United States Patent 11,098,302 (IDENTIFICATION OF POLYNUCLEOTIDES ASSOCIATED WITH A SAMPLE) - sequence listing, part 16

SEQ ID NO: 51940 - DNA, 566 bp, Homo sapiens
  misc_feature: GYAE6OF01BYVI0.18.11.A11.1.454.CMB.1.raw
  modified_base (207)..(207): a, c, t, g, unknown or other
  misc_feature (207)..(207): n is a, c, g, or t
  modified_base (509)..(509): a, c, t, g, unknown or other
  misc_feature (509)..(509): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagaggccaccatcaactgcaagtccagccagagtgttttanacagctcaaacataacaactactagcttggaccagacagaaaccaggacacgacccctaaggtcctctatttactgggacatcgtacccgggagtcccggggtccctgaccgattcgagaggcagcgggtctgggacagtactttcaccgttctcaaccactaccaacccaacctgaccgaggacctaggaacgattggtcggactaagttttattacgtgtacagtacaattactaattacgtccctctcgtactacggttcggcggaacggaccaagggtgaagataacgaacgtatggngctagccacgtactctcgtccttcgtacttcccgttacccgctatctcgtactaacg

SEQ ID NO: 51941 - DNA, 640 bp, Homo sapiens
  misc_feature: GYAE6OF01ADDW4.18.11.A11.1.454.CMB.1.raw
  modified_base (214)..(214): a, c, t, g, unknown or other
  misc_feature (214)..(214): n is a, c, g, or t
  modified_base (294)..(294): a, c, t, g, unknown or other
  misc_feature (294)..(294): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagacctccctggttgtgtctcgtgggcgagacgggccaccatcaactgcaagtccagccagtagttgttttaanacagctaccaacaataacaactacttagcttggtaccagcaagaaccaggaccacgccccctaaggtcctctatttacgngggcacgttccggtaccccggggacggtcccggggtcccctacggacccgtattcgaggacggcgacgggtcgggtcgtgggacagtactttccactcctcaacctatccaacctaaccgtcgaccgaggtctaggaacgagttggtacgggtcttaaggttttacttacgtgtaccagtactaacttactaattccgtcccttctctacgtacggttccggcggaacgggaaccgtaagggtcgaacgtactacgaaacgtcgtgtacggtcgtacgacctaccgtactccttaggttccttaccgtaccttcccgttccccacgtacttccgtactaacctacg

SEQ ID NO: 51942 - DNA, 526 bp, Homo sapiens
  misc_feature: GYAE6OF01CQ3TM.18.11.A11.1.454.CMB.1.raw
  modified_base (160)..(160): a, c, t, g, unknown or other
  misc_feature (160)..(160): n is a, c, g, or t
  modified_base (393)..(393): a, c, t, g, unknown or other
  misc_feature (393)..(393): n is a, c, g, or t
  modified_base (486)..(486): a, c, t, g, unknown or other
  misc_feature (486)..(486): n is a, c, g, or t
  modified_base (488)..(488): a, c, t, g, unknown or other
  misc_feature (488)..(488): n is a, c, g, or t
  modified_base (495)..(495): a, c, t, g, unknown or other
  misc_feature (495)..(495): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctntgggcgagagggccaccatcaactgcaagtccagccagagtgttttatacagctaccaacaataacaactacttagcttggtaccagcaagaaaccaggacacgccccctaaggtcctctatttactgggcatccgtacccgggagtcccggggtccctgaccgattcaggaggcaggcgggtcgtgggacagtatttcactctcaccatccaccaacctgcaggctagaagntggtgactagtttatactgtcagactaatactatacgtcctcctctcgtacgtcggacggacggaccaggtaggagtactacaaacgacgtgngncgcactntctgtcttcacttcctccactatctgactac

SEQ ID NO: 51943 - DNA, 526 bp, Homo sapiens
  misc_feature: GYAE6OF01B41ZO.18.11.A11.1.454.CMB.1.raw
  modified_base (461)..(461): a, c, t, g, unknown or other
  misc_feature (461)..(461): n is a, c, g, or t
  modified_base (514)..(514): a, c, t, g, unknown or other
  misc_feature (514)..(514): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaaacaataacaactacttagcttggtaccagcaagaaaccaggacagccccctaaggtcctcattactggcatccgtacccgggagtcccggggtcctgaccgatcagaggcagcgggtctgggacagatttcactctcaccatcaccaactgacaggctagaagatgtggactagtttatactgtacagcaaatactatacgtccctctctcgacgttcgggcggaacgggaccaagggtgaanataccaaaacggtactggtcggctgaccacattctgttctcattccttacccncatctgactacg

SEQ ID NO: 51944 - DNA, 528 bp, Homo sapiens
  misc_feature: GYAE6OF01DEGKE.18.11.A11.1.454.CMB.1.raw
  modified_base (382)..(382): a, c, t, g, unknown or other
  misc_feature (382)..(382): n is a, c, g, or t
  modified_base (481)..(481): a, c, t, g, unknown or other
  misc_feature (481)..(481): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacacgccccctaaggtcctcattactgggcatcgtacccgggagtcccggggtcctgaccgattcagaggcaggcgggtctgggacagtatttcactctcaccatcaccaactgcaggctgaagntgtgctagtttatactgtcagacaattactatacgtccctccttctcgtacgttcgggcggaacggaccgaaggtgggagatacgaaacgagtgtcggntcgcacctatctgttccttcattcccttcccgactatctgactaacg

SEQ ID NO: 51945 - DNA, 538 bp, Homo sapiens
  misc_feature: GYAE6OF01BNBN1.18.11.A11.1.454.CMB.1.raw
  modified_base (352)..(352): a, c, t, g, unknown or other
  misc_feature (352)..(352): n is a, c, g, or t
  modified_base (404)..(404): a, c, t, g, unknown or other
  misc_feature (404)..(404): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctaccaacaataacaactacttagcttggtaccagcagaaaccaggacacgccccctaaggtcctctatttacgtgggcatccgtaccccggggagtcccggggtccctcggaccgtattccgaggaggcaggcgggtcnggggacagatttcactctccacactccaccaacctgacaggctagaagatgngctagtttatactgtcagacaatactatacgtcctcctctcacgttcggcggaggacaggtgagatacgaacgtatggtgctgacctacgattcctgttccttacacttcccgttcccgcctatctgactaacg

SEQ ID NO: 51946 - DNA, 531 bp, Homo sapiens
  misc_feature: GYAE6OF01DVP5K.18.11.A11.1.454.CMB.1.raw
  modified_base (376)..(376): a, c, t, g, unknown or other
  misc_feature (376)..(376): n is a, c, g, or t
  modified_base (523)..(523): a, c, t, g, unknown or other
  misc_feature (523)..(523): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactggcatctacccgggagtcccggggtccctgaccgattcagagcagcggtctgggacagatttcactctcacatcaccaactgcagctagaagntgtgctagttttatactgtcagactatactatacgtcctcttctcacgttcggcggtagggaacctaaggtaggacgatacgaaacgacgtgtcggctacgcacctatcttagtccttcacttcccgttcccgactacttcgtaacnttaacccg

SEQ ID NO: 51947 - DNA, 518 bp, Homo sapiens
  misc_feature: GYAE6OF01AMZKQ.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagagcagcgggtctgggacagatttcactctcaccatccaccaacctgcaggctgaagatgtggctagtttattactgtcagcaatactatacgtcctcctctcacgttcggcggagggaccaaggtgagatacgaaacgactggtgctgacctaccagttctgtccttcacttccttcccgcctatcctgactacg

SEQ ID NO: 51948 - DNA, 653 bp, Homo sapiens
  misc_feature: GYAE6OF01BHCVL.18.11.A11.1.454.CMB.1.raw
  modified_base (286)..(286): a, c, t, g, unknown or other
  misc_feature (286)..(286): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagttgttttaatacagctccaacaataacaactacttagcttggtaccagcaagaaaccaggacacgcccctaaggtcctctattacngggcactcgtacccgggagtcccgggtccctggacccgattcgagagcaggcggtcgtgggacagacttcactctcacatcacacctgacaggctagaagtgtgtaggtactagtttacttacgtgtacctagtactaaattacttaagttacgtcccttcccgttactaccgtaccgggttccggggtaccgggtaacggggtaacccgtaaaggggtcgggaacgtaacgttaacccggtaaaccggtaaccgttagggtaccggtaccttacgggaccctaaacccgtacgtttaccgtacgtttcccgtttacacccgtttaccctacccccggacttaacgttccctaggtacccttaaccg

SEQ ID NO: 51949 - DNA, 702 bp, Homo sapiens
  misc_feature: GYAE6OF01BV8NE.18.11.A11.1.454.CMB.1.raw
  modified_base (235)..(235): a, c, t, g, unknown or other
  misc_feature (235)..(235): n is a, c, g, or t
  modified_base (341)..(341): a, c, t, g, unknown or other
  misc_feature (341)..(341): n is a, c, g, or t
tcagtacgagtatgcacgaccggtgctcgatttagctacgactgcaggggcagcaagatggtgttgcagacccaggtcttcatttctctgttgctctggatctcgtggtcgccggacgggacagtcggtgatcgacccagtcctaccagtaccttcccgtggttgtgtctcggtgggcgaggacgggaccaccataccaacgtgacaacgtccagtccgagtagttagttttaanacagtacctaccaaaactaactaacaacttacttagtcgttacggaaccagaccaaacggaaaaccaggaccaccggaccccgttaaggtcctataactttacggnggactacgtccggtaccgggacgtcccgggtcctaggacctattcgacggagtccgaggtccgggtatacgggactagtactttcgactccgtacaccatccaaccacgtgacgaggtactaggactagttcggtacgtacgttaagttttataccgttagtaccgaagttaacctaaagttacttacgttaccgtccctttaccgttacgtaccggtaccgggttaccgggacgggtaaacggtaaccgagggtacgaaagtacctaaacgtaacgaggtcggtcgactaccgtactaaccgtcgttacgttccttaccgttccacttccccgttaccacgtattccgaactacgtaccg

SEQ ID NO: 51950 - DNA, 558 bp, Homo sapiens
  misc_feature: GYAE6OF01A5CEI.18.11.A11.1.454.CMB.1.raw
  modified_base (207)..(207): a, c, t, g, unknown or other
  misc_feature (207)..(207): n is a, c, g, or t
  modified_base (384)..(384): a, c, t, g, unknown or other
  misc_feature (384)..(384): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagaggccaccatcaactgcaagtccagccagagtgttttanacagctccaacaataacaactacttagcttggtaccagcaagaaaccaggacagccccctaaggtcctcatttactgggcatctacccgggagtcccggggtcctgaccgattcagaggcaggcggtctgggacagtactttcactctcaccatccaccaacctgcaggcctgaagntgtgctagtttatctgtacagacaatactatacgtccctcctctcgtacgttccgggcggaacgggaccgaagggttcggaacgtacgtaccaaacgacgtgtcggctacggcaacccgtgttctcggttcttaccacttccctttcccccggactacttcctgtaccctaacg

SEQ ID NO: 51951 - DNA, 563 bp, Homo sapiens
  misc_feature: GYAE6OF01BYZSX.18.11.A11.1.454.CMB.1.raw
  modified_base (411)..(411): a, c, t, g, unknown or other
  misc_feature (411)..(411): n is a, c, g, or t
  modified_base (496)..(496): a, c, t, g, unknown or other
  misc_feature (496)..(496): n is a, c, g, or t
  modified_base (550)..(550): a, c, t, g, unknown or other
  misc_feature (550)..(550): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaaacaataacaactacttagcttggtaccagcaagaaaccaggaccacgccccctaaggtcctactactttaacgtgggctactaccgtaccccggggtacggtcccgggggtccccttggaccgattccgagacggcaggcgggtctgggacagtactttcactctcacatcaccaactgacaggctagaagtntgtggctagtttatacgtgtacatacaattactattacgtccctcctctacgtacggttccgacggacggacctaagggtggaanattacgaaacgactggtcgctgacaccgtatcgtcttcctcacgttccctcccncatctgtactacg

SEQ ID NO: 51952 - DNA, 549 bp, Homo sapiens
  misc_feature: GYAE6OF01BHOPZ.18.11.A11.1.454.CMB.1.raw
  modified_base (211)..(211): a, c, t, g, unknown or other
  misc_feature (211)..(211): n is a, c, g, or t
  modified_base (286)..(286): a, c, t, g, unknown or other
  misc_feature (286)..(286): n is a, c, g, or t
  modified_base (293)..(293): a, c, t, g, unknown or other
  misc_feature (293)..(293): n is a, c, g, or t
  modified_base (328)..(328): a, c, t, g, unknown or other
  misc_feature (328)..(328): n is a, c, g, or t
  modified_base (337)..(337): a, c, t, g, unknown or other
  misc_feature (337)..(337): n is a, c, g, or t
  modified_base (435)..(435): a, c, t, g, unknown or other
  misc_feature (435)..(435): n is a, c, g, or t
  modified_base (504)..(504): a, c, t, g, unknown or other
  misc_feature (504)..(504): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctcgtgggcgagagggccaccatcaactgcaagtccagccagagttgttttaanacagcctaccaaacaaataaacaactacttagcttggtaccagcaagaaaccaggacacgaccccctaagtcctnatttacnggcatccgtaccgggagtccgggcctgacatcagngcagcggtntgggacagatttcactctacaccatccaaccaacctgacaggctagaagtatggtgactagtttatactgtacagactaatactactacgtcctcctntcgtacgttcggcggaaggaccgaaggtgaagtactacgaaacgtacgtggtgactcgacctaaccgtntcctgttcttacgtactcctaccccgactaattcctagactaacg

SEQ ID NO: 51953 - DNA, 605 bp, Homo sapiens
  misc_feature: GYAE6OF01ALUU0.18.11.A11.1.454.CMB.1.raw
  modified_base (208)..(208): a, c, t, g, unknown or other
  misc_feature (208)..(208): n is a, c, g, or t
  modified_base (380)..(380): a, c, t, g, unknown or other
  misc_feature (380)..(380): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttanacagctccaacaataacaactacttagcttggtaccagcaagaaccaggacacgcccctaaggtcctcatttactgggcatccgtacccgggacgtccgggtcctgaccgattcagagcaggcgggtctgggacagatttcactctcacatcaccacctgcaggctagaagntgtgctagtttatactgtcagactaatactatacgtccctctcctctacggttcgggacgggtaacgggaaccgtaagggtaggtaacggtacgtaacgtaaaccggtaacgttcgggtacggtacctacggaccacccgtaacttccgttacggttccctttacccgtaacctttccccgttaccccggtacccttaacgttccgttcgtaaacccgttaaccg

SEQ ID NO: 51954 - DNA, 587 bp, Homo sapiens
  misc_feature: GYAE6OF01DK6XD.18.11.A11.1.454.CMB.1.raw
  modified_base (209)..(209): a, c, t, g, unknown or other
  misc_feature (209)..(209): n is a, c, g, or t
  modified_base (293)..(293): a, c, t, g, unknown or other
  misc_feature (293)..(293): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagttgttttanacagctaccaaacaataacaacttacttagcttggtaccagacaagaaaccaggacacgaccccctaaggtcctctatttacgngggacacgttccgtaccccggggacggttcccggggtccctcggaccgtatttcgaaggacggcgacggccgggtcgtgggactaggtactttccgacttcgtaccacctactccaacctaacctgaccaggtctagaagtatggtagtactagtttaatactgtacagactaatactatacgtcctctctacgtcgttcggcggaacgacgaaggtgagacacgaacgcgtgtcgctcgacaccgtattcgtcgttcttactacttcccgttcccgactattccgtgactacg

SEQ ID NO: 51955 - DNA, 630 bp, Homo sapiens
  misc_feature: GYAE6OF01CQ9VU.18.11.A11.1.454.CMB.1.raw
  modified_base (212)..(212): a, c, t, g, unknown or other
  misc_feature (212)..(212): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctcgtgggcgagagggccaccatcaactgcaagtccagccagtagttgttttaanacagctaccaacaaataacaactacttagcttggtaccagcaagaaaccaggacacgacccctaaggtcctcatttactggcatccgtacccgggagtcccgggtcctgaccgtattcgagacggcgaggcgggtctagggacagtactttccactcctacaccataccaaccaaccgtgacaggctagaaagtgtaggtacggtacttaagttttactaacgtgtacgaacgtactaaagttactaacgttacgtccctacccttcgtaccgtaccgggttaccgggacgggtaacgggaaccgaagggttacggagtaactaacgaaacgtacgtaggtcgctacggacctaccgtagttctcgttaccttctaaccttcccgttacccgacctacttaccgtcgtaacttaaccg

SEQ ID NO: 51956 - DNA, 661 bp, Homo sapiens
  misc_feature: GYAE6OF01C38CD.18.11.A11.1.454.CMB.1.raw
  modified_base (217)..(217): a, c, t, g, unknown or other
  misc_feature (217)..(217): n is a, c, g, or t
  modified_base (301)..(301): a, c, t, g, unknown or other
  misc_feature (301)..(301): n is a, c, g, or t
tcagtacgagtatgcacgaccggtgctcgatttagctacgactgcaggggcagcaagatggtgttgcagacccaggtcttcatttctctgttgctctggatctctggtgccggacggggacatcgtgatcgacccagtctccagactccctggttgtgtctcgtgggcgagacgggcccaccatacaactgacaagtccagccagagttgttttaanacagcctaccaacaaataacaactacttagcttggaccagacaagaaaccaggacaccgacccctaaggtcctactatttacgngggactacgtaccgtacccgggacggttcccggggtacccctaggacccgtattaccgaaggacggcgacggcgggtacgtcgggaacagtactttcaacttctaccacctactaccaacctaacctgaccaggtctaagaagtagtgtaggtcttaaggtttacttacgtgtacaagactaaatactataccgttccctacctgtacccgtacgggttaccgggacgggtaacgggaaccgtaaggggtacgtaagaactaaccgaaaacgtacggtggtcggacctacggaccctaacgacgttcgtacggttccttacaccgtttccctccccgactagttccacgtaacttaaccg

SEQ ID NO: 51957 - DNA, 509 bp, Homo sapiens
  misc_feature: GYAE6OF01BB3UB.18.11.A11.1.454.CMB.1.raw
  modified_base (338)..(338): a, c, t, g, unknown or other
  misc_feature (338)..(338): n is a, c, g, or t
  modified_base (388)..(388): a, c, t, g, unknown or other
  misc_feature (388)..(388): n is a, c, g, or t
  modified_base (491)..(491): a, c, t, g, unknown or other
  misc_feature (491)..(491): n is a, c, g, or t
  modified_base (504)..(504): a, c, t, g, unknown or other
  misc_feature (504)..(504): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcaagaaaccaggacacgccccctaagtcctcatttactggcatccgtacccgggagtcccggggtccctgaccgattcagagcaggcggtcngggacagtatttcactctccacatccaccaacctgcagctagaagatggngctagtttactactgtacagcaaatactatacgtcctcctctctacgttcggcggaggacctagggtgaagatacgaaacgtactgtgctgcacatctgtctnctctcccgcatcngctac

SEQ ID NO: 51958 - DNA, 508 bp, Homo sapiens
  misc_feature: GYAE6OF01CCPW8.18.11.A11.1.454.CMB.1.raw
  modified_base (210)..(210): a, c, t, g, unknown or other
  misc_feature (210)..(210): n is a, c, g, or t
  modified_base (286)..(286): a, c, t, g, unknown or other
  misc_feature (286)..(286): n is a, c, g, or t
  modified_base (301)..(301): a, c, t, g, unknown or other
  misc_feature (301)..(301): n is a, c, g, or t
  modified_base (454)..(454): a, c, t, g, unknown or other
  misc_feature (454)..(454): n is a, c, g, or t
  modified_base (478)..(478): a, c, t, g, unknown or other
  misc_feature (478)..(478): n is a, c, g, or t
  modified_base (483)..(483): a, c, t, g, unknown or other
  misc_feature (483)..(483): n is a, c, g, or t
tcagtacgagtatgcacgaccggtgctcgatttagctacgactgcaggggcagcaagatggtgttgcagacccaggtcttcatttctctcgttgctctggatcgtctggtgccgacggggacatcgtgatgacccagtctccagactccctggttgtgtctctgggcgagagggccaccatcaactgcaagtccagccagagtgttttanacagctccaacaactaacaactacttagcttggtaccagcaagaaaccaggacacgcccctaaggtcctcattacngggcatctaccgggngtccgggtcctgaccgattcagaggcaggcgggtctgggacagatttcgactctcaccatcacctaactgacaggctagaagatgtggactagtttactactgtcagacaatactatacgtcctctctcacgttcggcggaggaccaggtganactacaaagactgtgctgcacgtntactnttctctatcctccgcactctgctac

SEQ ID NO: 51959 - DNA, 591 bp, Homo sapiens
  misc_feature: GYAE6OF01B6MSO.18.11.A11.1.454.CMB.1.raw
  modified_base (210)..(210): a, c, t, g, unknown or other
  misc_feature (210)..(210): n is a, c, g, or t
  modified_base (295)..(295): a, c, t, g, unknown or other
  misc_feature (295)..(295): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctcgtgggcgagagggccaccatcaactgacaagtccagccagagtgttttanacagctaccaaacaaataacaaactacttagcttggaccagacaagaaaccaggacacgaccccctaaggtcctactatttacgngggcatccgtaacccggggaggttcccggggtccctggacccgattccaggaggcaggcggtctgggacagtattcactctacaccactccaccaactgacacggctagaacgtatggtggacttagtttacttactgtacaagactaaagttactaatacgtcctcctctacgtacggttcggacggacgggaaccaagggtgaagtactacgaaacgtacgtgtcggatcgacactacgttctcgttccttacgtaacttccccgttacccacctattcctacgtaacctaacg

SEQ ID NO: 51960 - DNA, 595 bp, Homo sapiens
  misc_feature: GYAE6OF01EIA3C.18.11.A11.1.454.CMB.1.raw
  modified_base (211)..(211): a, c, t, g, unknown or other
  misc_feature (211)..(211): n is a, c, g, or t
  modified_base (410)..(410): a, c, t, g, unknown or other
  misc_feature (410)..(410): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagttgtttttaanacagctaccaacaataacaactacttagcttggtaccagcaagaaaccaggaccacgcccccctaaggtcctactatttactgggacctagtccgtaccccggggacgtcccgggggtcccctggacccgattccgagaggcaggcggtctgggacagtatttcactctcaccatccaccaacctgcaggctagaagtntgtaggtctagtttattacgtgtacagactaaattactattacgtccctctcctcgtacggttcggacgggaacgggaccgaaggtaggagtactaacgaaacgtacgtggtcggctcgaaccaccgtagttccttagttcccttactacttcccgttaccccgacctattcctacgacttaacg

SEQ ID NO: 51961 - DNA, 696 bp, Homo sapiens
  misc_feature: GYAE6OF01D5S7P.18.11.A11.1.454.CMB.1.raw
  modified_base (390)..(390): a, c, t, g, unknown or other
  misc_feature (390)..(390): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagacctccctggttgtgtctcgtgggcgagagggccaccatcaactgcaagtccagccagagttgttttaatacagctaccaaacaaataacaactacttagcttaggtaccagacaagaaaccaggacacgaccccctaaggtcctactatttacaggactactaccggtacccggggacggttcccggggtccctacggaccgtattcgaggacggcgaggcgggtcgtagggacagtacttcactcnccacactaccaaccacctgacaggctagaagacgttggtacggtacttaaggttttatacgttgtacagtactaattactatacgttcccttcctcgtaccgtaccggtttaccgggacgggtaacggggaacccgtaaggggtacggaacgtaacgtaaccgaaaacggtacggttcggtacggaccttaccggaccctaacccggtacgtttaccgttaccggtttacccttacccgttaaccgtttccccccgttacccccggtaccctaacgtttacccgtaaccggtaaccttaaacccgg

SEQ ID NO: 51962 - DNA, 530 bp, Homo sapiens
  misc_feature: GYAE6OF01B4THR.18.11.A11.1.454.CMB.1.raw
  modified_base (208)..(208): a, c, t, g, unknown or other
  misc_feature (208)..(208): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttanacagctccaacaataacaactacttagcttggtaccagcaagaaaccaggacagccccctaaggtcctcatttactgggcatctacccgggagtccggggtccctgaccgattcagaggcagcgggtctgggacagattcactctcaccatccaccaacctgcaggctgaagatgtggctagtttatctgtcagcaattactatacgtcctacctctctacgttcgggcggacgggaccaagggtggaagactacgaaacgtactggtggctcgaccacctagtctgtccttcacttcccttcccgacctatcctgactacg

SEQ ID NO: 51963 - DNA, 533 bp, Homo sapiens
  misc_feature: GYAE6OF01B70QP.18.11.A11.1.454.CMB.1.raw
  modified_base (480)..(480): a, c, t, g, unknown or other
  misc_feature (480)..(480): n is a, c, g, or t
  modified_base (520)..(520): a, c, t, g, unknown or other
  misc_feature (520)..(520): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaaacaaataacaactacttagcttggtaccagcagaaaaccaggacagccccctaaggtcctcatttactgggcatctacccgggagtccggggtcctgaccgattcagaggcagcggtctgggacagacttcactctcaccactcaccaacctgcaggctagaagatgtggctagtttatactgtcagtacaatactatagtccctcctctccgacgttcggcgggaacgggtaaccaagggtggagactacgaaacggatgnggtactcgacacctatctgttcttcaactccgttaccccncatcctgactacg

SEQ ID NO: 51964 - DNA, 736 bp, Homo sapiens
  misc_feature: GYAE6OF01C0PCO.18.11.A11.1.454.CMB.1.raw
  modified_base (425)..(425): a, c, t, g, unknown or other
  misc_feature (425)..(425): n is a, c, g, or t
tcagtacgagtatgcacgaccggtgctcgatttagctacgactgcaggggcagcaagatggtgttgcagacccaggtcttcatttctctgttgctctggatctctggtgccggacggggacatcgtgatgacccagtctccagactccctggtgtgtctctgggcgagagggccaccatcaactgcaagtccagccaagtagtgttttatacagctaccaacaataacaactacttagcttggtaaccagcaagaaatcgaaggacaacgccccctaaggtcctactatttacgtgggacagtaccgtacccgggacgtcccgggtccctagaccgtattacagaggcaggcgggtctacggggacagtactttcgactcctaccaaccactccaacccaaaccgtgaccgaggactaggaacgngttacggtaggtacgttaaggtttttaacttacgttcggtaacctaacggtactaaaacgtttacttaaacgttaaccgtttcccccttacccgttcccgtttaacggtaaccccggggttttacggggaaccggggtaaaccggggaaccccggttaaaagggggttcggaaacggttaacttaaccggaaaaaccggtacgtttcggacgggtccctacggacccgtaacccgtaattcccgttcggttaccctttaccgtaacccgtttcccctttaccccgaccttaacttccgtaacgtaaacccg

SEQ ID NO: 51965 - DNA, 499 bp, Homo sapiens
  misc_feature: GYAE6OF01APJ16.18.11.A11.1.454.CMB.1.raw
  modified_base (468)..(468): a, c, t, g, unknown or other
  misc_feature (468)..(468): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaccaggacagccccctaaggtcctcattactgggcatctacccgggatccggggtcctgaccgattcagaggcagcgggtctgggacagatttcactctcaccatccaccaacctgcaggctgagatgtggcagtttattactgtcagcaatactatagtcctctctcacgttcggcggagggaccaggtgagatcgaaacgactgtggctgcaccgntctgtcttcatccttcccgctatctgctacg

SEQ ID NO: 51966 - DNA, 562 bp, Homo sapiens
  misc_feature: GYAE6OF01EJWOU.18.11.A11.1.454.CMB.1.raw
  modified_base (287)..(287): a, c, t, g, unknown or other
  misc_feature (287)..(287): n is a, c, g, or t
  modified_base (394)..(394): a, c, t, g, unknown or other
  misc_feature (394)..(394): n is a, c, g, or t
  modified_base (399)..(399): a, c, t, g, unknown or other
  misc_feature (399)..(399): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctaccaaacaataacaactacttagcttggtaccagcaagaaaccaggacacgccccctaaggtcctcatttacnggcatccgtacccgggagtcccggggtcctgaccgattcagaggcaggcgggtcgtgggaccagtatttcactctacaccatccaaccaacctgacaggctaggaanagtgngactagtttatctgtcagacaatactatacgtcctcctctctaccggttcgggcggaacggaccgaaggtggagtactaaccgaaacgtacgtggtcggactgaccaccgtattccgtggttcccttacgacttcccgtcccgacctattccgtgacctaacg

SEQ ID NO: 51967 - DNA, 777 bp, Homo sapiens
  misc_feature: GYAE6OF01CB86N.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgaggagggccaccatcaactgcaagtccagccagagtgttttatacagctaccaacaataacaactacttagcttggtaccagcaagaaaccaggacacgaccccctaaggtcctcactttactgggcatccgtacccgggaggtcccggggtccctaggaccgtacttcgaggacggacgaggcgggtcgtcgggactagtatttccacgttcctacaccacttaccaaccctaaaccctggaccgacggtacctacggaaagtacgttagggtcggtaccgttaaggtttttaactttaccgttacggttaccaacggtaccttaaaagttacccgttaactttaaccggttacccccttacccgttaccgttacccgtaacccgggttttaccggggaccggggtaaacggggtaacccgtaaacgggggttaggggtaaacgtaaaccgttaaccggaaaaacccgggttacctttacgggggttacggacccgttacggtaacccaccccgttaacgtttacccgttcgggtttaccctttcccctaaacgtttccccctttacccccggacccttaactttaccgtaccggtaacccttaaacccg

SEQ ID NO: 51968 - DNA, 563 bp, Homo sapiens
  misc_feature: GYAE6OF01BSII8.18.11.A11.1.454.CMB.1.raw
  modified_base (208)..(208): a, c, t, g, unknown or other
  misc_feature (208)..(208): n is a, c, g, or t
  modified_base (457)..(457): a, c, t, g, unknown or other
  misc_feature (457)..(457): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttanacagctaccaacaataacaactacttagcttggtaccagcaagaaaccaggacacgccccctaaggtcctcattactgggcatccgaccgggacgtcccggggtccctggaccgattccagaggcaggcgggtctgggacagtactttcactctacaccatccaaccaactgacaggctagaagtagtgtaggctaagtttattactgtacagtacaattactatacgtcctcctctacgtacgtcggnggaacgggtacctagggtgagtactaaccgaaaggactggcggtactgaccacgtcgttcttggtccttacacttcccgttacccgacctatcgtacgactaaccg

SEQ ID NO: 51969 - DNA, 625 bp, Homo sapiens
  misc_feature: GYAE6OF01DMKS0.18.11.A11.1.454.CMB.1.raw
  modified_base (296)..(296): a, c, t, g, unknown or other
  misc_feature (296)..(296): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatcgacccagtctccagactccctggttgtgtctcgtgggcgagagggccaccatcaactgcaagtccagccagtagttgttttatacagcctacaacaataacaacttacttagcttaggtaccagcaagaaaccaggaacacgacccctaaggtcctactatttacgngggactacgtaccggtacccggggacggttcccggggtaccctacggacccgtattccgaaggaggcgagggccgggtcgtacggggaactaggtactttccgaaccttcaccaccactaccgaacctaacgtcgaccgaggtcctaaggaagtagttggtacgtacttagttttaattacgtgtacagtactaatactattacgtccctctacgtcgtacggttcgggacggacggaacgaaggtcgaagactacgaacgtacgtgcgtctcgacctactactctcttcctctaccgttccctacccgtactattcctacgacttacg

SEQ ID NO: 51970 - DNA, 551 bp, Homo sapiens
  misc_feature: GYAE6OF01COUF1.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctaccaacaataacaactacttagcttggtaccagcagaaaccaggacacgccccctaaggtcctcatttacgtgggccattccgtaccccggggagtcccggggtccctggacccgattcgagaggcaggcgggtctgggacagtattcactctcacatccaccaacctgcaggctgagatgtgactagtttactacgtgtcagacaatactatacgtccctcctctcgacggttccgggcggtacgggaaccagggtgacgactacgaaacgtctggtcggctcgcacctattctgttcttacctattcccgttaccccgactattcctgacctacg

SEQ ID NO: 51971 - DNA, 725 bp, Homo sapiens
  misc_feature: GYAE6OF01BBCBV.18.11.A11.1.454.CMB.1.raw
  modified_base (701)..(701): a, c, t, g, unknown or other
  misc_feature (701)..(701): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctcgtgggcgagagggccaccatcaactgacaagtccagccagtagttgttttaatacagctaccaaaactaaactaaacctaacgtaactttaacgtcgtttacgggtaacccaagaccaaacggaaaaacccgagggaaaccaaccggtaacccccccgttaaagggttacccttacgtaattttaccgtacggggacctacgttacccggtaaccccggggacgggttcccggggtacccctacggaaccgtacttccgaacggacgggcgaacgggtcgggttcgaggggactaacggtactttccactcctacaacctactacccaacctaaccgtgacgaggtctaggaagtactgggtagtacgtagtttattacgtgtacaagtacctaaattacgttaatacgttccctccgtactccgaaggtttccggacgggtaacggtaccgaagggtagaacgactacgaaaccgtagtacggtacgcgtacgacctacgtacgttacttggttccttaccgtactttccccgttacccnctttaagcgttaacgccttaaacg

SEQ ID NO: 51972 - DNA, 539 bp, Homo sapiens
  misc_feature: GYAE6OF01DTGVB.18.11.A11.1.454.CMB.1.raw
  modified_base (208)..(208): a, c, t, g, unknown or other
  misc_feature (208)..(208): n is a, c, g, or t
  modified_base (370)..(370): a, c, t, g, unknown or other
  misc_feature (370)..(370): n is a, c, g, or t
  modified_base (381)..(381): a, c, t, g, unknown or other
  misc_feature (381)..(381): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttanacagctccaacaataacaactacttagcttggtaccagcagaaaaccaggacacgccccctaaggtcctcatttactgggcatctacccgggagtcccggggtccctgaccgattcagaggcagcggtcgtgggacagatttcactctcaccatcactaacngcagctgaagntgtgctagtttatactgtcagactaatactatcgtcctcctctcagttcggcggaggaccaagggtgagatacgaaacgactgtcggctgccgtaacctagttcttacgttccttacgtacttccccgttaccccgacctattccgtgtaacctaacg

SEQ ID NO: 51973 - DNA, 612 bp, Homo sapiens
  misc_feature: GYAE6OF01DCLRB.18.11.A11.1.454.CMB.1.raw
  modified_base (323)..(323): a, c, t, g, unknown or other
  misc_feature (323)..(323): n is a, c, g, or t
  modified_base (362)..(362): a, c, t, g, unknown or other
  misc_feature (362)..(362): n is a, c, g, or t
  modified_base (601)..(601): a, c, t, g, unknown or other
  misc_feature (601)..(601): n is a, c, g, or t
tcagtacgagtatgcacgaccggtgctcgatttagctacgactgcaggggcagcaagatggtgttgcagacccaggtcttcatttctctgttgctctggatctctggtgccggacggggacatcgtgatgacccagtctccagacctccctggttgtgtctcgtgggcgaggagggccaccatcaactgcaagtccagccagtagttgttttatacagcctaccaaacaataacaacttacttagcttaggaccagacagaaaccaggacacgcccctaaggtcctcatttacgtggcatccgtacccggagtcccgggtccnggaccgagttcgaggaggcgaggcgggtcgtggacagtntttcacgtctcacataccaccaacctgacacggctaggagtatggacggtctaagttttatacgtgtcgaagactaacgttactaattaccgtcctcctcttcgtaccggttcgggacgggaacgggaaccgtaagggtaggaacgtactaacgaaacggtacgttggtacggtctacgcctaaccgtagtacgtttcgtaccttacgtacctttcccgttaccccgacttcttaccgngtacctaaccg

SEQ ID NO: 51974 - DNA, 617 bp, Homo sapiens
  misc_feature: GYAE6OF01CEX2X.18.11.A11.1.454.CMB.1.raw
  modified_base (212)..(212): a, c, t, g, unknown or other
  misc_feature (212)..(212): n is a, c, g, or t
  modified_base (300)..(300): a, c, t, g, unknown or other
  misc_feature (300)..(300): n is a, c, g, or t
tcagtacgagtatgcacgaccggtgctcgatttagctacgactgcaggggcagcaagatggtgttgcagacccaggtcttcatttctctgttgctctggatctctggtgccggacggggacatcgtgatgacccagtctccagactccctggttgtgtctcgtgggcgaggagggccaccatcaactgcaagtccagccagagttgttttanacagcctaccaaacaaataacaacttacttagcttaggtaccagacaagaaaccaggacacgaccccctaaggtcctctattttacgnggcactccgtaccgggagtcccgggtcctagaccaattcagagcaggcgggtctagggacagtatttcgactctaccaccatccaaccaacctgacaggtctagaacgagtggtaggacttagtttatactagtacagactaatactatacgtccctctctcgacggttccggacggtaacgggacctaagggtcggaacgtacgtaaccgaaacggtaccgtggtacggtctacggacctaaccgtacttacgttacgttcccttacgtaccgttccccgttaccccgaccctattacccgtagtcccttaaaccg

SEQ ID NO: 51975 - DNA, 555 bp, Homo sapiens
  misc_feature: GYAE6OF01CX352.18.11.A11.1.454.CMB.1.raw
  modified_base (509)..(509): a, c, t, g, unknown or other
  misc_feature (509)..(509): n is a, c, g, or t
  modified_base (537)..(537): a, c, t, g, unknown or other
  misc_feature (537)..(537): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccaaacagaaaccaggacacgaccccctaaggtcctcatttactggcatcgtacccgggagtccggggtccctgaccgattcagaggcgaggcgggtctgggacagtactttcactctcaccatcaccaacctgcaggctagaacgatgtggtctagtttattactgtcagtactaattactatagtccctcctctcacgttcggcggaagggaccaagggtaggagtactacgaaacgacgtgtggctgaccgtaccacgtcgttntccttaccactttaccctcccgcttacncttacacctagttaaccg

SEQ ID NO: 51976 - DNA, 642 bp, Homo sapiens
  misc_feature: GYAE6OF01DM3XF.18.11.A11.1.454.CMB.1.raw
  modified_base (320)..(320): a, c, t, g, unknown or other
  misc_feature (320)..(320): n is a, c, g, or t
  modified_base (443)..(443): a, c, t, g, unknown or other
  misc_feature (443)..(443): n is a, c, g, or t
tcagtacgagtatgcacgaccggtgctcgatttagctacgactgcaggggcagcaagatggtgttgcagacccaggtcttcatttctctgttgctctggatctctggtgccgacgtggacatcgtgatgacccagtctccagactccctggttgtgtctcgtgggcgaggagggccaccatcaactgcaagtccagccagagttgttttatacagctaccaaacaataacaactacttagcttaggtaccagacaagaaaccaggacacgacccctaaggtcctactactttacgcgggtacacgtccgtaacccggggngtaccccggggtcccttacggaccgtaattcgaaggacggcgacggtcgggtcgtaggggaactaggtactttccactcctacaaccgtactaccgaaccaaccgtgacgacgctagaacgtntggtagtactagtttactacgtgtacagtactatactataccgtcctccttcgtacgtaccgggttacggaccggtacggggactaagggtacggacgtaataacccggaacgtaacggttgtacccggctacggaccctacccgtagttcgttcgttccttactacgttcccctcccgtaccacttcgcgttaacccg

SEQ ID NO: 51977 - DNA, 669 bp, Homo sapiens
  misc_feature: GYAE6OF01BA6KO.18.11.A11.1.454.CMB.1.raw
  modified_base (211)..(211): a, c, t, g, unknown or other
  misc_feature (211)..(211): n is a, c, g, or t
tcagtacgagtatgcacgaccggtgctcgatttagctacgactgcaggggcagcaagatggtgttgcagacccaggtcttcatttctctgttgctctggatctctggtgccggacggggacatcgtgatgacccagtctccagactccctggttgtgtctctgggcgagagggcccaccatcaactgcaagtccagccagagttgttttanacagctaccaaacaaataaccaactacttagcttggtaccagacaagaaaaccaggaacaccgacccccgtaacggtcctactatttacgtcgggactactaccgtaacccggggtacgtcccgggggtccctcggaccgtattccgaggacggcagggcgggtcgtgggacagtattccactctccaccacgtaccaaccaacctcgacacggtactacggaagacgtggtaggtaccttagttttaacttacgtcgtacaagtactaaacttaacttaacgtccgttcctacccttcctacgttacggttccgggacgggaacgggaacccgtaaggggtaggtaaacgtataacccggtaaaacctaggtacggtacgggacctcgaaccgaccgtattcgttacgttccttacctacgttcccctttacccgctagttacccgtgaacttaccg

SEQ ID NO: 51978 - DNA, 552 bp, Homo sapiens
  misc_feature: GYAE6OF01ASL0C.18.11.A11.1.454.CMB.1.raw
  modified_base (209)..(209): a, c, t, g, unknown or other
  misc_feature (209)..(209): n is a, c, g, or t
  modified_base (538)..(538): a, c, t, g, unknown or other
  misc_feature (538)..(538): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagttgttttanacagctaccaaacaataaccaactacttagcttggtaccagcagaaaccaggacacgaccccctaaggtcctactattacgtgggcatccgtacccgggacgtcccggggtccctggaccgtattcaggaggcaggtcgggtctgggactagtactttcactctcaccatccaccaacctgacaggctagaagatggtgacttagtttacttactgtacagactaatactattacgtcccttcctctactacggttcggacggaggaccaggtgagtatacaacgactggtcgctcgcaccgtatcgtcgttctctacttccctacccnctactcagtactac

SEQ ID NO: 51979 - DNA, 652 bp, Homo sapiens
  misc_feature: GYAE6OF01C20DY.18.11.A11.1.454.CMB.1.raw
  modified_base (207)..(207): a, c, t, g, unknown or other
  misc_feature (207)..(207): n is a, c, g, or t
  modified_base (214)..(214): a, c, t, g, unknown or other
  misc_feature (214)..(214): n is a, c, g, or t
  modified_base (229)..(229): a, c, t, g, unknown or other
  misc_feature (229)..(229): n is a, c, g, or t
  modified_base (383)..(383): a, c, t, g, unknown or other
  misc_feature (383)..(383): n is a, c, g, or t
  modified_base (388)..(388): a, c, t, g, unknown or other
  misc_feature (388)..(388): n is a, c, g, or t
  modified_base (398)..(398): a, c, t, g, unknown or other
  misc_feature (398)..(398): n is a, c, g, or t
  modified_base (436)..(436): a, c, t, g, unknown or other
  misc_feature (436)..(436): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactcccgtggttgtgtctcgtgggcgaggagggccaccatcaactgcaagtccagccagtagttnttttaanaccagcctaccaaanaaataacaacttacgtagcttggtaccagcaagaaaccacggacacgacccccttaaggtcctactactttacgcgggactacgtcccggtacccgggaggttccccggggtcctggaacccgattcgacggaggcacggcgggtctacggganacgtntttcacttcnccacactccaacctaacgtgaccgaggtctacgaagtntggtcgacttacgtttataccgtgtacacgataacttactaattacgtcctactctcgtaacggtcggacggtacgggaaccgttaagggcgtaacgactaaccgtaaacgacgtggtacgtacgttaccgacgtacccgtagttccgtttacgtccttttacgaccctttaccgttccccggtaactacctttacctaacggtaccttaaacccg

SEQ ID NO: 51980 - DNA, 569 bp, Homo sapiens
  misc_feature: GYAE6OF01C6PPJ.18.11.A11.1.454.CMB.1.raw
  modified_base (512)..(512): a, c, t, g, unknown or other
  misc_feature (512)..(512): n is a, c, g, or t
  modified_base (537)..(537): a, c, t, g, unknown or other
  misc_feature (537)..(537): n is a, c, g, or t
  modified_base (562)..(562): a, c, t, g, unknown or other
  misc_feature (562)..(562): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagcctaccaacaataacaactacttagcttggtaccagacagaaaccaggaacacgaccccctaaggtcctcatttactgggcatccgtacccgggaggtcccggggtccctcgaccgattcagaggcgaggcgggtcgtgggacagtactttcactcctccacctaactccaaccaacctcgacaggctacgaagtagtcgtgggacctaaggttttatactggtcaagacaatactatacgtccctccttctcgtacggttcggacgggaagggacctaagggtcgagataccaaacggntggtcggctgaccacgacttcgttntctcacttcccttcccgactatccngtactac

SEQ ID NO: 51981 - DNA, 630 bp, Homo sapiens
  misc_feature: GYAE6OF01B54E9.18.11.A11.1.454.CMB.1.raw
  modified_base (214)..(214): a, c, t, g, unknown or other
  misc_feature (214)..(214): n is a, c, g, or t
  modified_base (291)..(291): a, c, t, g, unknown or other
  misc_feature (291)..(291): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagacctccctggttgtgtctcgtggggccgagacgggccaccatcaactgcaagtccagccagagttgtttaanacagctaccaaacaataacaactacttagcttggtaccagcagaaccaggacacgcccctaaggtcctcatttacgnggcatccgtacccgggagtccgggtcctggaccgtattcagaggcaggtcgggtctcgggacaggtactttcacttctacacctacgtaccaacctaaccgtgaccgtacggtcctaggaacgtagtcggtacggtacttaacggtttacttacgtgtacacgtactaacttactagtaccgtcctacctcgtactacggttcgggacggtaacgggacctaagggtcgaacggtactaaccgtaaacggtactacggtacggtctacggacctacgtacttacgttcggttaccttacctacgttcccgttacccgacttatccgttagaccgttaac

SEQ ID NO: 51982 - DNA, 499 bp, Homo sapiens
  misc_feature: GYAE6OF01E00LQ.18.11.A11.1.454.CMB.1.raw
  modified_base (461)..(461): a, c, t, g, unknown or other
  misc_feature (461)..(461): n is a, c, g, or t
  modified_base (470)..(470): a, c, t, g, unknown or other
  misc_feature (470)..(470): n is a, c, g, or t
  modified_base (472)..(472): a, c, t, g, unknown or other
  misc_feature (472)..(472): n is a, c, g, or t
  modified_base (488)..(488): a, c, t, g, unknown or other
  misc_feature (488)..(488): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacacgccccctaaggtcctcattactgggcatctaccgggagtccggggtccctgaccgattcagagcagcgggtctgggacagatttcactctcacatcaccaacctgcaggctgaagatgtgctagtttattactgtcagctaatactactagtcctctctctacgttcggcggagggaccaggtgagatacaaacgactgngctcgcacntntgtcttcatcctcccnctatctgctac

SEQ ID NO: 51983 - DNA, 676 bp, Homo sapiens
  misc_feature: GYAE6OF01BCA6B.18.11.A11.1.454.CMB.1.raw
  modified_base (210)..(210): a, c, t, g, unknown or other
  misc_feature (210)..(210): n is a, c, g, or t
  modified_base (293)..(293): a, c, t, g, unknown or other
  misc_feature (293)..(293): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctcgtgggcgagagggccaccatcaactgcaagtccagccagagttgttttanacagctaccaaacaataacaactacttagcttaggtaccagcaacgaaaccaggacacgacccctaaggtcctactattacgngggctactccgtaccgggacgtcccgggtccctagaccgtattcgagacggcgacggtcgggtcgtagggactagtactttcaccgttctaccaacctactaccaacctaaccgtcgaccgtaggtacctaacgaagtacgttggtacgtacttaaggttttacttacgtagtaccagtacctaaattacgttatacgttccccttccgttacctacggttaaccggtttccgggaacgggtaccgggtaacccgtaaggggttacggaacgtaacgtaacgtaaaacggtacgttagggtaccggtacctacggaccctaaccgtctttccgtacgttcctacgtaccttccccgtacccgactattccgacgtcctaaccg

SEQ ID NO: 51984 - DNA, 533 bp, Homo sapiens
  misc_feature: GYAE6OF01B18S8.18.11.A11.1.454.CMB.1.raw
  modified_base (208)..(208): a, c, t, g, unknown or other
  misc_feature (208)..(208): n is a, c, g, or t
  modified_base (287)..(287): a, c, t, g, unknown or other
  misc_feature (287)..(287): n is a, c, g, or t
  modified_base (490)..(490): a, c, t, g, unknown or other
  misc_feature (490)..(490): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttanacagctaccaaacaataacaactacttagcttggtaccagcaagaaaccaggacacgccccctaaggtcctcatttacngggcatcgtacccgggagtccggggtcctgaccgattcagaggcaggcggtctgggacagatttcactctcaccatccaccaactgcaggctagaagatggtggactagtttactacgtgtacagactaatactatacgtcctcctctctacgttcggacggtaggaccaaggtgacgatacaaacgactgtacgctgcactnttctgttccttacgacttcccgttcccgactaatctgactacg

SEQ ID NO: 51985 - DNA, 729 bp, Homo sapiens
  misc_feature: GYAE6OF01C5QXX.18.11.A11.1.454.CMB.1.raw
  modified_base (293)..(293): a, c, t, g, unknown or other
  misc_feature (293)..(293): n is a, c, g, or t
tcagtacgagtatgcacgaccggtgctcgatttagctacgactgcaggggcagcaagatggtgttgcagacccaggtcttcatttctctgttgctctggatctctggtgccggacggggacatcgtgatgacccagtcctccagacctccctggttgtgtctcgtgggcgaggagggccaccatcaactgcaagtccagccagagttgttttatacagctaccaacaataacaactacttagcttggtaccagacagaaaccaggacacgcccctaaggtcctacatttacgngggcactccggtaaccccgggaggtcccgggggtccctcggaccgattcgaggacggcgacggtcggggtacgtgggacagtactttcactactaccaccaactccgaaccaacctgacgacggtactaggaacgtatacgggtcggtaccgttaagttttaactacgttcggttacaagtacctaaacttacttaacgtacgttcccctccttactcgaccggtttccggggacgggtaacggggtaaccgtaagggtacggggaacgtaacgtaacggtaaaacccggtagttaacgggtcggtacccgtacggtaaccctaaccgtaacgtttccctttaccgggttacccttttacccttaacccgggtttacccccttttacccccgggaaccctttaggttaaccccgttaacgggttaacccttaaccg

SEQ ID NO: 51986 - DNA, 530 bp, Homo sapiens
  misc_feature: GYAE6OF01APSW6.18.11.A11.1.454.CMB.1.raw
  modified_base (488)..(488): a, c, t, g, unknown or other
  misc_feature (488)..(488): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaaatacttagcttggtaccagcaagaaaccaggacagccccctaaggtcctcattactgggcatctaccgggagtccggggtccctgaccgattcagaggcagcgggtctgggacagatttcactctcacatcaccaacctgcaggctagaagatgtgctagtttatactgtcagctaaatactaatacgtccctctctctacgttccgggacggagggaccaagggtgagatacgaaacgtactggtgacgtgaccaccgtntctggtctttcatttccctcccgccaattcctagaaccctag

SEQ ID NO: 51987 - DNA, 520 bp, Homo sapiens
  misc_feature: GYAE6OF01AZCOH.18.11.A11.1.454.CMB.1.raw
  modified_base (379)..(379): a, c, t, g, unknown or other
  misc_feature (379)..(379): n is a, c, g, or t
  modified_base (486)..(486): a, c, t, g, unknown or other
  misc_feature (486)..(486): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacacgcccctaaggtcctcattactgggcatctaccgggagtccggggtccctgaccgattcagaggcagcgggtctgggacagatttcgactctcaccatcaccaacctgcaggctgaagngtgtgctagtttatactgtacagtacaatactatacgtcctacctctcacggttcggcggacggaccgaggtgaagtactacgaaacgactgtaggctcgcaccgtntctgtccttcacttcctcccgctatctgactacg

SEQ ID NO: 51988 - DNA, 566 bp, Homo sapiens
  misc_feature: GYAE6OF01EHBXP.18.11.A11.1.454.CMB.1.raw
  modified_base (283)..(283): a, c, t, g, unknown or other
  misc_feature (283)..(283): n is a, c, g, or t
tcagtacgagtatgcacgaccggtgctcgatttagctacgactgcaggggcagcaagatggtgttgcagacccaggtcttcatttctctgttgctctggatctctggtgccgacgggacatcgtgatgacccagtctccagactccctggttgtgtctctgggcgagagggccaccatcaactgcaagtccagccagagttgttttatacagctccaacaataacaactacttagcttggtaccagcaagaaaccaggacacgcccctaaggtcctcattacnggcactcgtaccgggacgtccggggtccctgaccgattcgagaggcagcggtctgggacagtattcactctcaccataccaaccaacctgcaggactagaagatggtgactagttattactgtacagcaatactatacgtcctctctcgtacgttcggacggtaggaccaggtggaagtactacgaaacgtacgtggtcgacgttacgacctaccgtacgttcctacggtttcccttactacccttcccgttaccccgacctaccttcgttacgaccttaacg

SEQ ID NO: 51989 - DNA, 649 bp, Homo sapiens
  misc_feature: GYAE6OF01A5BQ0.18.11.A11.1.454.CMB.1.raw
  modified_base (208)..(208): a, c, t, g, unknown or other
  misc_feature (208)..(208): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttanacagctccaacaataacaactacttagcttggtaccagcaagaaaccaggaccacgccccctaaggtcctactatttactgggcactcgtacccgggagtcccggggtccctgaccgattcgagacggcagcgggtctgggacagtatttcactcgtacaccatccaccaacctgcaggctagaagagtgtacgcgtagtttacttacgtgtacagtactaagtacttaatccggttccctccctacttcgtaccggttccgggacggtaacggaaccgtaagggtcgggaagtaacgttaaccgaaaccggtaacgttggtacggtccgtacgaccctaacccgtacgtttacccgttacggtttaccctttacctaacccgtttcccccgtttacccccggacccttaacgttccccgttaggtaacccctttaaacgg

SEQ ID NO: 51990 - DNA, 532 bp, Homo sapiens
  misc_feature: GYAE6OF01B825R.18.11.A11.1.454.CMB.1.raw
  modified_base (389)..(389): a, c, t, g, unknown or other
  misc_feature (389)..(389): n is a, c, g, or t
  modified_base (493)..(493): a, c, t, g, unknown or other
  misc_feature (493)..(493): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctaccaacaataacaactacttagcttggtaccagcaagaaaccaggacacgcccctaaggtcctcatttactgggcatcctacccgggacgtccggggtccctgaccgattcagaggcaggcgggtctgggacagatttcactctacaccatccaaccaacctgacaggctgaagntgtggactagtttatactgtcagcaatactatactcctcctactctacgttcgggcgacgggaccaaggtgagtatacgaaacgacgtgtgcgtgaccaccgtntctgttccttcacttccttccccgactagtctgctaacg

SEQ ID NO: 51991 - DNA, 600 bp, Homo sapiens
  misc_feature: GYAE6OF01D4419.18.11.A11.1.454.CMB.1.raw
  modified_base (208)..(208): a, c, t, g, unknown or other
  misc_feature (208)..(208): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttanacagctccaacaataacaactacttagcttggtaccagcaagaaaaccaggacacgccccctaaggtcctacatttactgggcatcctacccggggagtcccggggtcctgaccgattcagaggcaggcgggtctgggacagtacttcactctcaccatccaccaacctgcaggctagaagatggtgactaagtttattactgtcagacaatactatacgtcctcctctctacggttcggacggaacggaccagggtgagatacgaaacgtactggtacggcttacggacctaaccgtaacttccgttacggtttccctttaccgtaaccgtttcccccgttttaccccccgggaccccttaagtttccccgttaaggaacccttaaacccg

SEQ ID NO: 51992 - DNA, 572 bp, Homo sapiens
  misc_feature: GYAE6OF01EZLSK.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaaacaataacaactacttagcttggtaccagcagaaaccaggacacgccccctaaggtcctctatttactgggcatctacccgggagtcccggggtcctgaccgattcagaggcagcggtctgggacagtattcactctcacatcaccaactgcaggctagaagatgtgctaagtttattactgtcagctaagtactatacgtcctcctctactacgttcggcggaagggaccaagggtcggaagtactacgaaacgtacgttcggaggtcctcgaccaacccgtaactttccgttcggttacctttacctacttcccccgtttaccccgaccctacttcgttacgtaactaaccg

SEQ ID NO: 51993 - DNA, 578 bp, Homo sapiens
  misc_feature: GYAE6OF01ERRZ3.18.11.A11.1.454.CMB.1.raw
  modified_base (208)..(208): a, c, t, g, unknown or other
  misc_feature (208)..(208): n is a, c, g, or t
  modified_base (289)..(289): a, c, t, g, unknown or other
  misc_feature (289)..(289): n is a, c, g, or t
  modified_base (396)..(396): a, c, t, g, unknown or other
  misc_feature (396)..(396): n is a, c, g, or t
tcagtacgagtatgcacgaccggtgctcgatttagctacgactgcaggggcagcaagatggtgttgcagacccaggtcttcatttctctgttgctctggatctctggtgccgacgggacatcgtgatgacccagtctccagactccctggttgtgtctctgggcgagagggccaccatcaactgcaagtccagccagagttgttttanacagctaccaaacaataacaactacttagcttaggtaccagcaagaaaccaggacacgacccctaaggtcctacatttacnggcagtccgtacccgggacgtcccggggtccctggaccgattcgaggacggcaggcggtcgtgggacagtatttcactctcaccatccaccactgcagcagagatgngtactagtttatactgtacagactaagtactatacgtccctcctctaccgtacggttcgggacggacgggtaaccgtaagggtacggaagtacgtaacgaaacggtacgtggtcggactcgaccaccgtattccttcgttccttcctaacgttcccgttaccccgactatctagacctaacg

SEQ ID NO: 51994 - DNA, 547 bp, Homo sapiens
  misc_feature: GYAE6OF01CCOSM.18.11.A11.1.454.CMB.1.raw
  modified_base (346)..(346): a, c, t, g, unknown or other
  misc_feature (346)..(346): n is a, c, g, or t
  modified_base (404)..(404): a, c, t, g, unknown or other
  misc_feature (404)..(404): n is a, c, g, or t
  modified_base (482)..(482): a, c, t, g, unknown or other
  misc_feature (482)..(482): n is a, c, g, or t
  modified_base (495)..(495): a, c, t, g, unknown or other
  misc_feature (495)..(495): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagttgttttatacagctaccaaacaataaacaactacttagcttggtaccagcaagaaaccagacacgacccctaagtcctcattacgtggcatccgtacccgggagtcccggggtccctgaccgtattccgagaggcaggcgggtcngggacagtactttcactccgtacaccataccaaccaacctgaccaggctaggaaacgngtaggtcggataggttttatctgtcaagctaatactatcgtccctctctcgacgttcggcggaggaccaaggtgatanaacgaacgtatgngctgaccaccgtatctcgtcctcacttccgtcccgctagtcctagacctacg

SEQ ID NO: 51995 - DNA, 614 bp, Homo sapiens
  misc_feature: GYAE6OF01AFY0I.18.11.A11.1.454.CMB.1.raw
tcagtacgagtatgcacgaccggtgctcgatttagctacgactgcgagggcagcaagatggtgttgcagacccaggtcttctatttctctgttgctctggatctctggtgccgacggggacatcgtgatgacccagtctcctagactccctggttgtagtctctgggcgagagggccaccatcaactgacaagtccgagccaggagtgttttagtacagctaccaacaataacaactacttagcttggtaccagctaacgaacaggaccacgaccccgtaaggtcctactattacgtggcacgtccgtaccgggacggtcccgggtcctgaccgattcgaggacggcgagggtcgggtctgggacagtactttcaacttctacaccactccaacctaccgtcgaccgacggtctagaagtacgtcggtggaccttagtttactacgtcgtacacgtactaattactagtctacctctaccgtacgtacgtcggcggaacggaccgagggtgtaactactacgaacgtacgtggtggcttacgactaccgtacgttcttacgttccttacgtaccttcccggttaccgaccctagttaccgtcgtaccttaaccg

SEQ ID NO: 51996 - DNA, 508 bp, Homo sapiens
  misc_feature: GYAE6OF01DQDIE.18.11.A11.1.454.CMB.1.raw
  modified_base (357)..(357): a, c, t, g, unknown or other
  misc_feature (357)..(357): n is a, c, g, or t
  modified_base (454)..(454): a, c, t, g, unknown or other
  misc_feature (454)..(454): n is a, c, g, or t
  modified_base (479)..(479): a, c, t, g, unknown or other
  misc_feature (479)..(479): n is a, c, g, or t
  modified_base (497)..(497): a, c, t, g, unknown or other
  misc_feature (497)..(497): n is a, c, g, or t
  modified_base (503)..(503): a, c, t, g, unknown or other
  misc_feature (503)..(503): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcaagaaaccaggacacgccccctaaggtcctcatttactgggcatcgtacccgggagtcccggggtcctgaccgattcagaggcagcgggtcgtgggacagatttcactcncaccatcaccaacctgcaggctagaagatgtggactagtttatactgtcagctaatactatacgtcctctctcacgttcggcgagggaccaggtganagtacaaacgactgtgctgacaccntctgtctctatcctcccnctatcngctac

SEQ ID NO: 51997 - DNA, 799 bp, Homo sapiens
  misc_feature: GYAE6OF01CSVEK.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtgccggacggggacatcgtgatcgacccagtctccagacctccctggttgtgtctcgtgggcgagagggccaccatcaactgacaacgtccagccagtagttgttttatacagcctaccaaacaaataacaacttacttagcttaggtaccagacaacgaaaccacggacacgacccctaaggtcctactactttacgtcgggcacgttaccggtaacccgggacggttcccggggtacccgtacggaccggtatttacgaggacggacgacgggtcgggttcgtacgggaactacggtacttttaccgaaccttactaccctaaccgtaacttacccaaaccctaaacccgttcggaaccgtaacggtaccgttaaggaaacggttacgttaacgggttcggaacgttttaaacgttttttaacgttaaccgttacgttaaccgaaggtaaacctaaaacgttttacgtaaacgtttaccgtttccccttacccgttacgtttacccgttaccggggtttaccggggaacggggtaacggggtaacccgtaagggggttacggaagtaaaccgttaaccggtaaaacggtacgttacggtaccggtactacggacctaacccgtagttcccgttacgtttccttaccgtactttccccgttacccgaccttagtaccctagtacctaaccg

SEQ ID NO: 51998 - DNA, 531 bp, Homo sapiens
  misc_feature: GYAE6OF01ESNSP.18.11.A11.1.454.CMB.1.raw
  modified_base (207)..(207): a, c, t, g, unknown or other
  misc_feature (207)..(207): n is a, c, g, or t
  modified_base (383)..(383): a, c, t, g, unknown or other
  misc_feature (383)..(383): n is a, c, g, or t
  modified_base (386)..(386): a, c, t, g, unknown or other
  misc_feature (386)..(386): n is a, c, g, or t
  modified_base (519)..(519): a, c, t, g, unknown or other
  misc_feature (519)..(519): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagaggccaccatcaactgcaagtccagccagagtgttttanacagctaccaacaataacaactacttagcttggtaccagcagaaaccaggacacgccccctaaggtcctctatttactgggcatccgacccgggagtcccggggtccctgacccgatccgagaggcaggcggtctgggacagatttcactctcacatccaccactgcagctagagntgngactagtttatactgtcagtacaatactatactcctcctctacgtacgtcggcggaaggaccgaagggtgaacgtataacgaaccgtacgtggtggctcgaccaccgattcgtattcttcacttcccgtcccnctatctgctacg

SEQ ID NO: 51999 - DNA, 610 bp, Homo sapiens
  misc_feature: GYAE6OF01C6TAN.18.11.A11.1.454.CMB.1.raw
  modified_base (297)..(297): a, c, t, g, unknown or other
  misc_feature (297)..(297): n is a, c, g, or t
  modified_base (408)..(408): a, c, t, g, unknown or other
  misc_feature (408)..(408): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagacctccctggttgtgtctcgtgggcgagagggccaccatcaactgcaagtccagccagtagttgttttatacagcctaccaacaaataacaactacttagcttggtaccagcaacgaaaccaggacacgaccccctaaggtcctactaatttacngggcactccgtacccgggagtcccgggtcctcgaccgtattcagacggcgaggcgggtctcgggacagtactttcactctccaccatccaaccactgacaggctagaagtntagtggcttaagttttactactgtacaagtactaaattacctataccgtccctcttctaccgtacgtacgggacgggaaccggacgaagggtagactaagtacccgaaacggtacttcggtcggacttaccgactaccgtactcgttacgttccttacgtaccttccccgttaccccgactaaccttctacgtacttacccg

SEQ ID NO: 52000 - DNA, 634 bp, Homo sapiens
  misc_feature: GYAE6OF01AL7U6.18.11.A11.1.454.CMB.1.raw
  modified_base (209)..(209): a, c, t, g, unknown or other
  misc_feature (209)..(209): n is a, c, g, or t
tcagtacgagtatgcacgaccggtgctcgatttagctacgactgcaggggcagcaagatggtgttgcagacccaggtcttcagtttctctgttgctctggatctctggtgccgacggggacatcgtgatgacccagtctccagactccctggttgtgtctctgggcgagagggccaccatcaactgcaagtccagccagagtgttttanacagctccaacaactaacaactacttagcttggtaccagccagaacccaggacagcccctaaggtcctcattactgggcatccgtacccgggtagtcccggggtccctggaccgtaattccgaggacggcaggtcgggtctgggacagtatttcactctcaccataccaccaactgcaggctgagatgtgctagtttatactgtacagcaatactatacgtcctcctctctacggttccggcggaacgggtaaccaagggtcggaacgtagttaacgaaaccggtaacttcgggtacggtcctacgggtaaccctacccgtaacgtttccgttacggtttccctttaccgtaaaccgttttcccccggtttaaccccccggacccttaaccgtttacccgttaccgggtaaccctttaaacccgg

SEQ ID NO: 52001 - DNA, 522 bp, Homo sapiens
  misc_feature: GYAE6OF01ETWTH.18.11.A11.1.454.CMB.1.raw
  modified_base (467)..(467): a, c, t, g, unknown or other
  misc_feature (467)..(467): n is a, c, g, or t
  modified_base (480)..(480): a, c, t, g, unknown or other
  misc_feature (480)..(480): n is a, c, g, or t
  modified_base (490)..(490): a, c, t, g, unknown or other
  misc_feature (490)..(490): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctaccaacaataacaactacttagcttggtaccagcagaaaccaggacagccccctaaggtcctcatttacgtgggcactctacccggggagttcccgggggtccctggacccgattcagagcaggcgggtctgggacagactttcgactctcaccatccaaccaactgcaggctagaagatgtggctagtttactactgtcagactaatactatactcctctctcacggttcgacggacgggaacagggtaganatacaacgagtgngctcgcactntctctcttcacttcctcccgctatctgactac

SEQ ID NO: 52002 - DNA, 652 bp, Homo sapiens
  misc_feature: GYAE6OF01B9DTD.18.11.A11.1.454.CMB.1.raw
  modified_base (208)..(208): a, c, t, g, unknown or other
  misc_feature (208)..(208): n is a, c, g, or t
  modified_base (286)..(286): a, c, t, g, unknown or other
  misc_feature (286)..(286): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttanacagctaccaaacaataacaactacttagcttggtaccagcaagaaaccaggacacgacccctaagtcctcatttacngggcatccgtacccgggagtccggggtccctgaccgattcagaggcgaggcggtctgggacagtatttcactctccactactccaaccaacctgacgaggctaggaagtagtggtaggtaccttaaggttttaactttacgtgtactaacggactaaattacttaacgttaacgttccccttcccttacgttacccgtaccggtttccgggacgggtaaccgggaacctaagggtacgggaagtaacgtaacgaaaccgtacgtaggtcggtaccgtacgaccgtaccgtattccgttacggttcccttaccgtaactttccccgttaccccgaaccttagttacccttacggtaaccttaaaccg

SEQ ID NO: 52003 - DNA, 710 bp, Homo sapiens
  misc_feature: GYAE6OF01CS7XJ.18.11.A11.1.454.CMB.1.raw
  modified_base (209)..(209): a, c, t, g, unknown or other
  misc_feature (209)..(209): n is a, c, g, or t
  modified_base (290)..(290): a, c, t, g, unknown or other
  misc_feature (290)..(290): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagttgttttanacagtctaccaaacaataacaacttacttagcttggtaccagcaagaaaccaggacacgcccctaaggtcctacattacgngggacagtcgtacccgggagtcccgggtcctgaccagattcgagtggacaggcggtctggacagtacttacactctacaaccataccaaccgaccttgaccgtacgggtacctaggaacgacgttcggtacgggtacttaagttttacttaacgttcgttacgaagtacctaaataccgtaagttaaccgtcccgttcccttactaccggtaacgggtttccgggacgggtaacgggaaccccgtaaggggttacgaacggtaacgtttaaccgaaacgggttaaaccttcggggttacgtacccgttaggaacccgtaacccgtagtttacccgttacgggtttaccccttttaaccggaccgtttaccccgttacccccggtaacccttaacggtttacccgtaacggttaaaccccg

SEQ ID NO: 52004 - DNA, 641 bp, Homo sapiens
  misc_feature: GYAE6OF01A1GZ6.18.11.A11.1.454.CMB.1.raw
  modified_base (210)..(210): a, c, t, g, unknown or other
  misc_feature (210)..(210): n is a, c, g, or t
  modified_base (395)..(395): a, c, t, g, unknown or other
  misc_feature (395)..(395): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctcgtgggcgagagggccaccatcaactgcaagtccagccagagttgttttanacagctaccaaacaataacaactacttagcttggtaccagcagaaaccaggacacgccccctaaggtcctcatttactgggacatccgtacccggggagttcccggggtccctagaccgattcgagaggcaggcggtcgtgggacagactttcactctcacactcaccaactgacaggctgaagntggtggtctagtttattactgtctagactaacgttactaatacgttccctacccgtctccgtacggtttccgggacgggtaaccgggaaccgtaacggggttagggaaacgtacgttaaaccggtaaaccggtaaccgttacgggtcgggtaccttccggaaccgtacccgtacgttaccttcggttacctttccaacgtttcccccgttccccgtactacctttaccgtcggtaacccttacccg

SEQ ID NO: 52005 - DNA, 786 bp, Homo sapiens
  misc_feature: GYAE6OF01BNEOU.18.11.A11.1.454.CMB.1.raw
  modified_base (209)..(209): a, c, t, g, unknown or other
  misc_feature (209)..(209): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagttgttttanacagctaccaaacaaataaccaactacttagcttggtaccagacaagaaaccaggaccacgaccccctaaggtcctactactttacgtgggacactaccgtaccccggggtacgtcccgggggtaccctaggaccgtattccgaaggacggcgacgggtcgggtcgtagggaccaggtactttccaacttactccgaacctacgtaccaacccgtaaacctcggtacgtaaacgggccttaaggaaaggtacgttggtacgggtacgttaacggtttttaacgtttaacgttcggtaacctaacggtaaccttaaaacgtttaaccgttaacgtttaaccggttacccctttacccgtttaccttaccggttaaccccggggtttccggggtaacccggggtaacggggtaaacccgtaaaggggtacgggtaaacgtaaccgtaaaccggtaaaccggtaacgttacgggttacggtacccgtacggacccgtaaccgtacttacttacggttcctttaccgttaacctttcccgttaccccgtaccctaacgttccgttagtaacccttaaaccg

SEQ ID NO: 52006 - DNA, 611 bp, Homo sapiens
  misc_feature: GYAE6OF01CERWM.18.11.A11.1.454.CMB.1.raw
  modified_base (212)..(212): a, c, t, g, unknown or other
  misc_feature (212)..(212): n is a, c, g, or t
  modified_base (225)..(225): a, c, t, g, unknown or other
  misc_feature (225)..(225): n is a, c, g, or t
  modified_base (262)..(262): a, c, t, g, unknown or other
  misc_feature (262)..(262): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatcgacccagtctccagactccctggttgtgtctctgggcgagacgggccaccatcaactgcaagtccagccagagttgttttaanacagctaccaaanaaataacaactacttagcttggaccagcaagaaaccnggaacacgaccccctaaggtcctactatttacgtgggactacgtaccgtacccggggacgtcccggggccccttagaccggtattcgaggacggcgaggccgggtctagggacagtactttcactctcaccataccaacaactgacaggctagagactggtcgactagtttactacgtgtacagtactaagtactaagtacgtcctactctactacggttcggacggaacggtaccgtaagggtacgaacgtacgtaacgaaacgtaccgtagtcggtctacgaccgtactattacgtcgtttaccttacgtacttccgtaccccgacttatacgttcgaaccttaacg

SEQ ID NO: 52007 - DNA, 562 bp, Homo sapiens
  misc_feature: GYAE6OF01A3MKH.18.11.A11.1.454.CMB.1.raw
  modified_base (376)..(376): a, c, t, g, unknown or other
  misc_feature (376)..(376): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagttgttttatacagctccaacaataacaactacttagcttggtaccagcaagaaaccaggacacgaccccctaaggtcctactatttacgtgggcactccgtacccgggacgtcccggggtccctcgaccgacttcgagaggcaggtcggtcgtgggacagtattcactctcaccancaccactgcaggctagagagtcgtggctaagttacttactagtcagtactaatactaacttagtccctctctcgtacgtccgggacggtaacggacgaagggtagagtactacgaaacgactggtcgctcgactacgacttcgtcgttctccgtacttcccgtacccgactattcctgtactaccg

SEQ ID NO: 52008 - DNA, 694 bp, Homo sapiens
  misc_feature: GYAE6OF01C3539.18.11.A11.1.454.CMB.1.raw
  modified_base (217)..(217): a, c, t, g, unknown or other
  misc_feature (217)..(217): n is a, c, g, or t
  modified_base (259)..(259): a, c, t, g, unknown or other
  misc_feature (259)..(259): n is a, c, g, or t
  modified_base (295)..(295): a, c, t, g, unknown or other
  misc_feature (295)..(295): n is a, c, g, or t
  modified_base (418)..(418): a, c, t, g, unknown or other
  misc_feature (418)..(418): n is a, c, g, or t
tcagtacgagtatgcacgaccggtgctcgatttagctacgactgcagggggcagcaagatggtgttgcagacccaggtcttcatttctctgttgctctggatctctggtgccggacggggacatcgtgatcgacccagtctccagacctccctggttgtgtctcgtgggcgaggacgggccaccatcaactgcaacgtccagccagtagttgtttanacagctaccaacaataacacttactagcttaggaccagacanaaaccagacacgacccctaaggtcctactattacgnggcacgtaccgtacccgggacggtcccgggtccctaggaccgtatcgacggaggcgaggtcgggtcgtgggacagtactttcactctaccaccactccaacccaacctgacaggactagaagntgtcggacttagtttactactgtcgaacgtacaaacttacgtaacttaccgttccctacccttacgttccgtacccgggtttacggggacccggggtaaacggaacccgggtaaagggtacggggaacgtaacgttaaacccggaaaacgtacggttacgggtcggtaccgtacgaccctaaccgtacgtttaccgttaccggtttcccttaccggttaaccctttaccccggttacccccgtaccttaacttcccgtaacggtaccttaaacccg

SEQ ID NO: 52009 - DNA, 690 bp, Homo sapiens
  misc_feature: GYAE6OF01DEHZY.18.11.A11.1.454.CMB.1.raw
  modified_base (213)..(213): a, c, t, g, unknown or other
  misc_feature (213)..(213): n is a, c, g, or t
  modified_base (303)..(303): a, c, t, g, unknown or other
  misc_feature (303)..(303): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatcgacccagtctccagactccctggttgtgtctcgtgggcgagacggccacatcaactgcaagtccagccagtgtgttttacacgngcctacaaacaataacaacgttacttagcttagtaccagacaacgaaaccaggacaccgacccccttaaggtcccttacaattttaccgnggactaacgttaccccggtaacccgggtacggttccccggggtacccctacggaacccgtagttaccgaagggacgggcccgaaggggtccgggtacgttacggggacctaggtacttttaccgacctttccaccaaccactacccgaaccctaacgcgaccgaggtaccagaagtagtcggtacgtacgttagttttactaccgtagtactaacgtaactaataaccgttataccgtccctcttactaccgtacgggtccggaagggtacgacggtaagggtcgaacgtaactaacgtaaaccgtagtcggtcggactccgaaccttacgtactcgttacgttccttactacctttacccgccctaagtacctactagaccttacg

SEQ ID NO: 52010 - DNA, 512 bp, Homo sapiens
  misc_feature: GYAE6OF01B0TCR.18.11.A11.1.454.CMB.1.raw
  modified_base (208)..(208): a, c, t, g, unknown or other
  misc_feature (208)..(208): n is a, c, g, or t
  modified_base (457)..(457): a, c, t, g, unknown or other
  misc_feature (457)..(457): n is a, c, g, or t
  modified_base (472)..(472): a, c, t, g, unknown or other
  misc_feature (472)..(472): n is a, c, g, or t
  modified_base (500)..(500): a, c, t, g, unknown or other
  misc_feature (500)..(500): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttanacagctccaacaataacaactacttagcttggtaccagcagaaaccaggacagcccctaaggtcctcatttactgggcatcctacccgggagtcccggggtccctgaccgattcgagaggcaggcggtctgggacagtatttcactctacaccatccaaccaacctgacaggctagaagatgtgctagtttatactgtcagctaatctatcgtcctcctctctacgttcggcggaggaccaaggtgaanactacaacgacgtgnggctgctacatctgtctcattccctccnctatctgctacg

SEQ ID NO: 52011 - DNA, 577 bp, Homo sapiens
  misc_feature: GYAE6OF01ERMIN.18.11.A11.1.454.CMB.1.raw
  modified_base (330)..(330): a, c, t, g, unknown or other
  misc_feature (330)..(330): n is a, c, g, or t
  modified_base (335)..(335): a, c, t, g, unknown or other
  misc_feature (335)..(335): n is a, c, g, or t
  modified_base (344)..(344): a, c, t, g, unknown or other
  misc_feature (344)..(344): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcattactggcatctaccgggagtccggggtcctgaccgattcagagcagcggtgngcganagttctacnctcacactacaccaacctacgcacggctgaagaatgtggtacgacgtttaagtttaaccttaggttacaacgacaaacgttaaacctaattaaagtccttacccttcctactaaccgttccgggtacgggacgggaaccgaacggtagggtaaggaatactaaacgaaactagtggacgtcgcgaaccacttatcgtctttcctaatcctttacctcgtacactcgtgtaacc

SEQ ID NO: 52012 - DNA, 741 bp, Homo sapiens
  misc_feature: GYAE6OF01DLMIA.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtgccggacggggacatcgtgatgacccagtctccagactccctggttgtgtctctgggcgagagggccaccatcaactgcaagtccagccagtagttgttttatacagctaccaacaaataacaactacttagcttaggtaaccagacaacgaaaccaggaaccaccgtaccccctaacggtcctactactttacgtcgggacacgttccgtaccccgggtacgggtcccggggtccctcggaccgtattcgaaggaggcgtaggtccgggtcggtacgggactagtactttaccacctcctaccaaccctactacccaaccctaaaccgttcggaccgaacggtactaggaagtacgttggtacggtacgttagttttaactacgttgtacgtaactaacgtaattaaccgttattaacccggttcccttaccctttcgttaacccgtaccgggtttacccgggggaacggggtaaccgggtaaccggtaaggggtcgtaaacgtaacgttaaacccgaaacggttaccgtgggtacgtcgtacgaccctaaccgtacgttccgttacgtccctttaccgtacctttccccgttaccccggttactactttacccgtagaaacccttaaccgg

SEQ ID NO: 52013 - DNA, 508 bp, Homo sapiens
  misc_feature: GYAE6OF01BBHRC.18.11.A11.1.454.CMB.1.raw
  modified_base (465)..(465): a, c, t, g, unknown or other
  misc_feature (465)..(465): n is a, c, g, or t
  modified_base (474)..(474): a, c, t, g, unknown or other
  misc_feature (474)..(474): n is a, c, g, or t
  modified_base (496)..(496): a, c, t, g, unknown or other
  misc_feature (496)..(496): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagacttcactctcaccatcaccaacctgcaggctagaagatggtgctagtttattactgtcagcaatactatcgtcctctctctacgttcggcggaggaccaaggtcgagatacgaacgactgnggctgcacntatcgtcttcactccgttcccnctatctgactac

SEQ ID NO: 52014 - DNA, 541 bp, Homo sapiens
  misc_feature: GYAE6OF01EN3ES.18.11.A11.1.454.CMB.1.raw
  modified_base (284)..(284): a, c, t, g, unknown or other
  misc_feature (284)..(284): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcaagaaaccaggacacgccccctaaggtcctcattacnggcatccgtaccgggagtccggggtccctgaccgattcagagcagcgggtctgggacagtatttcactctcaccatccaccaactgcaggctgaagatgtgctagtttattactgtacagacaattactatacgtcctcctctctacggttcggacggacgggaacctaagggtggaagtactacgaaacgtactggtcggtactcgacctacgtattctcgttccttacacttcccgttcccactatctgactacg

SEQ ID NO: 52015 - DNA, 838 bp, Homo sapiens
  misc_feature: GYAE6OF01ACV04.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagtagttgttttatacagctaccaacaataacaacttacttagcttggtaccagcaagaaccaggacacgacccctaaggtcctactatttacgtggctacgtccgtaccggggacgtcccgggtccctacggaccgtattcgaggtaggccgaggtccggtcgtaggacagtacgtttccacttcctaccacccgtaatacccaacccgtaaccctcggtaccgaaggtccgtaagggaaacgtagtttagggttacgggtaacctttaaggtttttaacgttaccgttacggtaccgtaaacggtaacccttaaaacgtttaacccgtttaacgttaacccgtttccccctttacccgtttacccgtttaaccccgggttaacccgggtttaccccgggggtaaccgggggtaaacccggggtaaaccccgggtaaagggggttaacgggtaaacgtaaaccgttaaaccggtaaaacccggttaaccggttaccgggttacggggacccgttaaccgggtaccctaaaccccgttacgttacccgtttaccgggtttacccttttaaccccttaccggtttaccccccgttccccggaacccttaacgttccctttaacgggtaacccctttaaaccgg

SEQ ID NO: 52016 - DNA, 657 bp, Homo sapiens
  misc_feature: GYAE6OF01BD6M3.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagttgttttatacagctaccaaacaataacaactacttagcttggtaccagcaagaaaccaggacacgcccctaaggtcctctactttacgtgggcactccgtacccggggagtcccggggcccctgaccgattcgagacgcaggcgggtctgggacagtactttcactctccacctactaccaaccaccgtcgacgacggactagaagtacgtggtacggtacgttaagttttaacttacgttagtacgagtaactaattaaccttaagttaccgtcccttccctactaccgtcggtttaccgggacggaacgggaaccgtaagggtaggtaacgtaacgtaacgaaaaccggtacgtaggtacggccgttacggacctaaccgtacttccgttacgttccttaccctaacgttccccgttacccctaccgttaacttccgtacgtaacgttaacccg

SEQ ID NO: 52017 - DNA, 600 bp, Homo sapiens
  misc_feature: GYAE6OF01ETIF2.18.11.A11.1.454.CMB.1.raw
  modified_base (298)..(298): a, c, t, g, unknown or other
  misc_feature (298)..(298): n is a, c, g, or t
  modified_base (367)..(367): a, c, t, g, unknown or other
  misc_feature (367)..(367): n is a, c, g, or t
  modified_base (419)..(419): a, c, t, g, unknown or other
  misc_feature (419)..(419): n is a, c, g, or t
  modified_base (468)..(468): a, c, t, g, unknown or other
  misc_feature (468)..(468): n is a, c, g, or t
  modified_base (539)..(539): a, c, t, g, unknown or other
  misc_feature (539)..(539): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctcgtgggcgagacgggccacatcaactgcaagtccagccagtagttgttttatacacgctaccaaacaaataaaccaacttacttagcttacggtaccagacaagaaaccaggacacgcccctaagtcctactattacgngggacactccgtacccggggacggtcccggggtccctggacccgtattcgagacggcacggcggtacgngggactagtacttcactctacaccataccaccaactgacgaggctagaagtntcggtgtactagtttattctgtacagtactaatactatacgtcctctcncgtacggtcggacggtacggacgagggtcgaagtacgtaacaacggtactggtcggcctacgaccaccgtnttacgtccgttccttacgtacccttccgttacccccatacgttcctacgtacccttaccgg

SEQ ID NO: 52018 - DNA, 668 bp, Homo sapiens
  misc_feature: GYAE6OF01CPMNR.18.11.A11.1.454.CMB.1.raw
  modified_base (211)..(211): a, c, t, g, unknown or other
  misc_feature (211)..(211): n is a, c, g, or t
  modified_base (293)..(293): a, c, t, g, unknown or other
  misc_feature (293)..(293): n is a, c, g, or t
tcagtacgagtatgcacgaccggtgctcgatttagctacgactgcaggggcagcaagatggtgttgcagacccaggtcttcatttctctgttgctctggatctctggtgccggacggggacatcgtgatgacccagtctccagactccctggttgtgtctctgggcgagagggccaccatcaactgacaagtccagccagagttgttttanacagcctaccaaacaataacaacttacttagcttggtaccagacaagaaaccaggacacgcccctaaggtcctcatttacgnggacacgtccggtacccgggagtcccggggtccctggaccgtattcgaggacggcgacgggtcggtcgtagggacagtctttacacgtctaccacacgtaccaacctaaccgtgaccgaggtactagaagtagtaggtcggtacgttaagtttaacttacgtacgtacctagtaactaaacgttaccttaacgttaccgttcccctaccgttctacccggtacggttccgggacgggtaacggaaccggtaagggtcgtaagtacgtaaccgaaacggtacgtggtacgtccgtacgaccgtaaccgtattccgttacggttccttacgaccctttcccggtaccccgtactacgttccctcggtaaccttaacg

SEQ ID NO: 52019 - DNA, 571 bp, Homo sapiens
  misc_feature: GYAE6OF01DKUQS.18.11.A11.1.454.CMB.1.raw
  modified_base (290)..(290): a, c, t, g, unknown or other
  misc_feature (290)..(290): n is a, c, g, or t
  modified_base (394)..(394): a, c, t, g, unknown or other
  misc_feature (394)..(394): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctcgtgggcgagagggccaccatcaactgcaagtccagccagagttgttttatacagctaccaaacaataacaactacttagcttggtaccagcagaaaccaggaccacgccccctaaggtcctctatttacngggcatccgtacccgggagtcccggggtccctgaccgattcgagaggcaggcggtcgtgggacagactttcactctcaccatccaccaactgcaggctagaagntgtggctaagtttatacgtgtacagactaatactattacgtccctctctacgacgttcgggacggaacggaccgaagggtgaacgtactacgaaaacgagtggtcggactcggacccaccgtattcgttgttcccttactacttcccgttccccgactattcctacgaccttaaccg

SEQ ID NO: 52020 - DNA, 780 bp, Homo sapiens
  misc_feature: GYAE6OF01CW8SH.18.11.A11.1.454.CMB.1.raw
  modified_base (215)..(215): a, c, t, g, unknown or other
  misc_feature (215)..(215): n is a, c, g, or t
  modified_base (303)..(303): a, c, t, g, unknown or other
  misc_feature (303)..(303): n is a, c, g, or t
tcagtacgagtatgcacgaccggtgctcgatttagctacgactgcaggggcagcaagatggtgttgcagacccaggtcttcatttctctgttgctctggatctctggtgccggacggggacatcgtgatcgacccagtcctccagacctccctggttgtgtctcgtgggcgagagggccaccatcaactgcaagtccagccagagttgttttaanacagcctaccaaacaataacaactacttagcttggtaccagacaacgaaaaccaggaccacgaccccctaaaggtcctctatttacgnggacactccgtacccgggaggtcccggggtcctgaccgattcgagaggcaggcgggtctgggacagtactttcacgttcctaccacctaactacccaaccctaaacccgtcgacgaacggggtccttaagggaaacgtagttagggtacgggtactttaaggtttttaactttaaccgtacggttacaaacggtaacctaaaactttaccgttaaacgttaccggtttccccttacccgtttacccgttacccggtaaccgggttttacccgggggaccggggtaaaccggggttaacccggtaaaagggggttacggggaagttaaaccttaaccggtaaaaacccggtacggtttacgggtacgggtaacctcggtaaccctaaccgttaacgttccgttacggttccctttaccgtaacccgttccccgtttacccccggacccttaagtttaccctcggtaaaccttaacccg

SEQ ID NO: 52021 - DNA, 695 bp, Homo sapiens
  misc_feature: GYAE6OF01BI7OZ.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagttgttttatacagctaccaacaataacaactacttagcttggtaccagacaagaaaccaggaccacgccccctaaggtcctactattacgtgggactactccgtacccgggacggtcccggggtccctcggaccgtattcgaggtacggcgacggtcgggtcgtgggactagtactttccactcctaccacctactacccaaccctaaaccgtcgaccgacggtactaggaaacgtagttcgggtacggtacgtttaacggttttaactttaaccgttagtaccgaagtaactaaacttaacttaacttacggttcccttacccgttcctaccgtaccgggttaccgggaaccgggtaacggggtaaccgtaaggggtacgggtaacgtacgttaacccgaaaccggtacgttagggtaccggtactacgacctaccgtcttaccgttacgttccttaccgtacttccccgtccctactatcgtacgacttaccg

SEQ ID NO: 52022 - DNA, 522 bp, Homo sapiens
  misc_feature: GYAE6OF01BEJ8T.18.11.A11.1.454.CMB.1.raw
  modified_base (491)..(491): a, c, t, g, unknown or other
  misc_feature (491)..(491): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacacgccccctaaggtcctctatttacgtgggcatccgtacccgggagtcccggggtccctgaccgattcagaggcaggcggtcgtgggacagacttcactctcaccatccaccaacctgcaggctagaagatgtgctagtttattactgtccagacaactactatacgtcctcctctcgtacgttcggacggacggaccgaaggtgtagactacaacgactggtgctgacacntctgtcttcattcctccgctaatctgctacg

SEQ ID NO: 52023 - DNA, 542 bp, Homo sapiens
  misc_feature: GYAE6OF01CH306.18.11.A11.1.454.CMB.1.raw
  modified_base (210)..(210): a, c, t, g, unknown or other
  misc_feature (210)..(210): n is a, c, g, or t
  modified_base (293)..(293): a, c, t, g, unknown or other
  misc_feature (293)..(293): n is a, c, g, or t
  modified_base (366)..(366): a, c, t, g, unknown or other
  misc_feature (366)..(366): n is a, c, g, or t
  modified_base (379)..(379): a, c, t, g, unknown or other
  misc_feature (379)..(379): n is a, c, g, or t
  modified_base (394)..(394): a, c, t, g, unknown or other
  misc_feature (394)..(394): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaaagtccagccagagttgttttanacagctaccaaacaaataacaactacttagcttggtaccagcaagaaaccaggacacgccccctaaaggtcctacatttacgnggcatccgtacccgggagtcccgggtcctacgaccgattcagagcgagcgggtctgggacagtatttcactcncacatccacactncagctagagatgtgntagtttatactgtacagtacaatactatacgtcctctctctacggttcggcggacggaccaaggtgaacgatacgaaacgactaggtcggactgccaacctagtcttacgtcttacacttcccttcccgactagttcagaccttaacg

SEQ ID NO: 52024 - DNA, 501 bp, Homo sapiens
  misc_feature: GYAE6OF01BU8Y1.18.11.A11.1.454.CMB.1.raw
  modified_base (208)..(208): a, c, t, g, unknown or other
  misc_feature (208)..(208): n is a, c, g, or t
  modified_base (375)..(375): a, c, t, g, unknown or other
  misc_feature (375)..(375): n is a, c, g, or t
  modified_base (379)..(379): a, c, t, g, unknown or other
  misc_feature (379)..(379): n is a, c, g, or t
  modified_base (474)..(474): a, c, t, g, unknown or other
  misc_feature (474)..(474): n is a, c, g, or t
  modified_base (481)..(481): a, c, t, g, unknown or other
  misc_feature (481)..(481): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttanacagctccaacaataacaactactagcttggtaccagcagaaaaccaggacagccccctaaggtcctcatttactgggcatcgtacccgggagtccggggtccctgaccgattcagagcagcggtctgggacagatttcactctcaccatccacaacctgcaggctnaagntgtgctagtttatactgtcagcaatactatacgtcctcctctctacgttcggacggaaggaccagggtgagatacaaacgactgtgctgcacatntgtctcntcctccgctatctgactacg

SEQ ID NO: 52025 - DNA, 580 bp, Homo sapiens
  misc_feature: GYAE6OF01BDO63.18.11.A11.1.454.CMB.1.raw
  modified_base (283)..(283): a, c, t, g, unknown or other
  misc_feature (283)..(283): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactactagcttggtaccagcagaaaccaggacacgcccctaaggtcctcatttacgngggcatccgtacccgggagtcccggggtcctgaccgtattcagagcaggcgggtctgggacagtactttcactctcaccatccaccaactgcaggctagaagtatggtaggctaagtttatacgtgtacagactaattactattacgtccctacctcgtactacggttccgggacggaacgggaccaagggttaggagtacgtaaccgaaacggtactggtcggacctacgacctaaccagttccgttacggttccttaccgaacttcccgttaccccgactattcctcgtactacg

SEQ ID NO: 52026 - DNA, 545 bp, Homo sapiens
  misc_feature: GYAE6OF01CH16Y.18.11.A11.1.454.CMB.1.raw
  modified_base (208)..(208): a, c, t, g, unknown or other
  misc_feature (208)..(208): n is a, c, g, or t
  modified_base (284)..(284): a, c, t, g, unknown or other
  misc_feature (284)..(284): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttanacagctccaacaataacaactacttagcttggtaccagcagaaaccaggacacgccccctaaggtcctcatttacngggcatccgtacccgggagtcccggggtccctgaccgtattcagaggcaggcgggtctgggacagtatttcactctcaccatccaaccaacctgacaggctagaagatgtggactagtttacttatgtcagactaatactatacgtccctctctcacggttcggacggacggaccgaggtggagactacgaaacgtactggtcgtcgtcgaccaccgtatcttgttccttcacttcccgtcccgacctatcctgactaacg

SEQ ID NO: 52027 - DNA, 643 bp, Homo sapiens
  misc_feature: GYAE6OF01DQXE0.18.11.A11.1.454.CMB.1.raw
  modified_base (213)..(213): a, c, t, g, unknown or other
  misc_feature (213)..(213): n is a, c, g, or t
  modified_base (216)..(216): a, c, t, g, unknown or other
  misc_feature (216)..(216): n is a, c, g, or t
  modified_base (268)..(268): a, c, t, g, unknown or other
  misc_feature (268)..(268): n is a, c, g, or t
  modified_base (497)..(497): a, c, t, g, unknown or other
  misc_feature (497)..(497): n is a, c, g, or t
  modified_base (565)..(565): a, c, t, g, unknown or other
  misc_feature (565)..(565): n is a, c, g, or t
  modified_base (599)..(599): a, c, t, g, unknown or other
  misc_feature (599)..(599): n is a, c, g, or t
  modified_base (628)..(628): a, c, t, g, unknown or other
  misc_feature (628)..(628): n is a, c, g, or t
  modified_base (633)..(633): a, c, t, g, unknown or other
  misc_feature (633)..(633): n is a, c, g, or t
tcagtacgagtatgcacgaccggtgctcgatttagctacgactgcaggggcaggcaagatggtgttgcagacccaggtcttcatttctctgttgctctggatctctggtgccgacgggacatcgtgatcgacccagtctccagtacctcctggttgtgtctcgtgggcgagacggccaccatcaactgacaagtccaggccagtgttgtttanacngctaccaataactaacaactacgttagctttaggaccagcaacgaaaaccgnggaacaccgtacccccttaaggtcctactaactttacgtggcctaacgtccgtaacccgggtaggtccccgggtcctaggacccgtattcgaggacggtcgaacggtcgggtacgtcgggactagttactttacactctacctaacctactacccaaccctaaccgtcgaccgtaacggacgttacggaaagtcgttcgtacgggtccttaaggttttacttaaccgtntacgaacgtactaacttacgtacttacgtccctcgtctcgtacggttcgaggaacgacgtaaggcganacgtacctaagtcgtaggcgtcaccgataccgtntcgttacgtctcgtactcccgttccactnttacngtaccgtacg

SEQ ID NO: 52028 - DNA, 587 bp, Homo sapiens
  misc_feature: GYAE6OF01DBDV2.18.11.A11.1.454.CMB.1.raw
  modified_base (286)..(286): a, c, t, g, unknown or other
  misc_feature (286)..(286): n is a, c, g, or t
  modified_base (314)..(314): a, c, t, g, unknown or other
  misc_feature (314)..(314): n is a, c, g, or t
  modified_base (401)..(401): a, c, t, g, unknown or other
  misc_feature (401)..(401): n is a, c, g, or t
  modified_base (548)..(548): a, c, t, g, unknown or other
  misc_feature (548)..(548): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccacatcaactgcaagtccagccagagttgtttatacagctaccaaacaataacaactacttagcttaggtaccagacagaaaccaggacacgaccccctaagtcctcattacnggcactcgtacccggagtcccgggtccngaccattcagaggcaggcgggtcgtacgggacaagtctttcacctctccaaccactaccaaccctaaccctgacgacggctagaagnttaggtacggtacttaagttttacgttaactgtacaagtactaagttacttagtacgtccctccttcgtacctacggtttccgggagggaaccggaccggtaaggtacggagtacgtaacaacgtactggtcggtcgcgacaccgtnttcgtgttcctctacttccctcccgctatctgtactacg

SEQ ID NO: 52029 - DNA, 673 bp, Homo sapiens
  misc_feature: GYAE6OF01ED6Z0.18.11.A11.1.454.CMB.1.raw
  modified_base (289)..(289): a, c, t, g, unknown or other
  misc_feature (289)..(289): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccacatcaactgcaagtccagccagagttgttttatacagctaccaacaataacaactacttagcttggtaccagcaagaaaccaggacacgaccccctaaggtcctctatttacgngggctatccgtacccgggaggtcccgggggtccctgaccgtatcaggaggcaggcgggtctagggacagtatttcactctcaccactacaccaactgcaggtctagaagtcgtggtacgacttaagttttacttacgtcgtacagtacctaaagtttaacttacgttaccgttcccccttaccctacgtttacccggtaaccgggtttcccggggaaccgggggtaaaccgggtaacccggtaaaggggtcgggaaacgtaagttaacccggaaaacgtaccggttggtacggcgttacggacctaacccgtagttcttccggtttacctacgtccctttacccgttacccccgaccgttaacgtttcctacggaccttaaccg

SEQ ID NO: 52030 - DNA, 823 bp, Homo sapiens
  misc_feature: GYAE6OF01BF6EK.18.11.A11.1.454.CMB.1.raw
  modified_base (306)..(306): a, c, t, g, unknown or other
  misc_feature (306)..(306): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctcgtgggcgagagggccaccatcaactgcaacgtccagccagtagttgttttaatacacgctaccaaacaaataaaccaacttacttagtcttacggtaccagacaagaaaccaggaaccacgacccctaaggtcctactatttacgnggcactccgtaccgggtacgtcccggggtcctggaccgtacttaccgaggacggtcgacggtcgggtcgtacgggacgtagtactttaccacgttcctaccaccctaactaccctaaaccctaaccgtacggaccgtaacggtaccttaagggaaacgttacgttcgggtacggtaccgtttaaaggtttttaaccttaacgttacggtaacctaacggtaaccttaaacgttaacctttaacttaacccggtttcccctttaccccttacgttaccggttaacccggtttaccgggggaacccggggttaacggggtaaccccgggtaaaggggtttacgggaaacggtaaaccgttaaacggtaaaaacccgggtacgttaccgggtacggtacccgttacgtaaaccccgttaaccgtaagttccgtttaccggtttacccttacccttacccggtttacccccgtttaccccgaccgttaaacctttcccggtaaacggttaccccttaaacg

SEQ ID NO: 52031 - DNA, 783 bp, Homo sapiens
  misc_feature: GYAE6OF01DNQPO.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtgccggacggggacatcgtgatgacccagtcctccagacctcctggttgtgtctcgtgggacgaggacgggccaccatacaactgacaacgtccacgccagtagttagttttacaacacgacctaccaaactaaactaaacctaacttacttagtcgttacggtaccagacaacgaaaccgacggaccacccgtacccccgttaaggtccctactaacgtttacgcggactacgtacccggtaccccggggtacggttccccggggtaccctacggtaacccgtattccgaaggacgggacgacgggtccgggtacgtacgggaactacgttactttaccgaccttcctacccgaacctactacccaaacccgtaaccgtgaccgacggtactaggaagtagtggtacggtactttagttttactacgtacgtacaacgtactaaacttacttacgttaccgttccccttaccgttccgtaccggtaccgggttccggggaacggggtaaaccgggaccgtaagggtcggtaactaacgttaaccgaaaccggttcgtacgggtaccggtactaccggtaaccctaccgttacgttaccgttcggttaccctttaccctaccgtttacccccgttaccccgacttaccggtttacctaaccgtaaccttaacccgg

SEQ ID NO: 52032 - DNA, 678 bp, Homo sapiens
  misc_feature: GYAE6OF01CGOP5.18.11.A11.1.454.CMB.1.raw
  modified_base (140)..(140): a, c, t, g, unknown or other
  misc_feature (140)..(140): n is a, c, g, or t
  modified_base (226)..(226): a, c, t, g, unknown or other
  misc_feature (226)..(226): n is a, c, g, or t
  modified_base (334)..(334): a, c, t, g, unknown or other
  misc_feature (334)..(334): n is a, c, g, or t
tcagtacgagtatgcacgaccggtgctcgatttagctacgactgcaggggcagcaagatggtgttgcagacccaggtcttcatttctctgttgctctggatctcgtggtgccggacggggacatcgtgatcgaccagtcnccagactccgtggttgtgtctcgtgggcgaggacggcccaacatacaactgacaacgtccgagaccgaaggtagtttagttttaanacgagtcctaaccaaaactaaaacgtaaacctaaacttaccgttagtacgtttacgggaaccagacgaaacgaaaccgaggacaccgaccctaagtcctatattacgnggacacgtccgtaccgggcgtcccggcctacgacctatcgaggagcgaggcggtcgtggactagtacttcactctacacatccaactactgacaggtcagaacgtagtggtggtacttagtttactacgtagtacaagtaacaattacctagttacctcccttctacgtaccgtaggtaccggggacgggaacgggtaaccgtaaggggtacgaacgtaaaccgaaccggtaaaacgtaccggtggtacgggacctaacggtacccaaaccggtctttcggtaccgtttaacctcccgtaacgttcccgttccccggaaattcgtaccctagtaaccgttaccc

SEQ ID NO: 52033 - DNA, 646 bp, Homo sapiens
  misc_feature: GYAE6OF01CW4ZV.18.11.A11.1.454.CMB.1.raw
  modified_base (218)..(218): a, c, t, g, unknown or other
  misc_feature (218)..(218): n is a, c, g, or t
  modified_base (221)..(221): a, c, t, g, unknown or other
  misc_feature (221)..(221): n is a, c, g, or t
  modified_base (230)..(230): a, c, t, g, unknown or other
  misc_feature (230)..(230): n is a, c, g, or t
  modified_base (372)..(372): a, c, t, g, unknown or other
  misc_feature (372)..(372): n is a, c, g, or t
  modified_base (427)..(427): a, c, t, g, unknown or other
  misc_feature (427)..(427): n is a, c, g, or t
  modified_base (633)..(633): a, c, t, g, unknown or other
  misc_feature (633)..(633): n is a, c, g, or t
tcagtacgagtatgcacgaccggtgctcgatttagctacgactgcaggggcagcaagatggtgttgcagacccaggtcttcatttctctgttgctctggatctctggtgccggacggggacatcgtgatcgacccagtcctccagacctcccgtggttgtgtctcgtgggcgaggacgggccaccatcaactgcaacgtccagccagtagttgtttanacngctaccaanaataacaactacttagcttggtaccagacaacgaaaccacggacaccgaccccgtaagtcctactacttacgcgggactacgtccggtacccgggacggtcccgggtccctcgaccgtatcgagacggcacgggtcgggtcngggactagtcttcactcacaccactaccaacctaacctgacgaggactagaagtntaggtgtacttagttactacgtgtacgacactaattactacgtaccgtacctccttactaccggtacggttccgggacggaacggtaaccgtaagggtacgaagtaacttaaaccggaaacgtacgttacggtcggtaccgtcgaccgtaaccctgttaccttcggttacccttacgtacccttcccgttaccccgataccgttcncgtaaccttaacg

SEQ ID NO: 52034 - DNA, 541 bp, Homo sapiens
  misc_feature: GYAE6OF01EBAX5.18.11.A11.1.454.CMB.1.raw
  modified_base (384)..(384): a, c, t, g, unknown or other
  misc_feature (384)..(384): n is a, c, g, or t
  modified_base (475)..(475): a, c, t, g, unknown or other
  misc_feature (475)..(475): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagttgttttatacagctaccaaacaataacaactacttagcttggtaccagcagaaaccaggacacgccccctaaggtcctcatttacgtggcatcgtacccgggagtccggggtccctgaccgattcgagagcgaggcggtctgggacagtatttcactctcacatcaccaactgcagctgaagntgtgctagtttatactgtcagacaagtactatactcctctctcgtacgttcggcggacgggaccaaggtggacgatacgaaacgtacgtgnggcctgactaccgagttctcgttccttacgactttcccgttccccgacctattcctgtaacctaac

SEQ ID NO: 52035 - DNA, 643 bp, Homo sapiens
  misc_feature: GYAE6OF01C32LV.18.11.A11.1.454.CMB.1.raw
  modified_base (215)..(215): a, c, t, g, unknown or other
  misc_feature (215)..(215): n is a, c, g, or t
  modified_base (303)..(303): a, c, t, g, unknown or other
  misc_feature (303)..(303): n is a, c, g, or t
  modified_base (338)..(338): a, c, t, g, unknown or other
  misc_feature (338)..(338): n is a, c, g, or t
  modified_base (570)..(570): a, c, t, g, unknown or other
  misc_feature (570)..(570): n is a, c, g, or t
tcagtacgagtatgcacgaccggtgctcgatttagctacgactgcaggggcagcaagatggtgttgcagacccaggtcttcatttctctgttgctctggatctctggtgccggacggggacatcgtgatcgacccagtcctccagacctccctggttgtgtctcgtgggcgagacgggccaccatcaactgcaagtccagccagtagttgtttanacagcctaccaaacaaataacaactacttagcttaggaccagacaacgaaaccaggaccacgaccccctaagtcctactactttacgnggcacgtccgtacccgggacggtcccggggtcccncgaccgtacttcgaggaggcgaggcgggtcgtgggacagtctttcactctaccaccatccaaccaaccgtcgaccgaggctagaacgagtggtcgtacttaagttttacttacgtgttaccagtaactaacttacttattaccgtccctccttcgtaccgtacggttccgggacgggtaacggaacggtaagggttgaacgtacgtaacgaaacgtacgtcggtacggtacncgtaccgacctacttcgttacttccttcgaaccttcccgttaccccgtacctagttcctataaccgttacccg

SEQ ID NO: 52036 - DNA, 721 bp, Homo sapiens
  misc_feature: GYAE6OF01C036Y.18.11.A11.1.454.CMB.1.raw
  modified_base (260)..(260): a, c, t, g, unknown or other
  misc_feature (260)..(260): n is a, c, g, or t
  modified_base (650)..(650): a, c, t, g, unknown or other
  misc_feature (650)..(650): n is a, c, g, or t
tcagtacgagtatgcacgaccggtgctcgatttagctacgactgcaggggcagcaagatggtgttgcagacccaggtcttcatttctctgttgctctggatctctggtgccggacggggacatcgtgatgacccagtcctccagactccctggttgtgtctcgtgggcgagacgggccaccaatcaactgacaagtccagccagagttgttttaatacagtctaccaaacaaataacaactacttagcttaggtaaccanacacgaaaaccaggacacgaccccctaaggtcctacatttaacgtgggacctatccgtaacccgggaggtcccggggtccctgaaccgattacgaggacggcaacggcgggtcgtagggaactaagtacttttacgacttcctaccaacctagtaccaaccctaaacctcgactacgggacctaggaaacggtattacgggtacggtaccgtttaaggttttactaacgttcggtacaacggtaaacctaaagttacccttaaagttaccggttaccccttacccttaccgttaccgtaacccgggtttccgggaaccggggtaaacgggaacccggtaaaggggtacggtaacgtaagtaaccgaaaaccggtacgtacggtcggaccngtaccaacgtaccgttcgttagttccttaccgatttcccgttaccccgacctattacctcgtaacctaacg

SEQ ID NO: 52037 - DNA, 800 bp, Homo sapiens
  misc_feature: GYAE6OF01C8J73.18.11.A11.1.454.CMB.1.raw
  modified_base (223)..(223): a, c, t, g, unknown or other
  misc_feature (223)..(223): n is a, c, g, or t
  modified_base (279)..(279): a, c, t, g, unknown or other
  misc_feature (279)..(279): n is a, c, g, or t
tcagtacgagtatgcacgaccggtgctcgatttagctacgactgcgaggggcagcaagatggtgttgcagacccaggtcttcatttctctgttgactctggatctctggtcgccggacggggacatcgtgatcgacccagtctccagacctcccgtggttgtgtcctcgtggggcgaggacgggccaccatcaactgcaagtccagccagtagttagttttanacagtcctaccaactaaataaccaacttacttagcttaggaccagactagaaaccnggacacgcccctaaggtcctctattacgtggctacgtcgtacccgggaggtcccggggtcctacgaccgattcgaggacggtcgacggccgggtacgtgggacacggtactttcgactacgtccaacctactaccgaacctaacctggtaccgacgggtacgttacggaaacggtacgtacgggttacggtacgtttaacggtttttaacgttaacccgtggtttacccgaaggttaacctaaacgtttaacgttaacgttaacccgggtttacccctccccgtttaccgttacccgtaacccggggtttcccggggaacggggttaacggggtaaaccgtttaacgggggtagggtaaacgtacgtaaaccggtaaaaccgggttaccgttacgggtttacgggtaccgtccggtaaccgtaaccgttaaacgttcgtttaccggttaccttttacccgtacgttttacccccgtttacccggtaccttacggttacccgacggtaaccttaaacccggg

SEQ ID NO: 52038 - DNA, 530 bp, Homo sapiens
  misc_feature: GYAE6OF01AHJLH.18.11.A11.1.454.CMB.1.raw
  modified_base (494)..(494): a, c, t, g, unknown or other
  misc_feature (494)..(494): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacacgccccctaaggtcctcatttactgggcatccgtacccgggacgtccggggtccctgaccgattcagaggcaggcggtctgggacagtatttcactctcaccatcaccaacctgcaggctgagatggtgactagtttattactgtacagctaatactatacgtcctactctactacggttccggcggacgggaccgaagggtagagatacaaacgtacgtgtgctgacaccgtntcgtgtccttacacttccttcccgactatctgctac

SEQ ID NO: 52039 - DNA, 782 bp, Homo sapiens
  misc_feature: GYAE6OF01EIPCP.18.11.A11.1.454.CMB.1.raw
  modified_base (328)..(328): a, c, t, g, unknown or other
  misc_feature (328)..(328): n is a, c, g, or t
  modified_base (760)..(760): a, c, t, g, unknown or other
  misc_feature (760)..(760): n is a, c, g, or t
tcagtacgagtatgcacgaccggtgctcgatttagctacgactgcaggggcagcaagatggtgttgcagacccaggtcttcatttctctgttgctctggatctctggtgccggacggggacatcgtgatcgaccagtctccacgacctccgtggttgtgtctcgtgggcgaggacggccacatacaactgacaacgtccagccgaagtagtttagttttaacacacgtcctaaccaaaactaaactaaactaacttaacttacgcgtttacggaaccagacaaacgaaaccacgacaccgtaccccgtaacgtcctactagtttacgnggactacgtaccggtaccggggacggttcccgggtccacggaccgtatacgaggtacggcgacgggtcggtcgtacgggtactaagttcttaccgtacctcaccacctaacgtaccaacccgtaacgtcgaccgtaagggtctaaggaacgtagttacgggtacgtaaccgtttaagttttaacttaacggtccgtaaggaaccttaacgttaaacttaacgttacgttacccgttacccgttacccttcccggtttacggtaaccccggggtttacggggaccgggtaaaccggggtaacccgttaaacgggggtacggtaacgtaaccgttaaaacgaaaccggtaacgttcgggtacggttacctaccggaccttaaccgtcgttacttacggttacccttaccggtaccctttcccgtaccgtacctntacccgttagaacccgttaacg

SEQ ID NO: 52040 - DNA, 657 bp, Homo sapiens
  misc_feature: GYAE6OF01AJE1J.18.11.A11.1.454.CMB.1.raw
  modified_base (589)..(589): a, c, t, g, unknown or other
  misc_feature (589)..(589): n is a, c, g, or t
tcagtacgagtatgcacgaccggtgctcgatttagctacgactgcaggggcgagcaagatggtgttgcagacccaggtcttcatttctctgttgctctggatctctggtgccgacggggacatcgtgatgacccagtctccagacctccctggttgtgtctctgggcgagacgggcccaccatcaactgcaacgtccagccagagttgttttaatacagctccaaacaataacaactacttagcttggaccagacaagaaaccaggacacgaccccctaacggtcctcatttacgcgggcatccgtacccgggacggtcccgggtccctgacccgtattccgagacggcgacggtcgggtctagggactagtacgttttcaccgttctaccacctatcccaaccctaacccgtgcccgtaggcccttaggaaagtagtggttacgggacttagttttaacttaccgtgttacaggactaaacttacgttagttaccgttccctacccgtccgtacgtacgggttcccgggtacgggagggtaacccgaaggggttcgaacgtaacgtacaaaccgtacgtggtccggtntaccggccacgtcttacgtcgttcctaccgactttacccgtcccgtacccattcctagaccttaaccg

SEQ ID NO: 52041 - DNA, 584 bp, Homo sapiens
  misc_feature: GYAE6OF01A8XRK.18.11.A11.1.454.CMB.1.raw
tcagtacgagtatgcacgaccggtgctcgatttagctacgactgcaggggcagcaagatggtgttgcagacccaggtcttcatttccctgttgctctggatctctggtgccgacggggacatcgtgatgacccagtctccagactccctggttgtgtctctgggcgagagggccaccatcaactgcaagtccagccagtagtgttttatacagctaccaacaataaacaactacttagcttggtaccagcaagaaaccaggacacgccccctaaggtcctcatttactgggcatccgtacccgggacggtcccggggtccctggaccgattcgaggaggcaggtcgggtcgtagggacagtatttcactctccaccatccaaccaacctcgacaggctaggaagagttggtaggtacttagtttacttacgtgtactagactaaattactataccgttcctcctctcgtacggtcggacggaggaccgaaggtggaagtagtacaaacgacgtgtcggactcggacaccgtatcgttgtacttcaccttcccttacccgacctactctacgtcctacgttaccg

SEQ ID NO: 52042 - DNA, 559 bp, Homo sapiens
  misc_feature: GYAE6OF01ATPQD.18.11.A11.1.454.CMB.1.raw
  modified_base (208)..(208): a, c, t, g, unknown or other
  misc_feature (208)..(208): n is a, c, g, or t
  modified_base (388)..(388): a, c, t, g, unknown or other
  misc_feature (388)..(388): n is a, c, g, or t
  modified_base (409)..(409): a, c, t, g, unknown or other
  misc_feature (409)..(409): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttanacagctccaacaataacaactactagcttgtaccagacagaaaccaggacacgcccctaagtcctacatttactggcatccgtacccggggagtcccggggtccctgaccgattcagaggcagctcggtctggacagtactttcactcacaccataccacccaacctgcaggctagaagntggtgactagtttattacgtntacgagtactaatacctatacgtcctcctctacgaccgttcggacggaaggtaccgaagggtcgaatacgtacgaaaccgatggtcgacttcgacctacctattccgtgttcctaccacgtttccctacccgtacctatccgtctaaccg

SEQ ID NO: 52043 - DNA, 717 bp, Homo sapiens
  misc_feature: GYAE6OF01CEVWS.18.11.A11.1.454.CMB.1.raw
  modified_base (293)..(293): a, c, t, g, unknown or other
  misc_feature (293)..(293): n is a, c, g, or t
  modified_base (302)..(302): a, c, t, g, unknown or other
  misc_feature (302)..(302): n is a, c, g, or t
tcagtacgagtatgcacgaccggtgctcgatttagctacgactgcaggggcagcaagatggtgttgcagacccaggtcttcatttctctgttgctctggatctctggtgccgactgggacatcgtgatgacccagtctcagactccctggttgtgtctcgtgggcgaggagggccacatcaactgacaacgtccagccagtagttagttttaatacagcctaccaaacaaactaactaacttacttagcttaggtacagcaacgaaaccaggacacgacccctaaggtcctanactttacgngggcatccggtacccgggtacggtcccggggtccctcggaccgtattcgaagacggcagggcgggtcgtagggacagtactttcactcctaccaacctactaccaaccctaacctcgacgtaacggcgttaagaaggtagttcgggtacggtactttaagtttacttacgtcgtaactacggactaaacgttacttacgttaccgttcctaccgttccgtacgttaccggttcggggacgggtaaccggggaaccgtaaggggtggaaacgttaactaaccggtaaacggtaaccgttcgggtacggtccgtacgtacccgtaacccgttaacgtttcggttcccgttcccgttaacctacccgtttcccccgtttacccccggtaacctaaccgtttcgttaacccggtaaacc

SEQ ID NO: 52044 - DNA, 749 bp, Homo sapiens
  misc_feature: GYAE6OF01A4OBN.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagttgttttatacagctaccaaacaataacaactacttagcttggaaccagacaacgaaaccaggacacgaccccgtaaggtcctctatttacgtggcacgtccgtacccggggtacgtcccggggtccctacggacccgtagtttccgaacggacggccgaacgggtccggggttacgtacggggaactacggtacttttccgaaccttcctaccgaaccctacttacccgaacccgaaacccgttcggaccgtaaggtaccttacggaaagtaccgttggttacgggtaccttaagttttaacgttaccttggtaccgaagtaaccgtaaattaacgttacttaccgttaccccttaccttaccgtaccgttaccgggttcccggggaacggtaaccggggtaaccgtaagggtaggtaacgaacttaacggaaaccgtaacgtggttacgggctacggacccgtaacctcgttacgttcgttaccgtttaccaacccgtttccccgttaccccggaccttaacggtttccctaagtaccgttaaaccg

SEQ ID NO: 52045 - DNA, 565 bp, Homo sapiens
  misc_feature: GYAE6OF01ALR2N.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcaagaaaccaggacacgccccctaaggtcctcatttactgggcatccgtacccggggagtccggggtccctgaccgattcagaggcaggcgggtctgggacagtatttcactctcacatccaccaactgcaggctgaagatgtggctagtttactattgtcgagtacaattacctattacgtcccttcctcctaccgtacggttccgggcgggtacgggaacgaacgggtagggtagaacgtacaaacggaacgtgcggtctgcacctagttctacgttcttacctattcccttacccgcctactacgtctacttaccg

SEQ ID NO: 52046 - DNA, 699 bp, Homo sapiens
  misc_feature: GYAE6OF01DYZLK.18.11.A11.1.454.CMB.1.raw
  modified_base (293)..(293): a, c, t, g, unknown or other
  misc_feature (293)..(293): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagttgttttatacagctaccaaacaaactaacaactacttagcttggtaccagacaagaaaaccaggacacgaccccctaaggtcctcatttacnggcatccgtacccggggacgtccggggtccctgaccgattcaggagcgacggcgggtcgtagggacagtactttcactctaccaccactaccaaccaacgtcgcaggctagaacgtagtggtcggacttaagttttacttacgttcgtacaacgtactaaacttacgttaattaccgttacccttcccgttaccttacccgtaccgggtttaccgggtaccgggaacggggtaacccgtaaggggttacgggaagtaacttaaccgaaaacggtacgttacggtacggtaccgtacgaccctaacccgttacgtttacccgttcgtttacccgttttaccctaaccgtttcccccgtttacccccggtacccttactttacccggtacgtaaccctttaaacccgg

SEQ ID NO: 52047 - DNA, 538 bp, Homo sapiens
  misc_feature: GYAE6OF01BMG0H.18.11.A11.1.454.CMB.1.raw
  modified_base (284)..(284): a, c, t, g, unknown or other
  misc_feature (284)..(284): n is a, c, g, or t
  modified_base (382)..(382): a, c, t, g, unknown or other
  misc_feature (382)..(382): n is a, c, g, or t
  modified_base (481)..(481): a, c, t, g, unknown or other
  misc_feature (481)..(481): n is a, c, g, or t
  modified_base (522)..(522): a, c, t, g, unknown or other
  misc_feature (522)..(522): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacacgccccctaaggtcctcatttacngggcatcgtacccgggagtcccggggtcctgaccgattcagaggcagcgggtctgggacagatttcactctcaccatcaccaactgcaggctagaagntgtggactagtttattactgtcagtactaatactatacgtcctcctctccgcggttcggcggacggaccgaaggtggaacagtaccgaaacgacgtcgnggctcgaccacctagtctcggttccttcacttccctacccnctactctgaactaccg

SEQ ID NO: 52048 - DNA, 679 bp, Homo sapiens
  misc_feature: GYAE6OF01AWC8G.18.11.A11.1.454.CMB.1.raw
  modified_base (210)..(210): a, c, t, g, unknown or other
  misc_feature (210)..(210): n is a, c, g, or t
  modified_base (223)..(223): a, c, t, g, unknown or other
  misc_feature (223)..(223): n is a, c, g, or t
  modified_base (285)..(285): a, c, t, g, unknown or other
  misc_feature (285)..(285): n is a, c, g, or t
  modified_base (295)..(295): a, c, t, g, unknown or other
  misc_feature (295)..(295): n is a, c, g, or t
  modified_base (314)..(314): a, c, t, g, unknown or other
  misc_feature (314)..(314): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctcgtgggcgagagggccaccatcaactgcaagtccagccagagttgttttanacagctaccaaanaataacaactacttagcttaggtaccagcaagaaaccaggaccacgaccccctaaggtcctntactttacgnggactacgtttacccgggnggtcccgggtcctgaccgtattcgaggaggcgaggcgggtctgggacagtactttcgactctacaccatacccaccaacctgaccgaggtactaggaagtagttggtacggtactttaacgtttacttacgtcggtacctaacgtaactaaacttacttaacgttaccgttcccttaccgtccgttaccggtacccgggtttacgggaccgggtaaccgggaccgtaagggtcggaacgtaacgtaaccgtaaaacgtacgtaggtcggtaccgtacgaccgtaaccgtacgtcgttacgttaccgttctacccgttacccgttcccccgacttaccttaccgtacgtaacttacgttaacccgg

SEQ ID NO: 52049 - DNA, 590 bp, Homo sapiens
  misc_feature: GYAE6OF01BUU4G.18.11.A11.1.454.CMB.1.raw
  modified_base (368)..(368): a, c, t, g, unknown or other
  misc_feature (368)..(368): n is a, c, g, or t
  modified_base (384)..(384): a, c, t, g, unknown or other
  misc_feature (384)..(384): n is a, c, g, or t
  modified_base (389)..(389): a, c, t, g, unknown or other
  misc_feature (389)..(389): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctacaaacaataacaactacttagcttggtaccagcagaaaccaggacagaccccctaaggtcctctatttacgtgggcatccgtacccggggagtcccggggtccctcgaccgattcagacggcaggcggtctgggacagatttcactctcaccntccaccaactgcagcngaagntgtgactagtttattactgtctagactaacgttactaatcgttccctcctccgttctacggttcgacgggaacggaccgtaaggtggaagtatacgaaacggactggttacgcgtacgaccctaaccgacttcctacgttccttactaaccttccccgtttcccccgacccttattcccgtaacgttaaccttaaacccgg

SEQ ID NO: 52050 - DNA, 849 bp, Homo sapiens
  misc_feature: GYAE6OF01BS3WC.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactcccgtggttgtgtctcgtgggcgagacgggccaccatcaactgcaagtccagccagtagttgttttatacagctaccaaacaataaccaacttacttagcttaggtaccagacaagaaaccaggaccacgtacccccctaaaggtccctactaacgttttacgtcgggacctaacgtccccggtaaccccgggggtacgggttaccccggggggttacccctacgggtaacccggtactttaccggaacggacgggaccgtacgggtccgggggttacctacgggggaacctaacggggttaacgttttaccctaaccgttcccgtaacctaaccctaaccttaccccgaaaccccgtaaacccgtacggaccgaacgggtaccgttaagggaaacggtagttgggttacgggtactttaaggttttactttaacgttacgtacgaacggtaacctaaactttaaccgtaactttaacccggttcccttaccctttaccgtaaccggttaacccggggtttaccggggacggggtaaaccggggtaaccggtaaaggggtacgggtaaacggtaacgttaaaccgaaaccggtaacgttacgggtacgggaccttacgaccgtacccgtagttccgttacggtttcctttaccttaccgttttccccccgacttacgttacctcggtaaaccttcccgttaacg

SEQ ID NO: 52051 - DNA, 786 bp, Homo sapiens
  misc_feature: GYAE6OF01D1IVG.18.11.A11.1.454.CMB.1.raw
  modified_base (653)..(653): a, c, t, g, unknown or other
  misc_feature (653)..(653): n is a, c, g, or t
tcagtacgagtatgcacgaccggtgctcgatttagctacgactgcaggggcagcaagatggtgttgcagacccaggtcttcatttctctgttgctctggatctctggtgccggacggggacatcgtgatcgacccagtctccagacctcccgtggttgtgtctcgtgggcgagacggccaccatcaactcgacaacgtccacgccagtagttgttttaacacacgcctaccaaaacaaataaacctaacttacttagcttacggtaccagaccaaacgaaaacccgaacggaaccaacccggtacccccgttaaaggttccctactacttttaccgcgggacctacgtacccggtaacccggggtacggtccccggggtccctacggacccgtattaccggaagggacggacggacgggtccgggtacggtacgggactaacgtacttttaccaccgttcctaccaacccactacccaacccgtaaccgtacggaccgaacggtactaacgggtaaacgtacgtttacgggtacgtactttaagttttacttacgtactacgaacgtactaaacttacgttaacttccggttccctcgttacccgtacggttccgggttaccgggaacgggtaacgggaacgtacgggggtanaaaccgttaacgtaaccgaaacgggtacgttgggtacggcctacgtacccgtacgttcgttcgtttcgttacctttacccgaccctttcccccgttacccgtactttaaccttccgtaacgtaacccttaacg

SEQ ID NO: 52052 - DNA, 680 bp, Homo sapiens
  misc_feature: GYAE6OF01A8GRB.18.11.A11.1.454.CMB.1.raw
  modified_base (215)..(215): a, c, t, g, unknown or other
  misc_feature (215)..(215): n is a, c, g, or t
tcagtacgagtatgcacgaccggtgctcgatttagctacgactgcaggggcagcaagatggtgttgcagacccaggtcttcatttctctgttgctctggatctctggtgccggacggggacatcgtgatcgacccagtctccagactccctggttgtgtctcgtgggcgaggagggccaccatcaactgcaacgtccagccagtagttgttttanacagcctaccaaacaataaaccaactacttagcttaggtaccagacaacgaaaccgaggaaccaccgacccccgttaaggtccctactacttttacgtcgggactacgtcccggtacccggggtacggtcccggggtccctggtaccgtattcgagacggacagggcggtcgacgggacgagtactttcactctaccaccactaccgaacccaacgtcgacgaggactaggaacgtagttggtacggtacttagttttacttactcgtacgaagtactaattactaattaccgtccttcctaccgtacgtacggtaccgggacgggaacggtaaccgaagggtacggaactacgtaaccgaacgttacgtggtcggtacctacggaccctaacgtacgttcgttacgttaccgttacctacccgttcccgttacccccgacttaccttaccgtgaaccttaaccg

SEQ ID NO: 52053 - DNA, 516 bp, Homo sapiens
  misc_feature: GYAE6OF01D77WK.18.11.A11.1.454.CMB.1.raw
  modified_base (400)..(400): a, c, t, g, unknown or other
  misc_feature (400)..(400): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactactagcttggtaccagcagaaaccaggacagccccctaaggtcctcattactggcatcgtacccgggagtccggggtccctgaccgattcgagaggcaggcggtcgtgggacagattcactctcacatcaccaactgcagctagaagatgtgtctagtttatactgtcagnaatactatacgtcctctctcacggttcgcggacggacctaaggtggagactacgaaacgacgtgtggctgacaccgattctgtcttacacttccgtcccctacattctgactaccg

SEQ ID NO: 52054 - DNA, 727 bp, Homo sapiens
  misc_feature: GYAE6OF01C0QLM.18.11.A11.1.454.CMB.1.raw
  modified_base (215)..(215): a, c, t, g, unknown or other
  misc_feature (215)..(215): n is a, c, g, or t
  modified_base (638)..(638): a, c, t, g, unknown or other
  misc_feature (638)..(638): n is a, c, g, or t
tcagtacgagtatgcacgaccggtgctcgatttagctacgactgcaggggcagcaagatggtgttgcagacccaggtcttcatttctctgttgctctggatctctggtgccggacggggacatcgtgatcgacccagtcctccagacctccctggttgtgtctcgtgggcgagacgggccacatcaactgcaagtccagccagtagttgttttanacgagtcctaaccaaactaaataacaaaccttacgttagcttacggtaccagacaacgaaaccaggaccaccgacccctaaggtacctactactttacgcgggctacgtaccggtacccgggtacggtcccggggtacctggacccgtattccgaaggacggcgacgggtccgggtacgtcgggactagtactttaccaccttaccgaccacctaactacccgaacctaaccgtgacgacggacttagggaaacgtgtttacgggtacggtaacctttaaggttttaacttaccgttgtaaccaagttaacccgtaaattacttaacttaccggttccctccctttacgtaccgtaaccgggttccgggacggtaaacgggaaccgtaagggtacggacacgtaacgtaaacgtacgtacggngaccttacgacctaccgtacgttccgtttacgttccgttactaacccgttccgttacccccatttaccgtctaacggtcccgttaaacg

SEQ ID NO: 52055 - DNA, 625 bp, Homo sapiens
  misc_feature: GYAE6OF01DRLRO.18.11.A11.1.454.CMB.1.raw
  modified_base (210)..(210): a, c, t, g, unknown or other
  misc_feature (210)..(210): n is a, c, g, or t
  modified_base (295)..(295): a, c, t, g, unknown or other
  misc_feature (295)..(295): n is a, c, g, or t
  modified_base (414)..(414): a, c, t, g, unknown or other
  misc_feature (414)..(414): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagacctccctggttgtgtctctgggcgagagggccaccatcaactgcaagtccagccagagttgttttanacagctccaaacaataacaactacttagcttaggtaccagacaagaaaccaggacacgaccccctaaaggtccctactatttacngggcacgtccgtacccggggacggtcccggggtccctggaccgattccgaggacggacgacggcgggtcgtgggacagtactttcactctcaccatccaacctactgcaggctagaagntgtcgactagtttattacgtgtacagactaatactatacgtccctctctaccgtacgttccgggacggtacggacccgtaagggtggaacgtaacgtactaaaccggtactagggtcgacgttacgacctaaccgtacttcgttacggttccttacccgtacgttccccgtttaccccggactaacgtttccgtacgtaaccttaaacccg

SEQ ID NO: 52056 - DNA, 814 bp, Homo sapiens
  misc_feature: GYAE6OF01CM1WI.18.11.A11.1.454.CMB.1.raw
  modified_base (224)..(224): a, c, t, g, unknown or other
  misc_feature (224)..(224): n is a, c, g, or t
tcagtacgagtatgcacgaccggtgctcgatttagctacgactgcgaggggcagacaagatggtgttgcagacccaggtcttcatttctctgttgctctggatctctggtcgccggacggggacatcgtgatcgacccagtcctccagacctccctggttgtgtctcgtgggcgaggacggccaccatacaactgacaacgtccagccagtagtttagttttanacagtacctaccaaactaaactaaacctaacttaacgttagtacgtttcggaaccagacaacgaaaccacggacaccgacccccgttaaggtcctactaactttacgtcgggcacgttacccggtacccggggtacggtcccggggttccctacggaacccgtacttaccgaggtacggaccgaggtcggggtcgtacggggacaggttactttacaacctttccgacctaaccctaacgttacccaacccctaaaccgtcggaccgtaaggtaccgtacgggtaaacgtagttcgggttacgggtacccgtttaagtttttaacgtaccgttaggttaccgaacgtaactaacgttaactaacgttaccgttccccgttacccttaccgtaccggttacccgggttaccgggggacggggtaaccggggtaaccgtaaggggtacggggtaacgtaacgtaaaccgtaaaccggtacggttacgggtcgaccggtcgaccctaacccgtacgtttacctacggtttccctacgttaaccccgtttccctaccccgttacccacgtttacccgtagtaccctttaacccg

SEQ ID NO: 52057 - DNA, 935 bp, Homo sapiens
  misc_feature: GYAE6OF01DAYEZ.18.11.A11.1.454.CMB.1.raw
  modified_base (220)..(220): a, c, t, g, unknown or other
  misc_feature (220)..(220): n is a, c, g, or t
tcagtacgagtatgcacgaccggtgctcgatttagctacgactgcaggggcagcaagatggtgttgcagacccaggtcttcatttctctgttgctctggatctctggtcgccggacggggacatcgtgatcgacccagtcctccagaccttcccgtggttgtgtctcgtgggcgaggacgggccaccatcaactgcaagtccagccagtagttgttttanacagcctaccaaacaataaacaactacttagcttacggtaccagacaacgaaaccgacggaccaccgtacccccgttaaggtccttactaacttttacggtacgggacctaacgttaccccggtaaccccggggtacggtcccgggggttaccctacggaaccgtacttcgaggacggtcgacgggtcggtcgttagggactagtactttcgaacttccgtacacctactaccacctaacccgtgaccacggtactaacggaagtacgtacggttacggtaacgtttaacgtttttaacgttaccgttacggttacccgtaaagtaaccgttaaaccgtttaaccgtttaaccgtttaacccgtttacccctttccccgtttacccggtttaccccgggttaaccggggtttacccgggggtaacccgggggttaaacccgggggttaacccggggttaaaacggggggttaaccgggggtaaaccgggttaaaccgttaaaaccccggttaaaaaaccggggtttaccggtttacccgggggttaccgggttaacccgttaaccccggggtaacccttaaccccgggttaacgttttccccggtttacccggtttcccgttttttaaaccctccccggtttttaacccccgttcccccgggttaaccccttttacgttaaccccggttaccggttaaaccccgtttaaaccggg

SEQ ID NO: 52058 - DNA, 574 bp, Homo sapiens
  misc_feature: GYAE6OF01CL6GP.18.11.A11.1.454.CMB.1.raw
  modified_base (207)..(207): a, c, t, g, unknown or other
  misc_feature (207)..(207): n is a, c, g, or t
  modified_base (336)..(336): a, c, t, g, unknown or other
  misc_feature (336)..(336): n is a, c, g, or t
  modified_base (370)..(370): a, c, t, g, unknown or other
  misc_feature (370)..(370): n is a, c, g, or t
  modified_base (383)..(383): a, c, t, g, unknown or other
  misc_feature (383)..(383): n is a, c, g, or t
  modified_base (386)..(386): a, c, t, g, unknown or other
  misc_feature (386)..(386): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgtttanacagctccaacaataacaactacttagcttggtaccagcagaaaccaggacacgccccctaaggtcctctattactggcactcgtacccggagtccgggtcctgaccgatcgagtaggcaggcggtcgngggacagtacttcactctcaccatcaccaacgtncgaggctagaagntgnggactagtttatactgtacagactaactactactacgtaccctctacctcgtacggttacgggcggaagggtacccgtaagggtacggtagtacgtaacgaaacgtactcggagtccgtcgacctaccgtacgttcgtacgttcttaccactttccccgttccccgctaagttccctagtacttaacg

SEQ ID NO: 52059 - DNA, 641 bp, Homo sapiens
  misc_feature: GYAE6OF01CXH0Q.18.11.A11.1.454.CMB.1.raw
  modified_base (211)..(211): a, c, t, g, unknown or other
  misc_feature (211)..(211): n is a, c, g, or t
  modified_base (293)..(293): a, c, t, g, unknown or other
  misc_feature (293)..(293): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagacctccctggttgtgtctctgggcgagacgggccaccatcaactgcaagtccagccagagttgttttanacagctaccaacaaataacaacttacttagcttggtaccagacacgaaaccaggacacgcccctaagtcctctactttacgnggcactccgtacccggagtcccgggtcctgaccgtattcaggacggcgagcgggtcgtgggacagtactttacaccttctacaccactaccaaccctaacctcggacacggcttacgaagtagtcggtcggacttaagtttacttacgtgtaccaagtactaatactagtaccgttcctccttcgtacccgtacggttaccgggacgggtaacggaacggtaacggtggacgtaactaaccgaaacgtacgtggtaccggcgttacgaccctacgtacgttccgttacggtttccttacgtaccgtttcccctaccccgtaccctacgttacccgtgtaacctaacgg

SEQ ID NO: 52060 - DNA, 819 bp, Homo sapiens
  misc_feature: GYAE6OF01EC06U.18.11.A11.1.454.CMB.1.raw
tcagtacgagtatgcacgaccggtgctcgatttagctacgactgcaggggacgagcaagatggtgttcgcacgacccgaggttcttcgattttctcttggttgctctgggatctactggtgccgacgggacatcggtgtagtgacccagtctccagtaccttcccttggttgtcgtttactcgtcgggcgagagggccaccatcaactgcaagtccaggccagtagttgttttactacgacgctaccaaactaataaccaactacttagcttcggtaccagcaacgaaacctaggaccacgtccccctaaggtccctactacgttttacgtcggggacctacgttccggtaccccgggggtacgggttcccggggggtcccccttagggaacccggtaagtttccgaacggtaacgggtcctaagggccggggttaccgttaggggaacctagggtaacgttttccgaacttccgtacctaaccctaacgttacccaaacccgtaacccgttcggaccggtaccgggtacctaacggtaacgtacgttacgggtacgggaaccttaagggtttttaactttaccggtaggtaccgaacgtaccgtaaacttaccgtttaacgtttacgttacccccttacgttaccgtaccgttaccgggtttaccgggacgggtaacgggaacccgtaaggggtacgggaacgtaaaccgttaccgaaaacgttacgttcggtacgggccttacggaccctacgtacgttcgtacgttccgttacccacctttcccgttccccgacttagttccttagacccttacgg

SEQ ID NO: 52061 - DNA, 845 bp, Homo sapiens
  misc_feature: GYAE6OF01DZAHY.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtgccggacggggacatcgtgatcgacccagtctccagactccctggtgtgtctcgtgggcgaggacgggccaaccatacaactcgacaaacgtccacgccaagtagttagttttaacaacgagccttaaccaaaactaaactaaacctaaacttacgttaagtccgttttacggaaccaggaccaaacggaaaacccgacggaaccaccggaccccccgttaaaggttcccttactaacgtttaacggtcgggtacctacgttccccggtaacccggggtaccggttaccccggggtccctacggtaacccgtaacttaccgaaggtacggaccgacgggtaccgggtccgttagggaaccgtagttactttaccaactacccgtaccaacctacctaccgaaccccaaacgtcgaccgaaggtccgtaaggaaacgtgtttcggtacggtactttaaggtttttaactactcggtaaaccaacgttacttaaacgtttaacctaacgtttcccgttaccctccccgttacgttacccggtaaccggggtttccgggaaccggggtaaaccgggaacccgtaagggtacgggtaactaaaccgtaacccggtaaacgtaccgtttgggacccgtacgtaccgaacccggtaacctcgtttaagtccctttacgttaacccctcccgtttaccccgttacccgacccttaagtttctaacccgttaagttaaacccccg

SEQ ID NO: 52062 - DNA, 529 bp, Homo sapiens
  misc_feature: GYAE6OF01BQG34.18.11.A11.1.454.CMB.1.raw
  modified_base (485)..(485): a, c, t, g, unknown or other
  misc_feature (485)..(485): n is a, c, g, or t
  modified_base (491)..(491): a, c, t, g, unknown or other
  misc_feature (491)..(491): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaaacaataacaactacttagcttggtaccagcagaaaccaggacacgccccctaaggtcctcattactgggcatcctacccgggagtcccggggtccctgaccgattcagaggcaggcgggtctgggacagtatttcactctcaccatcaaccacctgcaggctgaagatgtgctagtttattacgtgtacagactaattactatagtcctctctcacgtcggcggaggaccaggtgagtactacaacgtactgtggactcgcaccgtnttcgtnttctctaccttccctacccgctacgtctagtactaacg

SEQ ID NO: 52063 - DNA, 578 bp, Homo sapiens
  misc_feature: GYAE6OF01EE8DH.18.11.A11.1.454.CMB.1.raw
  modified_base (294)..(294): a, c, t, g, unknown or other
  misc_feature (294)..(294): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagtagttgttttatacagctaccaaacaataacaactacttagcttaggtaccagacagaaaccaggaccacgccccctaaggtcctactatttacgnggacacgtaccgtacccggggaggtcccggggtccctggaccgtattcgagacggcgacggcgggttcgtgggactagtactttccacgtctcaccataccaaccaacctcgcaggctagaagagtggtaggactagtttattactgtacagtacaatctattacgtcctctctcgtacgttcgggagacggaacgaggtggaagtactaacgaacgtagtacgtcggctacggacctacgacttccgtgttccttacacttcccttccactattctgactacg

SEQ ID NO: 52064 - DNA, 541 bp, Homo sapiens
  misc_feature: GYAE6OF01DLNUU.18.11.A11.1.454.CMB.1.raw
  modified_base (392)..(392): a, c, t, g, unknown or other
  misc_feature (392)..(392): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctaccaacaataacaactacttagcttggtaccagcagaaaaccagacacgccccctaaggtcctacatttactgggcatccgtacccgggagtcccggggtccctgacccgattcagaggcagcgggtcgtgggacagctttcactctcaccatccaacctaacctgcaggctagaagntgtggctagtttatactgtcagacaatactatacgtcctcctctcacgttcggcgaggaccaggtggacagtacaaacgtactggtacgctgaccactatcttacgttcttacctacttcccgttcccgacctatcgtagacttaaccg

SEQ ID NO: 52065 - DNA, 550 bp, Homo sapiens
  misc_feature: GYAE6OF01BQTOR.18.11.A11.1.454.CMB.1.raw
  modified_base (209)..(209): a, c, t, g, unknown or other
  misc_feature (209)..(209): n is a, c, g, or t
  modified_base (370)..(370): a, c, t, g, unknown or other
  misc_feature (370)..(370): n is a, c, g, or t
  modified_base (388)..(388): a, c, t, g, unknown or other
  misc_feature (388)..(388): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagttgttttanacagctaccaaacaataacaactacttagcttggtaccagcaagaaaccaggaacacgaccccctaaggtcctctatttactgggcactccgtacccgggagtcccggggtccctggaccgattcgagacggcgaggcgggtctgggacagtattcactcncacatcaccactgcagcngatgtgtgactagtttatactgtacagctaatactatacgtcctctctcgtacgtcggaggacggaccgaagggtgaagatacgaaacgtagtgtcggactcgacctacctagttcttgtccttctaccgttcccttcccgacctactccgtgtactaaccg

SEQ ID NO: 52066 - DNA, 726 bp, Homo sapiens
  misc_feature: GYAE6OF01C665D.18.11.A11.1.454.CMB.1.raw
  modified_base (628)..(628): a, c, t, g, unknown or other
  misc_feature (628)..(628): n is a, c, g, or t
tcagtacgagtatgcacgaccggtgctcgatttagctacgactgcaggggcagcaagatggtgttgcagacccaggtcttcatttctctgttgctctggatctctggtcgccggacggggacatcgtgatcgacccagtcctccagacctcccgtggttgtgtctcgtgggacgagacggcccaactatacaactgacaacgtccgaagccaagtagtttgttttaacacacgactaccaaacaaactaacaaacttacgtagcgttacgaacacgcaaacgaaaccaggaccacgtacccccgtaaggtcctacttaagtttacggcgggactaacgtaccccgggtaaacccggggtccgggttacccgggggtcccctacggtaacccgtaacgttacgaggaacggtcgaggggtccgggtacggtgggaactaggtactttacaaccttcgacaacctactacccaacctaaccgtgaccgaggactaggaagtagtggtacgtacttaggtttacttacggtataccgataaccttaaaacttataaccgttaccgttacccctcttaccgtacgttacgggttaccgggaacgggtaaccggaacggtaggacgggtaaanaacgtaacgaacgtacgtcggtacgactacgactaccgttacgtctacttccgttacctaccttaccccgttaccgactacgttaccacgtacctacg

SEQ ID NO: 52067 - DNA, 618 bp, Homo sapiens
  misc_feature: GYAE6OF01C0W2V.18.11.A11.1.454.CMB.1.raw
  modified_base (208)..(208): a, c, t, g, unknown or other
  misc_feature (208)..(208): n is a, c, g, or t
  modified_base (216)..(216): a, c, t, g, unknown or other
  misc_feature (216)..(216): n is a, c, g, or t
  modified_base (345)..(345): a, c, t, g, unknown or other
  misc_feature (345)..(345): n is a, c, g, or t
  modified_base (403)..(403): a, c, t, g, unknown or other
  misc_feature (403)..(403): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagacctccctggttgtgtctcgtgggcgagacggcccaaccatcaactgcaagtccagccagaggttntttacacngctaccaataaactaaacactacttagacttaggaccagacagaaaaccaggacacgtacccctaaggtacctcaatttacgagggcaactaccggtaacccgggaggtcccggggtcctagaaccgtntacagaggcacggcggtactgggacagtattccactcctcacaactcgacccaacgtncgagctagtaagctaggtacggacttaagttttactaacgtgtacaacgtaactaaattactacgtaacttcctaccttctaccgttacgggtacggaccggggaagtaaccgtaagggtagaagacttaaacgaacggtacttgggtcgacgtcggaccaacgtacttactacgtcttacgtacctcttcccccgatactacgtctactaaccg

SEQ ID NO: 52068 - DNA, 615 bp, Homo sapiens
  misc_feature: GYAE6OF01ASH9A.18.11.A11.1.454.CMB.1.raw
  modified_base (207)..(207): a, c, t, g, unknown or other
  misc_feature (207)..(207): n is a, c, g, or t
  modified_base (286)..(286): a, c, t, g, unknown or other
  misc_feature (286)..(286): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgtttanacagctaccaacaataacaactacttagcttaggtaccagcaagaaaccaggacacgccccctaaggtcctcatttacngggcatccgtacccgggagtcccggggtcctggaccgtatcgagaggcaggtcgggtctgggacaggtactttcgactctcacctacgtccaaccaaccgtgacaggtctaggaacgtagtggtaggactaaggttttattacgtgtacacgtacaaagttactaataccgttacctccttacgtacgtaccggtttccgggacgggtacgggtaacccaagggtacggagaacgtacgaaacgacgtggtcggactagacctaccgtattcctcggttccttcaccgttccccgttacccgacctaacttccgtacgtaccttaaccg

SEQ ID NO: 52069 - DNA, 534 bp, Homo sapiens
  misc_feature: GYAE6OF01A6WP9.18.11.A11.1.454.CMB.1.raw
  modified_base (390)..(390): a, c, t, g, unknown or other
  misc_feature (390)..(390): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagttgttttatacagctccaaacaataacaactacttagcttggtaccagcaagaaaccaggacacgccccctaaggtcctcatttactgggcatcgtacccgggagtccggggtccctgaccgattcgagaggcaggcgggtctgggacagactttcactctcaccatcaccaactgcagctagaagatgnggtctagtttatactgtcagactaatactatacgtcctcctctcgacgttcggcggaggaccaaggtggagatacgaaacgacgtgcggactcgacaccgtatctagttccttacacttcccttcccgacctatctcgactacg

SEQ ID NO: 52070 - DNA, 647 bp, Homo sapiens
  misc_feature: GYAE6OF01DC72I.18.11.A11.1.454.CMB.1.raw
  modified_base (301)..(301): a, c, t, g, unknown or other
  misc_feature (301)..(301): n is a, c, g, or t
  modified_base (361)..(361): a, c, t, g, unknown or other
  misc_feature (361)..(361): n is a, c, g, or t
  modified_base (634)..(634): a, c, t, g, unknown or other
  misc_feature (634)..(634): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtcctccagacctccctggttgtgtctcgtgggcgagacgggccaccatcaactgcaagtccagccagagttgttttatacagcctaccaaacaataaaccaacttacttagtcttggtaccagacagaaaaccaggaacacgaccccctaaggtcctctattacgnggccatccgtacccgggaggtcccgggtccctgaccgtattcgagaggcaggccggtcgngggacagtatttcactctccaaccataccaccaacctgacaggctagaagtatggtaggaccttaagtttattacgtcgtctaacgtaacaactttactaagttacccgttcccttacctccttccgacggtttccggggacgggtaacgggaacccgtaagggttacgaggtacctaaaccgaaaaccgtagttacgggtgtacgacgtaccacctaccgttacttcgttaccttacctacgttaccccgtttcccgacctacttaccggtntaaccgttaaccc

SEQ ID NO: 52071 - DNA, 856 bp, Homo sapiens
  misc_feature: GYAE6OF01CFNXA.18.11.A11.1.454.CMB.1.raw
  modified_base (220)..(220): a, c, t, g, unknown or other
  misc_feature (220)..(220): n is a, c, g, or t
tcagtacgagtatgcacgaccggtgctcgatttagctacgactgcaggggcagcaagatggtgttgcagacccaggtcttcatttctctgttgctctggatctctggtgccggacggggacagtcgtgatcgacccagtctccagaccttcccgtggttgtgtcctcgtgggcgaggacggcccacatcaactgacaagtccagccagtagttgttttanacagcctaccaaacaaataacgaacttacttagactttaggaaccagacgaacgaaaaccgaggtaaccaaccgtacccccgtaaaggtcccttacgtaacgttttaccgtacggggacctaacgttacccgggtaaccccggggtacgggttcccccgggggttacccctacggtaaccccgtaacgtttcccggaaggaaccggggtaccgaacggggtccccgggggttaccgtaagggggaacccttaacgggtttaacgttttaccccgaaccgtttcccgtaccccaaaccgtaacgttaccccaaacccgtaaacccgtcggtaaccgacggtacctagggtaaacgtcgttacggtacggtacgtttaacgttttaacgttacgtacgtacgaacgtaactaaacgtttaaccgttaagttacccgttaccctttaccgttaccgttaccggtaacccggttttccggggaaccgggtaaccgggtaacccgtaaggggttaacggacgttaacgtaaacgtaaaccggtacgttggaccgtcgtacgacctaaccttcgttaccttcgtaccgtccttaaaccgttccccgttacccggaccttagttaccgtagtcccttaaaccg

SEQ ID NO: 52072 - DNA, 600 bp, Homo sapiens
  misc_feature: GYAE6OF01EMOXC.18.11.A11.1.454.CMB.1.raw
  modified_base (213)..(213): a, c, t, g, unknown or other
  misc_feature (213)..(213): n is a, c, g, or t
  modified_base (301)..(301): a, c, t, g, unknown or other
  misc_feature (301)..(301): n is a, c, g, or t
  modified_base (367)..(367): a, c, t, g, unknown or other
  misc_feature (367)..(367): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgaccccagtctccagacctccctggttgtgtctcgtgggcgagagggccaccatcaactgcaagtccagccagtagttgttttanacacgcctaccaaacaataaaccaacttacttagcttggtaccagcaagaaaccaggaaccacgccccctaaggtcctactatttacngggctactccgtacccggggacgtcccggggtccctgaccgtattcgaggaggcaggcgggttcgnggacagtactttcactcctcaccactccaccaactcgcaggctagaacgtatggtggactaagtttacttactgtacagaactaactacttataccttccctctctcgtacggttcggacggaagaccgaggtgaatactaacgaacgtacgtgtacgcgtcgacctaaccgtacttctcgttcccttactaccttccccgttcccctactactttaccgtacgtacgtaacg

SEQ ID NO: 52073 - DNA, 731 bp, Homo sapiens
  misc_feature: GYAE6OF01DSWQR.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtgccgacggggacatcggtgatcgacccagtcctccagactccctggttgtgtctcgtgggcgagagggccaccatacaactgacaagtccagccagtagttgttttaatacgagcctaccaaactaaataaacctaacttacttagcgttggtaccagacaagaaaccagaccacgtacccctaaggtcctactagtttaccgtgggactacgttacccggtacccgggacggtttccccgggggtcccttaggaacccgtagttccgaggacggcgtacgggtccggggtacggtaggacgtagtactttcgaccttcaccacctactaccacctaactcgacgaggctaaggatagtggtagtacgttagtttacttagtactacgtaagtaacttaaatacgttaacttaccgttacccttcccgttacgttacccgtaaccgggttccgggtaaccggggtaaccgggtaaccggtaagggtacggtaacggtaacttaaccgaaaccggttacgtcgggtacggtccgtaccgtacctaacccgttacgtcgtttaccgttccttacccgtccgtttaccccgtccccggtacttaccttacctagtacccttaaccg

SEQ ID NO: 52074 - DNA, 814 bp, Homo sapiens
  misc_feature: GYAE6OF01DAYVY.18.11.A11.1.454.CMB.1.raw
  modified_base (216)..(216): a, c, t, g, unknown or other
  misc_feature (216)..(216): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatcgacccagtctccagacctccctggttgtgtctcgtgggcgaggacgggccaccatcaactgcaacgtccagccagtagttgttttanacagcctaccaaacaataacctaactacttagtcttacggaccagacaagaaccagaccacgccccctaagtcctactattacgcggactacgtccggtaccggggtacggttccccggggtaccctcggaaccgtacgttacggaggacggacgacgggtccggggttacggtacgggaactacggttactttaccgtaccttaccctacccgtaacccacttacccaaaccccgtaacccgttcggaccggtaacggtaccgtaacggtaaacggtacgttagggttaccggttaacgtttaacgtttttaacgttacgttacggtaacgaacggtaccttaaactttaacgttaccgtttacccggttcccctttaccgttaccgtaccgggttacccggttacgggggacccgggtaacgggtaaccggtaaggggtacgaagttaaccgtaaccggaaacgttaccgggtacggtccgggtaccgtacccggaaccttaacccgttaacgtttccgttaccggtttaccttacccgttaccttcccccgttccccgaaccgtttaacgttccctaacggttacctaaacccgg

SEQ ID NO: 52075 - DNA, 585 bp, Homo sapiens
  misc_feature: GYAE6OF01B17OS.18.11.A11.1.454.CMB.1.raw
  modified_base (211)..(211): a, c, t, g, unknown or other
  misc_feature (211)..(211): n is a, c, g, or t
  modified_base (248)..(248): a, c, t, g, unknown or other
  misc_feature (248)..(248): n is a, c, g, or t
  modified_base (351)..(351): a, c, t, g, unknown or other
  misc_feature (351)..(351): n is a, c, g, or t
  modified_base (375)..(375): a, c, t, g, unknown or other
  misc_feature (375)..(375): n is a, c, g, or t
  modified_base (401)..(401): a, c, t, g, unknown or other
  misc_feature (401)..(401): n is a, c, g, or t
  modified_base (423)..(423): a, c, t, g, unknown or other
  misc_feature (423)..(423): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctcgtgggcgagacggccaccatcaactgacaagtccagccagagttgttttanacagctacaaacaataacaactactagcttagaccancaagaaaccaggaactacgacccctaaggtcctctaatttacgtggctacgttccgtaaccgggcgttcccggggtcctgaccgattcagagcaggcgggtcngggactagtacttcactctccacnctacaacctaacgtgacaggctaganacgtgtgacttagttatactgnaagtactaatacgtatacgttcctccacgttcaggtttccggacggtaaggaaccgtaaagggtcggtaagactaacgaaaccgtagtgtacggcttacgacctacgtacttacttcgtccttagtaacccttccgttaccccgactactagtccgaatacc

SEQ ID NO: 52076 - DNA, 813 bp, Homo sapiens
  misc_feature: GYAE6OF01CGEIT.18.11.A11.1.454.CMB.1.raw
  modified_base (212)..(212): a, c, t, g, unknown or other
  misc_feature (212)..(212): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagacctccctggttgtgtctctgggcgagacgggccaccatcaactgacaagtccagccagagttgttttanacagctaccaacaataacaactacttagcttggtaccagcaagaaaccgacggaaccacgacccccgtaacggtcctactactttacgtcgggaccacgtaccgtacccgggtacggtcccggggtccctcggaccgtattccgaggacggacgagggcgggtcgtacgggacgtacgtactttccaacttccgtacctaaccctactaccctaaacccgaaacccgtggaccgtaacggtccgtaaggtaaacgtacgtttacgggtacgggtaaccttttaaggtttttaactttaaccggtcggttaactaacggtaccttaaaacgttaacccgtttaaccgtttacccgtttccccctttaccccgttccgttaccccgtaccggggttttacccggggaacggggtaaaccggggtaacccggtaaacgggggttacgggtaacgtaaaccgtaacccgaaaaccgggttaccgttaggtacgggtacctacggaaccccgtaccgtaaccgtttccgttacgtttacccgtttacccgttacgttacccccgtttaccccgacccgttaactttccgtaccgtaacctaaaccg

SEQ ID NO: 52077 - DNA, 598 bp, Homo sapiens
  misc_feature: GYAE6OF01B7JSU.18.11.A11.1.454.CMB.1.raw
  modified_base (538)..(538): a, c, t, g, unknown or other
  misc_feature (538)..(538): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagcccagagttgttttatacagctaccaaacaataaacaactacttagcttaggtaccagcagaaaccaggacacgaccccctaaggtcctctatttactggcactccgtaccgggacgtcccggggtccctgaccgtattcaggaggtcaggtcgggtcgtagggacagtatttcgactctacaccactcacccaactcgcaggctagaagtatgtaggcttaagtttacttacgtgtacagtacaaattactatacgtccctcgtcctcgtacggttcgggacgacgggaacctagggtgaacgtataaccgaaacgtacgttgcggctaggaccctaaccgtntacgttcgttcttacacctttacccgttaccccgacgtatcccgttagaacccgttaacg

SEQ ID NO: 52078 - DNA, 761 bp, Homo sapiens
  misc_feature: GYAE6OF01B2BWC.18.11.A11.1.454.CMB.1.raw
  modified_base (216)..(216): a, c, t, g, unknown or other
  misc_feature (216)..(216): n is a, c, g, or t
  modified_base (303)..(303): a, c, t, g, unknown or other
  misc_feature (303)..(303): n is a, c, g, or t
tcagtacgagtatgcacgaccggtgctcgatttagctacgactgcaggggcagcaagatggtgttgcagacccaggtcttcatttctctgttgctctggatctctggtgccggacggggacatcgtgatgacccagtctccagacctccctggttgtgtctcgtgggcgaggagggcccaccatcaactgacaagtccagccagtagttgttttanacagcctaccaaacaataacaactacttagcttaggtaccagacaacgaaaccaggaccaccgacccctaaggtcctactattacgnggcacgtccgtacccgggacggtcccgggtccctgacccgtatacgaggacgacgacgggtcggtacgtgggacagtactttcactctaccaaccacgtacccaaccctaaccgtcgacgtaggacctaggaaggtacgtagggtacggtactttaaggttttaacttacgttagtaaccaagtacctaaactttactaacttacccggttccccttacccttaccgttacccggtttacggggttaccgggaccggggtaaaccgggtaacccgtaaggggtacggtaacggtaacgttaaaccggaaaccgttacggtagggttaccgggaccgttccggaaaccccttaacccgtacgtttacccggtttcggttttcctacccgttaacccgttttcccccttacccccggtacctttaaccgttccccggttaagtaaacccccgtttaaccg

SEQ ID NO: 52079 - DNA, 782 bp, Homo sapiens
  misc_feature: GYAE6OF01BWMSK.18.11.A11.1.454.CMB.1.raw
  modified_base (330)..(330): a, c, t, g, unknown or other
  misc_feature (330)..(330): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgtttttaatacagcctaccaaacaataacaactacttagcttggtaccagcaagaaaccaggaccacgccccctaaggtcctctactttacgtgggactagtccgtacccgggacgtcccggggtcccncggaccgtattcgagacggcgacggcggtcgtgggactaggtacttctacgtcctaccgtaaccactacccgaaccctaaccgttcggacccgaacgggtacccgtaaggtaacggtaagttcggggttacgggtacctttaagggtttttaaccttaacggtttcggttaaccgtaacgtaccgttaaaagtttacccttaaacgtttaaccggttcccctttacccgtttcccgttaccggttacccgggtttaccggggtaaccgggtaaccggggtaaacccgggtaaagggtacggggtaacgtaacggttaaaccccgtaaacggtaaccgttacgggtacggtacgtaccgaccctaaccgtacgttcgttaacggttccctttacgtaaccccgttccccgttacccccgtacccgttacttacccgtacgtaaccttaacccg

SEQ ID NO: 52080 - DNA, 696 bp, Homo sapiens
  misc_feature: GYAE6OF01DRAZQ.18.11.A11.1.454.CMB.1.raw
  modified_base (226)..(226): a, c, t, g, unknown or other
  misc_feature (226)..(226): n is a, c, g, or t
  modified_base (241)..(241): a, c, t, g, unknown or other
  misc_feature (241)..(241): n is a, c, g, or t
  modified_base (284)..(284): a, c, t, g, unknown or other
  misc_feature (284)..(284): n is a, c, g, or t
  modified_base (347)..(347): a, c, t, g, unknown or other
  misc_feature (347)..(347): n is a, c, g, or t
  modified_base (381)..(381): a, c, t, g, unknown or other
  misc_feature (381)..(381): n is a, c, g, or t
  modified_base (395)..(395): a, c, t, g, unknown or other
  misc_feature (395)..(395): n is a, c, g, or t
tcagtacgagtatgcacgaccggtgctcgatttagctacgactgcaggggcagcaagatggtgttgcagacccaggtcttcatttctctgttgctctggatctcgtggtcgccggacggggacatcggtgatcgacccagtcctccagacctccctgggttgtgtctcgtggggcgaggacggccaaccatacaactgacaagtccagccaagtagttagtttaanacagcctaaccaaanaaactaacaacttacttagctaggtaaccagacaagaaaccgnggaaccacgtaccccctaaggtcctactaacgtttacgcgggtacacgtaccggtaccggggngttcccgggtcctaggaccgtattccgagacggngacggtcgggtacngggactagtacttccactctacaactactccgaacctaacgtgaccgtaaggactaggtaagtagtcggtaggtacctaagttttaacgtactacgtagaacgtaactaaattacgtaactcgtacccctcgtaccgtacgtaccgggttcggacgggtaacgggaacctaagggtcggaaactacgtaacgtaaaccgacgttggtcgtaccgttacaccgtaacgtaccgttcgtacgtttcctacgtaacccgtttcccgtaccccgtaaacgtactaccgttagaacccgttaaacg

SEQ ID NO: 52081 - DNA, 531 bp, Homo sapiens
  misc_feature: GYAE6OF01ERPK4.18.11.A11.1.454.CMB.1.raw
  modified_base (292)..(292): a, c, t, g, unknown or other
  misc_feature (292)..(292): n is a, c, g, or t
  modified_base (471)..(471): a, c, t, g, unknown or other
  misc_feature (471)..(471): n is a, c, g, or t
  modified_base (495)..(495): a, c, t, g, unknown or other
  misc_feature (495)..(495): n is a, c, g, or t
  modified_base (521)..(521): a, c, t, g, unknown or other
  misc_feature (521)..(521): n is a, c, g, or t
  modified_base (526)..(526): a, c, t, g, unknown or other
  misc_feature (526)..(526): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagttgttttatacagctaccaaacaataacaactacttagcttaggtaccagcaagaaaccaggacacgaccccctaaggtcctactatttacngggcactccgtacccgggagttccggggtccctgaccgattcgagagcaggcggtctgggaccagtacttcactctccaccatccgaaccaactgcaggctagaagatgtgctaagtttatactggtacagtacaattactatacgtcctctctctacgttcggagaggacgaggtganatacaagactgcgctgaccacgtntctgtccttacacttcctcccgactnacctnaccta

SEQ ID NO: 52082 - DNA, 817 bp, Homo sapiens
  misc_feature: GYAE6OF01CY5HX.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtgccggacggggacatcgtgatcgacccagtcctccagaccttcccgtggttgtgtctcgtgggacgaggacgggccaccatcaactgacaagtccagccagtagttgttttacacacgtcctaaccaaactaaataaacctaaaccttacgttaacgtacgttacggtaaccaagaccgaaacgaaaacccgacgggaaccacccggtaaccccccgttaacgggtacccttacgtaacgttttaccggtcgggacctacgttaccccggtaaccccggggtacgggttccccggggtacctacggtaaccgtacgttacgacggaacggtcgacgggtccgggtacggacgggacgtaacggttactttaccgaccttacctaccaacctaacctacccgaaccctaaccgtcgaaccggtacggtacttaacggaagttacggttcgggtacggtacgttttaaagttttaacgttaccgtaagttaccgaagtaaccttaaacgtaccttacgttaacccgttcccttacccttacgttccggtaacgggttacggggaccgggtaacgggtaaccggtagggtagaaagttaccgtaaacctaaacgggtctagggtccgacgtcgaaacctaccgtcgttacgttccgttcttacccgtactttccccgttacccgacttaccttacgccgtaaccttaaccgg

SEQ ID NO: 52083 - DNA, 553 bp, Homo sapiens
  misc_feature: GYAE6OF01BKFA3.18.11.A11.1.454.CMB.1.raw
  modified_base (208)..(208): a, c, t, g, unknown or other
  misc_feature (208)..(208): n is a, c, g, or t
  modified_base (324)..(324): a, c, t, g, unknown or other
  misc_feature (324)..(324): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttanacagctccaacaataacaactacttagcttggtaccagcagaaaccaggacagccccctaaggtcctcattactgggcatcgtacccgggagtccggggtccctgaccgattcagnggcagcgggtctgggacagattcactctcacatccacaacctgcagctgaagatgtgctagtttacttactgtacagtactaatacttatacgtccctcctctcgtacggttcgcgggaaggaccaagggtggaagataacgaaacgtactggtcggactgacctacccagttacctcgttccttactacttccccgttaccccgacctaagttcctgaacccttaacg

SEQ ID NO: 52084 - DNA, 720 bp, Homo sapiens
  misc_feature: GYAE6OF01A7R7G.18.11.A11.1.454.CMB.1.raw
  modified_base (300)..(300): a, c, t, g, unknown or other
  misc_feature (300)..(300): n is a, c, g, or t
tcagtacgagtatgcacgaccggtgctcgatttagctacgactgcaggggcagcaagatggtgttgcagacccaggtcttcatttctctgttgctctggatctctggtgccggacggggacatcgtgatgacccagtcctccagactccctggttgtgtctcgtgggcgagacgggccaccatcaactgcaagtccagccagagttgttttatacagtctaccaaacaataaaccaacttacttagtcttcggtaccagcaagaaaccaggacacgacccccgtaagtcctcatttacgngggcactccgtacccgggacgtcccggggtccctgacccgtattcgaggacggcaggcggtcgtgggacaggtactttccacgtctccgaaccactacccaacccgaacctcgacgtacggcctaggaaacggtattgggtgggtaccttaacggtttttaacttaccgttaggtaccgtaagtaacctaaattaaccgtttaacgtaaccgttccccttaccctttcccgttaccgttaacccgggtttccggggaccggggtaaacgggtaaccggtaagggttacggaaggtaccttaacggaaaaccgtaccgtagggccggtacggtcgaccgaacccgtcgttcccgtaggtttcccttaccgtacgtttcccccgttacccgtaccctaacgttccctacgtaacttaacccg

SEQ ID NO: 52085 - DNA, 731 bp, Homo sapiens
  misc_feature: GYAE6OF01DPNUK.18.11.A11.1.454.CMB.1.raw
  modified_base (215)..(215): a, c, t, g, unknown or other
  misc_feature (215)..(215): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatcgacccagtctccagacctccctggttgtgtctcgtgggcgagacgggccaccatcaactgcaacgtccagccagtagttgttttanacagctaccaaacaaataacaactacttagcttgtacagacaacgaaaccacggacacgaccccctaacgtcctactattacgtcggactacgtccgtacccgggacggttcccggggtcctcgaccgattcgagtaggcgagtccggtcgtaggacagtactttcactctaccacctactaccaaccaaccgtcgactaggaccttagaagttagtcgggttacggactttaacggtttatttaaccgtgttacgaagtaccttaaaattactttaacgttaaccgtttcccctacggtttccctaccggttaacggggttaccgggtaccggggtaacgggtaacccggtaagggtacgggaaacgtaacgtaaccggtaaaccggtagttaccgggtcggtacctaccggtaaccgtaacccgtacgtttacccgtacggtttttaccttcccgttaaaccttccccgtttacccccggaccttaaactttccgttaacggaacccttaaccg

SEQ ID NO: 52086 - DNA, 534 bp, Homo sapiens
  misc_feature: GYAE6OF01BEEFD.18.11.A11.1.454.CMB.1.raw
  modified_base (398)..(398): a, c, t, g, unknown or other
  misc_feature (398)..(398): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacacgccccctaaggtcctcatttactgggcatccgtacccggggagtccggggtccctggaccgattcgaggacggcaggccgggtcgtcgggacagtatttcactctcaccatccaccaacctgcaggctagaagatgngtctagtttatactgtcagcaatactatacgtcctcctctctacggtcggcggaggaccaagggtcgaagactacgaaacgtactggtcgctgaccacgactctcgtcttcacttccctcccgctatcctgactac

SEQ ID NO: 52087 - DNA, 867 bp, Homo sapiens
  misc_feature: GYAE6OF01A70ZU.18.11.A11.1.454.CMB.1.raw
  modified_base (278)..(278): a, c, t, g, unknown or other
  misc_feature (278)..(278): n is a, c, g, or t
tcagtacgagtatgcacgaccggtgctcgatttagctacgactgcaggggcagcaagatggtgttgccagacccaggtctttcagtttcttctgttgctctggagtctctagtgccgacgggacatccgtgagtgtacccgagtctcagtacgtcccttggttgtggtcttacgttagggcgtacgagggtcctaccgagtcaacgtgctaagtccgagccgtaggagttcgttttagacagtccgtacggaacataacgactacttagcttggtacngacacgtaaccgtaggactacgaccccttaaggtcctactacttacgtgggactacgtccggtacccgggcgtaccggggtcctcggacggtagttccgaggacggtcgaggtccggtacgttgggtaccgtaggttagtttccggaacgttcgtaccgaccgtaacgttacctaacccgaaaccttcggacccgtacggtacgtacggtaacgggtacttacggtaggtacccttagtttaacttacgttaccgtacaacggtaacaaaacgtttcttaagttaccggttacctttacccggtacttacccggtaacggtttacccggggtaacggtaacccgggggtaactaacggggttaaccgggaagtaaaccccgggttaaccgtaaaacccggggtaacccggttttacggggttaaccggttaccccgttttagggtaacccccgttaaaacccgttacggggtttaaccctttcggggttaccccgtttaaaccgtaaccgggttttacccccgttacccccgggttacccctaaaacgttttccccggttacggttaaaccgggttttaaacccccggg

SEQ ID NO: 52088 - DNA, 748 bp, Homo sapiens
  misc_feature: GYAE6OF01CD59O.18.11.A11.1.454.CMB.1.raw
tcagtacgagtatgcacgaccggtgctcgatttagctacgactgcgaggggccaagcaacgatggtgttgccagacccaggtcttcatttcctctgttgctctggatctctggtgccgacgggacagtcgtgatcgacccagtcctccagacctcccgttggttgtcgtctcgtgggacgaggacgggcccaccataccgaacgtgaccaagtccgagtccaggtagttgttttacacgacgtcctaccaaactaactaacctaacttaacgttagtccgtttaggtaccagacaacggaaaccgacggaaccaaccgtaccccccgttaaggtcccttacgtaacgtttaccgtcgggacctacgttacccggtaaccccggggtacggttccccggggtaccctacggacccgtagtttaccgaggtacggacgaacggtcggtacgtacggactacgtactttccgaactcgacacctactaccaaccaacgtcgacgaggtacgtagagtacgtacggtcgacttaacgtttataccgtagtacgagtaactaacgttactaagttacccgttcctacctcgtaccgtaccggttcgggacggacggtaacgtagggtacgtacgtaactaaccgtaaacgacgttggtacgtccgtaacgacctacccggtaagttcccttacggttccctacgtacgtttcccccgtaccgtacctaagtttccgtaaggtcctaaacccgg

SEQ ID NO: 52089 - DNA, 832 bp, Homo sapiens
  misc_feature: GYAE6OF01BMTND.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtgccgacgggacatcgtgatcgacccagtctccagacctcccgtggtgtgtctcgtgggcgaggacggcccaccatacaacgtgacaacgtccagccagtagttgttttaacacacgcctaccaaacaactaaccaacttactagtcgttcggtaacccagaccaaacgaaacccgtaggaccaccgtacccccgttaaggtccctacgtacgtttacggcggtactaccgtaccgggtaacccgggacggtttccccgggtaccctaggtaacccgtagttaccggaaggacggacgtacggggtccgggttacgaggggaaccttaggttactttaccgaccgttacctacccaaccgtacctaacccgaacccgtaccgtacggaccgaacggttacctaagggtaaagtccggttacggtaccggttaacgtttaacgttttacgttaccgtagtaccgtaaacgttaacctaaacgtttaacctacgtttaacccggtcccctttacccgtaccggttaaccggtaccgggttaccggggacgggtaaaccggtaaccggtaagggtaccgtaaagtacgtaaacccgtaaacggttcggtacggtccgggtacctacggtaacccctaccgttcgttacgttaccgttcccggtacttacccccgttaccccggtttacccgaacctttaccgtaaccgtacccttaacggttacccgg

SEQ ID NO: 52090 - DNA, 664 bp, Homo sapiens
  misc_feature: GYAE6OF01EPIS4.18.11.A11.1.454.CMB.1.raw
  modified_base (216)..(216): a, c, t, g, unknown or other
  misc_feature (216)..(216): n is a, c, g, or t
  modified_base (571)..(571): a, c, t, g, unknown or other
  misc_feature (571)..(571): n is a, c, g, or t
tcagtacgagtatgcacgaccggtgctcgatttagctacgactgcagggggcagcaagatggtgttgcagacccaggtcttcatttctctgttgctctggatctctggtgccgacgggacatcgtgatcgacccagtctccagtacctccctggttgtgtctcgtgggcgagacgggccaccatcaactgcaagtccagccagtagttgttttaanacagcctaccaaacaataacaactacttagcgttggaccagcaagaaccaggacacgacccccgtaagtcctctatttacgtggctactaccgtacccggggacggttcccggggtccctacggacccgtattcgagacgcgacggcggtcgtgggactagtacttacactctaccactactaccaaccctaaccgtgaccgacggctaaggaagtagttcgggtacggtaccttaagttttacttacgtcgtaccgagtactaactttagttttacggtaccttaccgtactaccgtacccgtccgtaaccgaacgggtaacaacggtacgtaagggtaaataaacgttaaaanacgttgggtacggacgttacgacctactacgtcgttagttcctacctcgtttaccccgtcccgttactaacttcgtactaacttcgttacccg

SEQ ID NO: 52091 - DNA, 554 bp, Homo sapiens
  misc_feature: GYAE6OF01CPGCE.18.11.A11.1.454.CMB.1.raw
  modified_base (208)..(208): a, c, t, g, unknown or other
  misc_feature (208)..(208): n is a, c, g, or t
  modified_base (220)..(220): a, c, t, g, unknown or other
  misc_feature (220)..(220): n is a, c, g, or t
  modified_base (389)..(389): a, c, t, g, unknown or other
  misc_feature (389)..(389): n is a, c, g, or t
  modified_base (507)..(507): a, c, t, g, unknown or other
  misc_feature (507)..(507): n is a, c, g, or t
  modified_base (545)..(545): a, c, t, g, unknown or other
  misc_feature (545)..(545): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttanacagctaccaanaataacaactacttagcttggtaccagcagaaaccaggacacgccccctaaggtcctcatttactgggcatccgtacccgggagtcccggggtccctgaccgattcagaggcaggcgggtctgggacagtatttcactctcaccatccaccaactgcaggtctagaagntgtggtctagttttattcgtagtcagtcaattactatacgtcctcctctcgacgttcgggcggaacgggacctaaggtggaagactacgaaacgtacgtggtacggctcgacaccgtnttactcggttcctactactcccttaccccgctattccngaacttacg

SEQ ID NO: 52092 - DNA, 818 bp, Homo sapiens
  misc_feature: GYAE6OF01DPLZX.18.11.A11.1.454.CMB.1.raw
  modified_base (213)..(213): a, c, t, g, unknown or other
  misc_feature (213)..(213): n is a, c, g, or t
tcagtacgagtatgcacgaccggtgctcgatttagctacgactgcaggggcagcaagatggtgttgcagacccaggtcttcatttctctgttgctctggatctctggtgccggacggggacatcgtgatgacccagtcctccagacctccctggttgtgtctcgtgggcgagagggccaccatcaactgcaagtccagccagtagtgttttanacagctaccaaacaataacaactacttagcttaggtaccaagcagaaaaccaggaaccacgtacccccgtaaaggtccctatactttaacgtggggcctaacgtaccgtaaccccgggggtaacggttccccgggggtaccctacggaaccggtactttcgaaggaacgggcgaacggccgggtacgtggggaaccaaggtactttaccaaccttacctaccaacccaatacccaacccctaaaccgtgacccgaaggtaccttaagaaaacggtagttaccgggtagggtaccttaaaggtttttacttaaccgttagtacctaagaacccaaagtttaaccgtaattaccgttccccttaccgttccgttacccgtaaccgggtttacgggaccgggtaaaacgggggtacccgtaaaacggggttaggaacggtaaacttaaccgaaaaccggggtttaaacgtcggtttacggggacctaaccgggttacccaaaccctaacgttttaccggttccggttttaacctttaacccgtaccgtttaaccccgttcccccggtaaaccccttatttaaacccgtccgtaaaccgttaaaacccg

SEQ ID NO: 52093 - DNA, 651 bp, Homo sapiens
  misc_feature: GYAE6OF01DUR98.18.11.A11.1.454.CMB.1.raw
  modified_base (217)..(217): a, c, t, g, unknown or other
  misc_feature (217)..(217): n is a, c, g, or t
  modified_base (306)..(306): a, c, t, g, unknown or other
  misc_feature (306)..(306): n is a, c, g, or t
  modified_base (602)..(602): a, c, t, g, unknown or other
  misc_feature (602)..(602): n is a, c, g, or t
tcagtacgagtatgcacgaccggtgctcgatttagctacgactgcaggggcagcaagatggtgttgcagacccaggtcttcatttctctgttgctctggatctctggtgccggacggggacatcgtgatcgacccagtcctccagaccttccctggttgtgtctcgtgggcgaggacgggccaccatcaactgcaagtccagccagtagttgtttanacagctaccaacaataaccaactacttagcttacggtaccagacaacgaaaccaggaccacgtacccctaaggtcctactactttacgngggactacgtccgtacccggggacggtcccgggggtccctcggaaccgtacttacgaggaggcgtacgggcgggtacgtgggaactacggtactttccactacctacacctaactccaacctaaccgtgacctaggcctaggaagtacgttcggtacggtacttaagttttaactacgttcgtactaagacctaatactatactccctctcgtcgtaccggttcgggacgggtaaggacccgaagggtggaacgtactaacgtaacgtacgtcggtacggctacgacctaaccgtnttccgtagttccttactcttccccttccgaccttatccgtagtctaacg

SEQ ID NO: 52094 - DNA, 591 bp, Homo sapiens
  misc_feature: GYAE6OF01BIRQY.18.11.A11.1.454.CMB.1.raw
  modified_base (553)..(553): a, c, t, g, unknown or other
  misc_feature (553)..(553): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagtagttgtttttatacagctaccaaacaataaacaactacttagcttggtaccagcaagaaaccaggacacgccccctaaggtcctactatttacgtgggacactaccgtaccccggggacggtcccgggggtccctcggaccgtattacgaggacggcgaggcgggtcgtagggacagtattcactctcacataccaccaactgacaggcgtagaagatggtacggtactagttttactacttcgtacagtactaaatacttattaccgttcccctacttctccgtaccggttcgggcgggtaacggacgaagggtgaagtacgtaacaacggtactggtacgctcgaccacctntctcttctctacttcctaccccgctacttctgacctac

SEQ ID NO: 52095 - DNA, 639 bp, Homo sapiens
  misc_feature: GYAE6OF01C3O87.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtgccggacggggacatcgtgatgacccagtctccagactcccgtggttgtgtctcgtgggcgaggacgggcccaccataccaactgcaacgtccagccagtagttgtttatacacgcctaccaaacaaactaacaacttacttagcgttaggtaccagacaacgaacacggacaccgacccctaaggtcctctattacgtggactacgtaccggtaccgggtaccggttcccggggtccctacggaccgtacttcgacggacggcgacgggtccgggtcggtacgggacgtacgtactttcgactctaccacctactaccacctactgacgacggtcgtagagtatggtcgtagtagtttactcgtagtacagtactaatacttatactccctctccgtacttacgggtccggacgggtacggaccgtagggacgggaactaacgtacgaacggtaccgtaggtcgtaccacgacctaaccgtcttcgtacgttcttccgtactcccctcccgactctacctagtacctacg

SEQ ID NO: 52096 - DNA, 689 bp, Homo sapiens
  misc_feature: GYAE6OF01AY6K6.18.11.A11.1.454.CMB.1.raw
  modified_base (451)..(451): a, c, t, g, unknown or other
  misc_feature (451)..(451): n is a, c, g, or t
  modified_base (481)..(481): a, c, t, g, unknown or other
  misc_feature (481)..(481): n is a, c, g, or t
tcagtacgagtatgcacgaccggtgctcgatttagctacgactgcaggggcagcaagatggtgttgcagacccaggtcttcatttctctgttgctctggatctctggtgccggacggggacagtcgtgatcgaccccagtcctccagacctccctggttgtgtctcgtgggcgaggacgggcccacatacaactgacaagtccgagccgagtagttgttttatacacgtcctaccaaacaaataactaactacttagcttaggaccagacaacgaaaccgacggaccacgaccccctaggtcctactacttacgcggcacgtccgtaccgggcggtcccgggtccctacgaccgtagtcgacgacggcgaggccgggtacgcggactagtacttcgtacgtctaccgaacctactaccaaccgtacgtcgaccgtaggtacgtagtaacgngttacggtgtaaccttagttttactacgtntaccgacgtactaacgtacttacgtaccgtacccttccgtaccgtccttacggggttacccgggacggaaccggtaccggaaggtcggaagtactaacgaaccgtacgtggaccggtactccggacctaaccgtcgttaccgttcggttccctacggtacccttaccccggtttccccacttaacccgtcgtaaaccgtccgttaacg

SEQ ID NO: 52097 - DNA, 623 bp, Homo sapiens
  misc_feature: GYAE6OF01EGC64.18.11.A11.1.454.CMB.1.raw
  modified_base (212)..(212): a, c, t, g, unknown or other
  misc_feature (212)..(212): n is a, c, g, or t
  modified_base (391)..(391): a, c, t, g, unknown or other
  misc_feature (391)..(391): n is a, c, g, or t
  modified_base (441)..(441): a, c, t, g, unknown or other
  misc_feature (441)..(441): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgaggagggcccaccatcaactgcaagtccagccagagtgtttttaanacagctaccaaacaataacaactacttagcttaggaccagacaagaaaccaggaaccacgacccccttaaaggtcctactaacttttacgtcgggcctaacgttccgtaaccccgggggtacggttcccgggggttcccctcggtacccgtagtttccgaggtacggcaggcgggtcgngggacaggtactttcactctacaccactacaccaactgcaggctagaagntgtgtctagtttactactgcagtacaactactatacgtccctctctcgtacggtcggcgggtacgggaacctaggtagggactacgtaacgaaacgtacgttggacgtcgtcgaccgtacctagttccgtgttcccttaccacgttccccttacccgacctaattcccttagaccttaaccg

SEQ ID NO: 52098 - DNA, 659 bp, Homo sapiens
  misc_feature: GYAE6OF01CPTDB.18.11.A11.1.454.CMB.1.raw
  modified_base (221)..(221): a, c, t, g, unknown or other
  misc_feature (221)..(221): n is a, c, g, or t
  modified_base (648)..(648): a, c, t, g, unknown or other
  misc_feature (648)..(648): n is a, c, g, or t
tcagtacgagtatgcacgaccggtgctcgatttagctacgactgcaggggcagcaagatggtgttgcagacccaggtcttcatttctctgttgctctggatctctggtcgccggacggggacatcgtgatcgacccagtctccagacctcccgtggttgtgtctcgtgggcgaggacgggccaccataccaactgactaagccagccagtagttgtttaanacacacctaccaaacaaactaacaacttacttagcttaggaccagacaacgaaaccgaggacaaccgacccccgttaaggtccctactaagtttacgcgggactacgtaccgtacccggggtacgtcccgggtcccagacctatcgagacggcaggtccgggtagtacgggactaggtactttccgaacttcaccaaccactaccaacccaaccgtgaccaagggtctaaggaacgtatcggtagacctttagttattactagctaagactaaataccgttaattaccgccttccaccgtccgtaagggttccgggacgggaacggaaccgtaagggtcgaaacacgtaaaccgaaacgtacggtcgacggtccacgaccgtaaccttagtcctacgttcactccctacccgttcccactacttcgngtacctaaccg

SEQ ID NO: 52099 - DNA, 675 bp, Homo sapiens
  misc_feature: GYAE6OF01CPOLP.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtgccggacggggacatcgtgatcgacccagtcctccagaccttccctggttgtgtctcgtggggcgaggacgggccaccataccaactgacaagtccagccagtagttgttttaactacagtcctaccaaactaaataaacctaaacttacttacgctttggaaccagacaacgaaaaccaggaaccaccgaccccctaacggtcctactactttacgtcgggcacgtccgtacccggggacgtcccggggtccctacgaccgtatcgaggacggcgaggcgggtcgtggactacgtcttcactcctaccaccaagtaaccacgtcgacgagctagaagtatggtacgtactagtttatactgtacagtactaatactatcgtccctccgtactaccgtcggttcggaccgggtacgggaacgtaagggtacggaacgtacgtaaccgaaacgtacggttgtacggtacgtcgaaccctaccgttacgttccgttacggttcctttcgtaacccgttcccgttacccccgtaccttacgttcccgttaacgtaaccgttcgtaacccg

SEQ ID NO: 52100 - DNA, 748 bp, Homo sapiens
  misc_feature: GYAE6OF01BKOBO.18.11.A11.1.454.CMB.1.raw
  modified_base (222)..(222): a, c, t, g, unknown or other
  misc_feature (222)..(222): n is a, c, g, or t
tcagtacgagtatgcacgaccggtgctcgatttagctacgactgcaggggcagcaagatggtgttgcagacccaggtcttcatttctctgttgctctggatctctggtgccggacggggacatcgtgatcgacccagtcctccagacctccctggttgtgtctcgtgggcgaggacgggcccaccatccaactgaccaagtccagccagtagttagttttanacacgctaccaaacaactaacctaacctacttagtaccgttacggtaaccagacaacgaaaccgacggaaccaccgacccccgttaaggtccctactaattacggtacgggacctacgtcccggtaaccccggggtacggttccccggggtaccctcggaccgtattacgaacggagggtacgacgggtcggttacgtacgggacgtacgttactttccgaccttcctaccctaaccgtactacccaacccgtaccgtacgacgtacggacgtaaggtaacgtacgtaggtacggtaactttaagttttaacgtcgttaacggtacgtaagtaacttaaacgtacttaacgttaccttcccgttacctccgttacgtaccgggttaccggacgggtaacggtaccggtaagggtagtacgtaacgtacgaaacccggtagtaccggtgaccgtacgaccctaccgtattcccgtgttacccttaccgtccctacccttcccacttatacccgtagtccttaacccg

SEQ ID NO: 52101 - DNA, 714 bp, Homo sapiens
  misc_feature: GYAE6OF01EVTXO.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtgccggacggggacatcgtgatgacccagtctccagacctccctggttgtgtctcgtgggcgagacgggccaccatcaactgcaagtccagccagagttgttttatacacgcctaccaaacaaataaactaacttacttagtcttacggtaccagacaacgaaaaccgacggaaccaccgaccccctaacggtcctactactttacgtcggactactccgtacccggggacggttcccggggtccctcggaccgtactcgaggacggcgacgggtcgggtcgtacgggacagtacttcactcctacaacctactacccaacctaaccgtcgacgacggtacgtagaagtacgttggtacggtacctttaatttttaattaccggttagtaccaagtacctaaaagttaccttacgttaccgttccccttccctacgttaccggtaccgggttcggggacgggaaccgggtaaccgtaagggtggaacgtaacttaaccgaaacggtacgttgggtaccggctacgggaccctaacgtaccgttaccgttcgttcccttacccgtacctttccccgttaccccactacttcctaaggtaccttaaccg

SEQ ID NO: 52102 - DNA, 879 bp, Homo sapiens
  misc_feature: GYAE6OF01BSDBM.18.11.A11.1.454.CMB.1.raw
tcagtacgagtatgcacgaccggtgctcgatttagctacgactgcaggggcagcaagatggtgttgcagacccaggtcttcatttctctgttgctctggatctcgtggtgccggacggggacatcgtgatcgacccagtcctccagacctcccgtggttgtgtctcgtgggcgaggacggcccaccatacaactgacaacgtccagccagtagttagttttaacacacgacctaaccaaactaaactaaaccaacttacgttagtacttacggtaaccagaccgaaacgaaaccgacggaaccaaccgtacccccgttaacggtcctacttaacgtttaccggtacgggacctacgttacccggtaacccggggtaccggttccccgggtaccctacggtaccggtacgttaccggacggtacgggaccgtacgggtccgggttacggtacgggaacgtaacggttaactttaccaccgttacccgtacccaacccgtacctaacccgaaccccgtaacccgtacggtaccggacggtaccgtaaggtaacggtacgtacggtacggttacgttaacgttttaacgtttacgttacgtacgtaacgaaccgttttttttttttaaacaaccgtttaacgttaccgttacccgttacccgtttaccgttacccggttaccgggttacccgggtaacggggtaaccgggtaaccgggtaacgggtaacgggtaacggtaaccgtaacggtaaaccggtaacggtacggtacggtaccgtaccgtaccgtaccgtacgttaccgttccgttaccgttacccttacccgtttacccgttaccccgtacccgttaccgttaccgttaccgtaaccgttaacccg

SEQ ID NO: 52103 - DNA, 798 bp, Homo sapiens
  misc_feature: GYAE6OF01CTUQ6.18.11.A11.1.454.CMB.1.raw
  modified_base (318)..(318): a, c, t, g, unknown or other
  misc_feature (318)..(318): n is a, c, g, or t
tcagtacgagtatgcacgaccggtgctcgatttagctacgactgcaggggcagcaagatggtgttgcagacccaggtcttcatttctctgttgctctggatctctggtgccggacggggacatcgtgatcgacccagtctccagacctcccgtggttgtgtctcgtgggcgaggacgggcccaccatacaactgacaacgtccagccagtagttgttttaacacagtcctaaccaaactaaactaaactaacttacttagtcgttacggaaccagacaacgaaaccaggacaccgtacccctaagtcctatattacgnggacacgtccgtaccgggtacggtcccgggtcctacgtaccgtataccgaggacggcgagggtcggtcgtaggactagtactttaccaacctccgtaccaaccgactacccaaacctaaccgtgaccggtaaggcgtaagaagacgtggtacgtacgtttagttttaacgttaccgtagttaaccaagtaaccttaaaatttacccgttaattaccccgttccccttacccttaccgttaccgggttaacccgggtttaccgggggaacccggggtaaacggggaacccgggttaaaggggaacggtaaacgtaaaccgtaaaccggaaaaccggttaccggttacggggtacgtacgtacccggtaaccctaaacccggtttaacttccggtttaccctttaccgtttaccccttaacccgtttacccccgtacccccgtaaccgttacgttaccgtaaccggttaacccttaaaccgg

SEQ ID NO: 52104 - DNA, 817 bp, Homo sapiens
  misc_feature: GYAE6OF01CXI4H.18.11.A11.1.454.CMB.1.raw
  modified_base (208)..(208): a, c, t, g, unknown or other
  misc_feature (208)..(208): n is a, c, g, or t
  modified_base (211)..(211): a, c, t, g, unknown or other
  misc_feature (211)..(211): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctcgtgggcgagaggccaccatcaactgcaagtccagccagagtgttttanacngctaccaacaataacaactacttagcttaggtaccagacaacgaaaccgaggacacgccccctaaggtcctcacttacgtgggcacgtccgtacccgggaggtccccggggtccctcgaccgtattacgaggtacggcgaacggcggggtcgtacgggacaacggtactttccgaaccttcctaccgaaccctacgttaccccaaaccctaaacccgttgaccgtacggtaccgttaggaaacggtacgttacgggtacggtaccgttttaaacgggttttttaactttccgttaggttaccgaacgttaccgttaaggttttaacttaaggtttacggtaaaccttttaccggggttacgggttacccgggtttacccggggaaccgtaaaacggggaaccccgttaaacggggtacggaaacgggttaacgttaacccggtaaaaacgggtacgttacggggttacgggtaaccgttaccgggaacctaaccccgttacgtttacccgttaccggttttaacctttcccggttaacctttacccccgttcccccggtaccttaaaccgtttcccgtaacgtaaccgttaacctttaaccccggg

SEQ ID NO: 52105 - DNA, 722 bp, Homo sapiens
  misc_feature: GYAE6OF01EZZWF.18.11.A11.1.454.CMB.1.raw
  modified_base (482)..(482): a, c, t, g, unknown or other
  misc_feature (482)..(482): n is a, c, g, or t
tcagtacgagtatgcacgaccggtgctcgatttagctacgactgcaggggcagcaagatggtgttgcagacccaggtcttcatttctctgttgctctggatctctggtgccggacggggacatcgtgatcgacccagtctcacgactcccgtggttgtgtctcgtgggcgaggacggccaccatcaactgacaacgtccagccaagtagtttagtttttaactaacacgtacctaaccaaaactaaaactaaaacctaaccttaacgttacgtccgtttacggtaaccagacaaacgaaaccgaggaaccaccgacccccttaaggtcctactaacgttacgtcggactacgtaccggtaccggggacggtcccggggtaccctggaccgtactacgaggacgcgtacggcggtcgtaggactagtactttaccacgtacctaccaaccataccacctaacgtcgacgtaggactagaagtntggtcggtacttagtttactacgtcgtacaagtactaaactactaacttaccgtccttacccgtacttaccggttaaccggttcggggaaccgggtaacgggtaaccgaagggtacggtaacggtaactaacggtaaaccgtagtacggtcgactccgaacctaaccgtacgttcgttacggtactttaccgaaccgtttcccgtaccccgtaccgtaacttcgtaacgaacgttaaccg

SEQ ID NO: 52106 - DNA, 582 bp, Homo sapiens
  misc_feature: GYAE6OF01BV4OB.18.11.A11.1.454.CMB.1.raw
  modified_base (209)..(209): a, c, t, g, unknown or other
  misc_feature (209)..(209): n is a, c, g, or t
  modified_base (284)..(284): a, c, t, g, unknown or other
  misc_feature (284)..(284): n is a, c, g, or t
  modified_base (345)..(345): a, c, t, g, unknown or other
  misc_feature (345)..(345): n is a, c, g, or t
  modified_base (505)..(505): a, c, t, g, unknown or other
  misc_feature (505)..(505): n is a, c, g, or t
  modified_base (528)..(528): a, c, t, g, unknown or other
  misc_feature (528)..(528): n is a, c, g, or t
  modified_base (535)..(535): a, c, t, g, unknown or other
  misc_feature (535)..(535): n is a, c, g, or t
  modified_base (573)..(573): a, c, t, g, unknown or other
  misc_feature (573)..(573): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagttgttttanacagcctaccaaacaataacaactacttagcttggtaccagcaagaaaccaggacaccgaccccctaaggtcctntactttacgtgggcactccgtacccggggtcggtcccggggtccctggaccgtattcgagnggcgaggcgggtcgtgggacagtattcactctcaccatccaacccaactcgacgacggcgtagaagtagtggtaggcttaagtttattactgtcagactaatactatacgtccctctctcctacggttccgggacggagggaccgtaaggtggaagtaanaccgaaacgacgttggacgcgtnaccgctntcttgttccttcctacttcccgttcccacctatccgtnaccttaccg

SEQ ID NO: 52107 - DNA, 600 bp, Homo sapiens
  misc_feature: GYAE6OF01D3493.18.11.A11.1.454.CMB.1.raw
  modified_base (211)..(211): a, c, t, g, unknown or other
  misc_feature (211)..(211): n is a, c, g, or t
  modified_base (284)..(284): a, c, t, g, unknown or other
  misc_feature (284)..(284): n is a, c, g, or t
  modified_base (291)..(291): a, c, t, g, unknown or other
  misc_feature (291)..(291): n is a, c, g, or t
  modified_base (351)..(351): a, c, t, g, unknown or other
  misc_feature (351)..(351): n is a, c, g, or t
  modified_base (369)..(369): a, c, t, g, unknown or other
  misc_feature (369)..(369): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctcgtgggcgagagggccaccatcaactgacaagtccagccagagttgttttanacagctaccaaacaataacaactacttagcttagtaccagcaagaaaccaggacacgccccctaaggtcctanatttacngggcatccgtacccgggagtcccggggtccctgacccgattccagaggcaggcgggtcgngggacagtatttcactcncaccatccaaccactgcaggctagaagatggtggctaagttttatactgtacagactaatacctatacgtcccttcctctctacggttcggcggaagggaccagggtggatactacgaaacgtactggtcggactcgacctacccgtaattccgttacgttccctttacgtaacctttccccccgtttaccccggacccttaacttcccgttaccggaaactttaaccccg

SEQ ID NO: 52108 - DNA, 648 bp, Homo sapiens
  misc_feature: GYAE6OF01DZ1HN.18.11.A11.1.454.CMB.1.raw
  modified_base (212)..(212): a, c, t, g, unknown or other
  misc_feature (212)..(212): n is a, c, g, or t
  modified_base (294)..(294): a, c, t, g, unknown or other
  misc_feature (294)..(294): n is a, c, g, or t
tcagtacgagtatgcacgaccggtgctcgatttagctacgactgcaggggcagcaagatggtgttgcagacccaggtcttcatttctctgttgctctggatctctggtgccggacggggacatcgtgatgacccagtctccagacctccctggttgtgtctcgtgggcgagagggccacatcaactgcaagtccagccagtagttgttttanacagcctaccaaacaataacaactacttagcttggtaccagacaagaaaccaggacacgcccctaaggtcctacatttacgnggcactccgtacccggggaggtcccgggtcctgaccgtattcgagagcaggtcgggtcgtagggacagtctttccgacttccgtaccacctactccaacctaaccgtgaccgaggctaggaagtagtggtagacttaagtttactacgtagtacaagtactaagttactagttaccgtccctaccttccgttacgtacggttaccgggacggtaacgggaccgtaagggtacgtaagactacgaaacggtgtcgtaggtccacggtaccaaccgttacgtccgttacggtttccttaccgttacccgttccccgttacccccggacttacgttacccgtacctacgttaaaccg

SEQ ID NO: 52109 - DNA, 629 bp, Homo sapiens
  misc_feature: GYAE6OF01DZ8JV.18.11.A11.1.454.CMB.1.raw
  modified_base (210)..(210): a, c, t, g, unknown or other
  misc_feature (210)..(210): n is a, c, g, or t
  modified_base (539)..(539): a, c, t, g, unknown or other
  misc_feature (539)..(539): n is a, c, g, or t
tcagtacgagtatgcacgaccggtgctcgatttagctacgactgcaggggcagcaagatggtgttgcagacccaggtcttcatttctctgttgctctggatctctggtgccggacggggacatcgtgatgacccagtctccagacctccctggttgtgtctctgggcgagaggccaccatcaactgcaagtccagccagagttgttttanacagcctaccaaacaataaccaactacttagcttggtaccagcaagaaaccgaggacacgacccccctaaaggtcctactactttacgtgggccagttccgtaaccccggggaggttccccggggtccctgaacccggattacgaggaggcaggcgggtcgtgggacagtacttcacctctaccaccataccaacccgaacctgcgaggactagaaagtgtggtggacctaagttttacttacgtgtcaagtactaacttactaattccgttccctaccgttcctacgtaccggttcgggacggaacgggaccgtaaagggtgacgtanaacgaaacgtacgtgtacgtactcgtaccaccgttataccgttggttccttacgacttcccgtacccctacccattccgtagtactaacg

SEQ ID NO: 52110 - DNA, 824 bp, Homo sapiens
  misc_feature: GYAE6OF01B4T04.18.11.A11.1.454.CMB.1.raw
  modified_base (218)..(218): a, c, t, g, unknown or other
  misc_feature (218)..(218): n is a, c, g, or t
  modified_base (232)..(232): a, c, t, g, unknown or other
  misc_feature (232)..(232): n is a, c, g, or t
tcagtacgagtatgcacgaccggtgctcgatttagctacgactgcaggggcagcaagatggtgttgcagacccaggtcttcatttctctgttgctctggatctctggtgccggacggggacatcggtgatcgacccagtcctccagacctccctggttgtgtctcgtgggcgagacgggccacatacaactgacaacgtccagccagtagttgtttanacagcctaccaaanaaactaacaacttactacgtcgttacggtaccagaccaaacgaaaccacggaaccaccgtaccccgtaaggtccctactaacgtttacggacgggactaaccgtcccgggtaacccggggtacgggttccccggggtacccctacggtacccgtaattccggaagggtacgggaccggtagggtcccggggtacgttacggggaacttacggtactttaccaaccgtcctaccaacctactacccaaccgtaaccgtgaccggaacggtctaaggaaggtacgtggtacgtacgttaacgttttactacgtagtaaccgacgtaactaaacttactaccgttaaccgttccccttaccgttaccgtaccggggttaaccgggttacggggaacccgggggtaaaccgggtaacccgggttaaagggggtacgtaaaccggtaaccgtaaaacccggtaaacggtaacgggttacgggtacggtacccttacgggtaaccccaaccggtttaccttcggttaccggtttcccctacggttaacccttcccccgtacggtaacccctagtttcccgtaagtaacccgttaaccg

SEQ ID NO: 52111 - DNA, 679 bp, Homo sapiens
  misc_feature: GYAE6OF01EGWA2.18.11.A11.1.454.CMB.1.raw
  modified_base (217)..(217): a, c, t, g, unknown or other
  misc_feature (217)..(217): n is a, c, g, or t
  modified_base (311)..(311): a, c, t, g, unknown or other
  misc_feature (311)..(311): n is a, c, g, or t
tcagtacgagtatgcacgaccggtgctcgatttagctacgactgcaggggcagcaagatggtgttgcagacccaggtcttcatttctctgttgctctggatctctggtgccggacggggacatcgtgatgacccagtctccagactccctggttgtgtctcgtgggcgaggacgggccaccatcaactgcaacgtccagccagtagttgtttttaanacagcctaccaaacaaataaaccaacttacttagtcttacggtaaccagacaagaaaccaggaccacgaccccctaaggtcctactatttacgnggactactccgtacccggggacggttcccggggtccctcgaccgtattccgaggacggcagggcgggtcgtagggacagtactttccgactcctaccaacctactaccaaccctaacctacgaccacgggtactaacggaaggtattcgggtacggtaacctttaagtttttaacgttacgtacgtacaagtacttaaacttaccttagttacccgttccctccttcgtaccgttaccgggttcgggaacggaccgggtaaccgaagggtgggtaactaactaccgaaacggtacgtggtacggctacgaccctaccgtagttccttacgttctaccgcttcccttcccgactattcacgacgttacc

SEQ ID NO: 52112 - DNA, 701 bp, Homo sapiens
  misc_feature: GYAE6OF01EZ9NY.18.11.A11.1.454.CMB.1.raw
  modified_base (292)..(292): a, c, t, g, unknown or other
  misc_feature (292)..(292): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctcgtgggcgagacgggcccaccatcaactgcaagtccagccagagttgttttatacagctaccaacaataacaacttacttagcttgtaccagacaagaaaccaggacaccgacccctaaggtcctcatttacnggcatccgtaccgggagtccggggtcctcgaccgtatcgagaggcaggtcgggtacgtgggactagtactttcgactcctacgacctactcccaacctaaccgtcgacgacggtctacggaagtacgttggtacggtaccttaagttttacttaccttggtacctaagtactaacttaacgttacgttaccgttcccttcccttacctaccggttacccggtttacgggacgggtaacgggtaaccccgtaagggttcgggaaccgtaaacttaccggaaaaccgtacggttacggttacggtcctaacgcccgttaaaccctggtttacccgtacggtttaccccttaccgttacccttaccccgtttccccggtactaccttttccggtagaaacccctttaaaccg

SEQ ID NO: 52113 - DNA, 700 bp, Homo sapiens
  misc_feature: GYAE6OF01CBXNF.18.11.A11.1.454.CMB.1.raw
  modified_base (210)..(210): a, c, t, g, unknown or other
  misc_feature (210)..(210): n is a, c, g, or t
  modified_base (648)..(648): a, c, t, g, unknown or other
  misc_feature (648)..(648): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctcgtgggcgagaggccaccatcaactgcaagtccagccagagttgttttaanacagcctaccaaacaataacaactacttagcttggtaccagcaagaaaccgaggacacgccccctaaaggtcctactatttacgtgggcacgtaccgtacccggggtacggttcccggggtccctacggaccgtattccgaggaggtccaggtacgggtctaggggacaggtactttccgaacttccgtaccacctacgttacccaacccgtaacccgtggaccgaaggggtacctaggtaaacggtagttacgggttacggtacttaacgttttacgtttaccgttagtaccgtaacgtacgtaaacgttactttaacgtacgttccccttacccgttaccttacgtaccggtttccgggaccgggaacggggtaacccgtaagggtggaacgtactacgaaacgtacgtggtacggtaccgtagacgtaacccgtntccgtaggttccttctacgttcccttcccgacttagtttcgactagttaccg

SEQ ID NO: 52114 - DNA, 650 bp, Homo sapiens
  misc_feature: GYAE6OF01EN8OE.18.11.A11.1.454.CMB.1.raw
  modified_base (214)..(214): a, c, t, g, unknown or other
  misc_feature (214)..(214): n is a, c, g, or t
  modified_base (301)..(301): a, c, t, g, unknown or other
  misc_feature (301)..(301): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctcgtgggcgaggagggccaccatcaactgcaagtccagccagtagttgtttttaanacagctaccaaacaaataaacaactacttagctttaggtaccagcaacgaaaccaggacacgaccccctaaggtcctctatttacgnggcactccgtacccggggacgtcccggggtccctgaccgtattcgaggacgcgacggcgggtcgtagggacaggttactttccgaactccgtaccaccgtactaccaacccaaccgtgacctagggcctaggaacgtagttcggtcggtacttagttttaacttacgtgtacaagtactaaattacttacgttacttcccttacctccttcgtaccggttcgggacggtaacgggtaacccgagggtacggacgtaataccgaaacgtacgtggtagggacttcggaccacgtacgttcttcgttcctactacttccctttccccgactaactttcgacgtactaaccg

SEQ ID NO: 52115 - DNA, 685 bp, Homo sapiens
  misc_feature: GYAE6OF01CNX9V.18.11.A11.1.454.CMB.1.raw
  modified_base (492)..(492): a, c, t, g, unknown or other
  misc_feature (492)..(492): n is a, c, g, or t
  modified_base (509)..(509): a, c, t, g, unknown or other
  misc_feature (509)..(509): n is a, c, g, or t
  modified_base (534)..(534): a, c, t, g, unknown or other
  misc_feature (534)..(534): n is a, c, g, or t
  modified_base (599)..(599): a, c, t, g, unknown or other
  misc_feature (599)..(599): n is a, c, g, or t
  modified_base (671)..(671): a, c, t, g, unknown or other
  misc_feature (671)..(671): n is a, c, g, or t
tcagtacgagtatgcacgaccggtgctcgatttagctacgactgcaggggcagcaagatggtgttgcagacccaggtcttcatttctctgttgctctggatctctggtgccggacggggacatcgtgatcgaccccagtcctaccacgtacctcccgttggttgtcgtcctcgtggggcggaggacgggcccaaccataccaactgaccaacgtccacgccgaggtagtttacgttttaacaccacgtacctaaccaaactaaactaaacctaacttacgttaagtccgttacggaaccagaccaacgaaaccgacgaccgaccgacccccgttaacggtacctactacgttacgtcggacgaccgttaccgtacccggggtaccggtcccggttccgtacgaccgacttacgacgacggcgacggtcggtcgaggacgtacgtacttacacctcacctaccactaccacctaccgcgcgacggtcagacgngtacgcgtatagtttanactgtcacgtataactactacttcnccctcgtctacggtccggtccgggaaggtaccggtacgaggtagtacgactaacgaaggctcggngccttacgaccctactcgttacgttccgtacctttcgaccccgtttccgttcccccgacttacggttaaccncgaaccgttaaccg

SEQ ID NO: 52116 - DNA, 612 bp, Homo sapiens
  misc_feature: GYAE6OF01CTLIA.18.11.A11.1.454.CMB.1.raw
  modified_base (217)..(217): a, c, t, g, unknown or other
  misc_feature (217)..(217): n is a, c, g, or t
  modified_base (230)..(230): a, c, t, g, unknown or other
  misc_feature (230)..(230): n is a, c, g, or t
  modified_base (398)..(398): a, c, t, g, unknown or other
  misc_feature (398)..(398): n is a, c, g, or t
tcagtacgagtatgcacgaccggtgctcgatttagctacgactgcagggggcagcaagatggtgttgcagacccaggtcttcatttctctgttgctctggatctctggtgccggacggggacatcgtgatcgacccagtctccagactccctggttgtgtctcgtgggcgagacgggcccaccatcaactgaccaagtccagccagagttgttttanacagctaccaaanaataacaactactagcttagtaccagacaagaaaccaggacacgaccccctaaggtcctactactttacgtgggactaactccgtaacccgggagtcccggggtccctgaccgattcgagacggcacggtcggtacgtagggacaggtactttcaactctcaaccganccaccaactgacgaggctagaagatgtaggtactacgtttatacgtgtaccaagactaatactatacgtccctcctctacgtacggttcggacgggtaacggaaccgaagggtcggaagtactaacgaaacgtacgtgtacggtctacggaccaccgtagtcgtcgttccttacctacgttcccttaccccgctacttccgacgtacttaaccg

SEQ ID NO: 52117 - DNA, 636 bp, Homo sapiens
  misc_feature: GYAE6OF01A3S1N.18.11.A11.1.454.CMB.1.raw
  modified_base (294)..(294): a, c, t, g, unknown or other
  misc_feature (294)..(294): n is a, c, g, or t
  modified_base (327)..(327): a, c, t, g, unknown or other
  misc_feature (327)..(327): n is a, c, g, or t
  modified_base (355)..(355): a, c, t, g, unknown or other
  misc_feature (355)..(355): n is a, c, g, or t
  modified_base (373)..(373): a, c, t, g, unknown or other
  misc_feature (373)..(373): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagacctccctggttgtgtctctgggcgagaggccaccatcaactgcaagtccagccagagttgttttatacagctaccaaacaaataacaactacttagcttaggtaccagacaagaaaccaggacacgacccctaacggtcctctatttacgnggcactccgtacccgggacgtcccggggtcccnggaccgattcgagagcgacggcggtcgnggacagtactttcactcncaccactccaaccaacgtcgacgaggactagaagtagtggtacgtacttagttttactacgtagtacgaagtactaaattacctaagttaccttacccttcctaccttacgtaaccgggttccgggacggggtaaccgggaaccgtaagggtacggtacgtaacttaacgaaacgtacgtggtacggtctacggacctaccgcttacgtccgttcttaccgtaccttcccgttacccgtactacttacctacgtacctaaccg

SEQ ID NO: 52118 - DNA, 778 bp, Homo sapiens
  misc_feature: GYAE6OF01CE7SM.18.11.A11.1.454.CMB.1.raw
  modified_base (324)..(324): a, c, t, g, unknown or other
  misc_feature (324)..(324): n is a, c, g, or t
tcagtacgagtatgcacgaccggtgctcgatttagctacgactgcaggggcagcaagatggtgttgcagacccaggtcttcatttctctgttgctctggatctctggtgccgacgggacatcggtgatcgacccagtctaccagcctcccgtggttcgtgtctcgtgggacgaggacgggccaacacgtcaactcgacaacgtccacgccgagtagttcgtttaacacgacgcctacaaacctaaaataacctaacttacgttagcgtttacggaacagacaacgaaaccgagacacgtaccccctaaggtcctagtattacgnggactacgtaccgtaccgggacggttcccggtacctcggtaccgtacgttcgaaggacggtcgacggtcggtacgtacgggacctaggttacttacgaccttacacctaaccgaactccctaaccgaacgtcggaacctagggaccttaaacggaagttacggtacgggttacggtactttaacgttttaacgtacgttacgtacgtaagtaacctaacgttaactacggttacctacccttcgtaccgtaaccgtacggggtttaccgaacgggtaaccgggtaaccgttaaagggtaccggtaaacgtaccgttaaaccgtaaacgggtaccgttaggtacccggtacgtccgaaaccgttcccgtaacgtttaccggtcgtttaaccgtcccgttaaacccgtttccccgtaacccgccgtttaagtaaccctacggtaaccctttaacgg

SEQ ID NO: 52119 - DNA, 756 bp, Homo sapiens
  misc_feature: GYAE6OF01D5RSG.18.11.A11.1.454.CMB.1.raw
  modified_base (214)..(214): a, c, t, g, unknown or other
  misc_feature (214)..(214): n is a, c, g, or t
  modified_base (217)..(217): a, c, t, g, unknown or other
  misc_feature (217)..(217): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctcagacctccctggttgtgtctcgtgggcgaggagggccaccatcaactgcaacgtccagccagtagttgtttttanacngctaccaacaataacaactactagcttaggaccagacagaaaccaggacaccgacccccgtaagtcctactatttacgcgggactagtacccggtacccgggaggttaccccggggtcctacggaaccgtattaccgaggaacggccgaacgggtccgggtacgtacggggaacctaggttactttccaccgtacttacccaacctatacccgaaccctaaccgtcgacgtaaggtctaagggtaaacgtaggttacggtgtaccgtttaagttttaactttacccgtaggttaccgaaacttaccttaaaacgtttaccttaacgtaacccgtttccccttaacccgttccgtaaccggttaccggttaccgggggacgggtaaaccgggaccggttaaaggggtacgaacgtaacttaacccggaaaaggttaccgttagggccgacgttaccaaccgtacgtaacgtttccgttacggttcccttaccgtacccgttcccgttaccccgactacggtttccctaacgtactaaccg

SEQ ID NO: 52120 - DNA, 742 bp, Homo sapiens
  misc_feature: GYAE6OF01BTYU9.18.11.A11.1.454.CMB.1.raw
  modified_base (216)..(216): a, c, t, g, unknown or other
  misc_feature (216)..(216): n is a, c, g, or t
  modified_base (221)..(221): a, c, t, g, unknown or other
  misc_feature (221)..(221): n is a, c, g, or t
tcagtacgagtatgcacgaccggtgctcgatttagctacgactgcaggggcagcaagatggtgttgcagacccaggtcttcatttctctgttgctctggatctctggtgccggacggggacatcgtgatgacccagtcctccagacctcccgtggttgtgtctcgtgggcgagagggccaccatcaactgacaagtccagccagtagttgttttanacacnctaccaaacaataaacctaactacttacgcgtttacggaccagaccaacgaaaccgaggaccaccgtacccccgtaaggtcctactacgtttacgcggactacgtcccggtacccggggtaccggtcccggggtaccctcggtaccgtacttacgacggacggacgtacgggtcgggtacgtcgggaactacgttacttcgacctccgtaccacctactacccaaccctaaccgtcgacgacggtactacggagtacgttggtacgggtactttaacgttttacttaccgtagtacctaacggttaaccttaaattaaccgttactttaacccgttccctttaccgttacccgtacgggttaacccggggtccgggaaccgggggtaaccgggtaaaccggtaacggggtaggtaacgtaacgtaaccggtaaacggtacggtcggtccggactaccggacctacgtacttcctagttccctacgtacccttcccgtccgacttcctcgactaccgttacg

SEQ ID NO: 52121 - DNA, 651 bp, Homo sapiens
  misc_feature: GYAE6OF01DEAT8.18.11.A11.1.454.CMB.1.raw
  modified_base (304)..(304): a, c, t, g, unknown or other
  misc_feature (304)..(304): n is a, c, g, or t
  modified_base (326)..(326): a, c, t, g, unknown or other
  misc_feature (326)..(326): n is a, c, g, or t
tcagtacgagtatgcacgaccggtgctcgatttagctacgactgcaggggcgagcaagatggtgttgcagacccaggtcttcatttctctgttgctctggatctctggtgccgacggggacatcgtgatgacccagtctccagacctccctggttgtgtctctgggcgagagggccaccgatcaactgcaacgtccagccagtagttagttttatacagcctaccaacaactaacctaacttacttagcttaggtaccagacacgaaaccaggaccaccgtccccctaaggtcctctatttacngggctacgttccgtacccgggnggtcccggggtcctggaccgtatcgagaggcaggcggtcgtggacagtactttcactctcaccatccaccacctgacaggctagaagagtcgtagtacttagtttattacgtgtacaagtactaattacgtactaacgttccccttacttctaccgtaccggtttcgggaccgggtaacgggtaccgtaagggtacgggaacgtagtaacccgaaacggtacttcgggtacggtactcggacctaacccgttacgttccgtttcgttcccttaccgttacttcccccgttacccgtaccttacttacctccgtaacttaacccgg

SEQ ID NO: 52122 - DNA, 752 bp, Homo sapiens
  misc_feature: GYAE6OF01CMOQ9.18.11.A11.1.454.CMB.1.raw
  modified_base (209)..(209): a, c, t, g, unknown or other
  misc_feature (209)..(209): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactcctggttgtgtctcgtgggcgagagggccaccatcaactgcaagtccagccagagttgttttanacagctaccaacaaataacaactacttagcttggtaccaagacaagaaaccaggacacgacccctaaggtcctacattactggcatccgtaacccgggagtcccgggtccctgaccgtattcagaggcgtacgcgggtctgggacagtatttcactctcaacactccaaccaaccgtgacgaggactagaaacgtagtaggtacggacttaagttttaactttaacgtcgttacgaacgtaacttaaattaacccgttaattaaccggttaccccttcccgtttaccgtacccgttaaaccgggtttacccggggtaacgggggaaaccggggtaaacccggtaaacggggtttaacgggggaaacgttaacgtttaaacccgtaaaaaaccgggtaacccgttagggttaccggggtaaccttaccgggtaaccctaaaacccgtaactttccccggttaggtttcccctttaaccggtaacccttttccccgttacccccgtaaccgttaactttacgttaaccggtaaacctttaaaccg

SEQ ID NO: 52123 - DNA, 770 bp, Homo sapiens
  misc_feature: GYAE6OF01EU1E3.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtgccgacggggacatcgtgatcgacccagtcctccagacctcccgttggttgtgtctcgtgggcgagacgggcccaaccatcaactgacaacgtccagccagtagttgtttttatacacgcctaccaaactaaactaaacctaaccttacttagtcttacggtaaccagacaacgaaaccgacggaccaccgacccccgtaaggtcctactactttacgtggactacgtaccgtacccggggtacggttcccggggtcccgtcgtacccgtacttacgaggacggcgacggtcgggtcgtacgggactagttacttcctacctctaccacctactacccaacccgtaaccgtcgaccgtaacggtccgtaaggaacgtacggttagggtccgttaaccgtttaagttttaacgtttacgttacgttaccgaagtaacttaaacgttaccttaacgttaccgtttccctttacccttaccgttacccgtaccggggtttaccggggaccgggtaacgggtaaccggtaaggggtagggtaacgtaacgtaacccgtaaacggtaacggtcggtacggtccgtacgacccgtaaccgttacttacgttcgttcttacccgtaccgtttcccccgttaccgccctttagtacctaccgtacctacg

SEQ ID NO: 52124 - DNA, 778 bp, Homo sapiens
  misc_feature: GYAE6OF01C3M34.18.11.A11.1.454.CMB.1.raw
  modified_base (534)..(534): a, c, t, g, unknown or other
  misc_feature (534)..(534): n is a, c, g, or t
  modified_base (765)..(765): a, c, t, g, unknown or other
  misc_feature (765)..(765): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatcgacccagtctccagaccttccctggttgtgtctcgtgggcgagacggccaccatcaactgcaagtccagccgagtagttgttttacacacgacctaccaaaacaaactaaactaaccttaactttagctttacggaacccaggacaacgaaaacccgagggaaccaccgaccccccgtttaaggtcccttactaacgttttaacgttcggggacaacgttccccggtaaccccggggtaacgggttcccccgggggttccctacggtaacccggtacgtttaccgacggaacggaccgagggtccggggtacgtaggggaacaacggttactttaccgaaccttcaccctaaccaacttacccaaccccgtaaccttcggacacgggtaaccttaggaaacggtnttagggtacggtactttaagttttacgtaccgttagttacgacgtaactaattaacctttaagttacccgtttccctccgttaccgttaccgtacggtttacgggacggggtaaaccggtaccggtaaagggtaggaacgtactaaaccgtaacggtacgtggtaccggtactcggaccacgtagttaccttcgttacttaccgttgttcccccttaccggacctattccncgtaacttaaccg

SEQ ID NO: 52125 - DNA, 673 bp, Homo sapiens
  misc_feature: GYAE6OF01B3CWL.18.11.A11.1.454.CMB.1.raw
  modified_base (208)..(208): a, c, t, g, unknown or other
  misc_feature (208)..(208): n is a, c, g, or t
  modified_base (281)..(281): a, c, t, g, unknown or other
  misc_feature (281)..(281): n is a, c, g, or t
  modified_base (289)..(289): a, c, t, g, unknown or other
  misc_feature (289)..(289): n is a, c, g, or t
  modified_base (308)..(308): a, c, t, g, unknown or other
  misc_feature (308)..(308): n is a, c, g, or t
tcagtacgagtatgcacgaccggtgctcgatttagctacgactgcgagggggcagcaagatggtgttgcagacccaggtcttcatttctctgttgctctggatctctggtgccgacgggacatcgtgatgacccagtctccagactccctggttgtgtctctggcgagaggccaccatcaactgcaagtccagccagagttgttttanacagctacaaacaataacaactacttagcttggtaccagacaagaaaccagactacgaccccgtaagtccctnatttacgnggactactccgtaccgggngtcccgggtcctgaccgattcgaggacggcaggtcggtacgtagggactaggtactttcgaactcacacatccaaccaactgacctagtctagaagtgtgtcgtacttagtttactacgtgtacgacgtactaactacttacgttactaccctctacgtcgtaacggttcggacggtacgggtaaccgtagggtacgtaagtacgtaaacgtaaaccgtaacggttcgggtaccggtacgttaccggaaccctaaacccggttcgtttacccgttacggtttaccctttaccggttaaaccctttccccccgttaacccgttcccggttaacctttaccgggtaacccgtaactttaaacccccg

SEQ ID NO: 52126 - DNA, 764 bp, Homo sapiens
  misc_feature: GYAE6OF01AQ3AC.18.11.A11.1.454.CMB.1.raw
  modified_base (227)..(227): a, c, t, g, unknown or other
  misc_feature (227)..(227): n is a, c, g, or t
tcagtacgagtatgcacgaccggtgctcgatttagctacgactgcaggggcagcaagatggtgttgcagacccaggtcttcatttctcttgttgctctggattctcgtggtggccggacggggacatcgtgatcgacccagtctaccagacctccgttggttgtcgttctcgtgggacgaggacggccacatcaatgactaagtccagccaagtagttcgttttaanacacgacctaaccaaaactaaaactaacctaaacttaccttagtacggtttacgaaaccaagacaaacgaaaccgacgggaaccacccgtaaccccgttaaggtaccttactaacgtttaacggtcgggactaaccgtaccggtaccccggggtacggttccccggtcctaggtaacccgtataccggaacggtacggcgaacgggtccggtagtacgggaacttacgtactttacgacctcgtaaccaaccgactacctaacctaacgcgagacgtacaggtaataggttcgtacgtaatttacgttaacgttagtacgcgtaacgaacttaattactaaccgtcgttacccttcttaacccggcttaaccggggtacgggaacgggaacggttaaccggaaggttaggaacttaaacgtaacgggaaaccgttacgttggtaccgtacgacttaccgaacgttacctgtttaccggttcttaaccgttcccgttaacccctccgaaccgttccttaacgattaaacgtaacccgg

SEQ ID NO: 52127 - DNA, 613 bp, Homo sapiens
  misc_feature: GYAE6OF01DITWC.18.11.A11.1.454.CMB.1.raw
  modified_base (210)..(210): a, c, t, g, unknown or other
  misc_feature (210)..(210): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctcgtgggcgagagggccaccatcaactgcaagtccagccagagttgttttanacagcctaccaacaataacaactacttagcttggtaccagacagaaaccaggacacgaccccctaaggtcctacacttacgtggctacgtccgtaccccgggaggtcccggggtcctcgaccgattcgagacggcgaggcggtcgtggacagtacttcactctcaccatccaaccaactgacacggactagaagtagtggtagacttaagtttacttactgtcgaagtactaattactataccgttccctcctctaccgtacggttcgggacggaacggaccgtaagggtcggaacgtactaacgaaacgtacgtaggtaccgtactaccacctacttccgttacgttaccttactaccttcccgtacccccgacttaactcctaacgacctacgttaacccg

SEQ ID NO: 52128 - DNA, 1094 bp, Homo sapiens
  misc_feature: GYAE6OF01C9XDV.18.11.A11.1.454.CMB.1.raw
tcagtacgagtatgcacgaccggtgctcgatttagctacgactgcaggggcagcaagatggtgttgcagacccaggtcttcatttctctgttgctctggatctcgtggtcggccggacggggactacgtcggtgagtaccgaccctacgtcctccgacgtacccttcccgttgggttgtcgtccgtcggtacgggacggaagggaccgggacccacctactaccaacgtacgaccgtaacgtacccgacggtaccgtaaggttaggtttacgttttaacaaccgtacgtaccctaaaccctaaaacctaaaactaaaacctaaacctttaacgttacgtaccgtttaaccggaaccgaacggaaccgaaaaccggtaaacccggtaacccggggtaaccccggtaacccccggttaacggttcccttaaccgttaacgtttaccggacgggtaccgttaaccggtaccccggggttaacccccgggggtaccggggttccccggggtacccgtaaccggtaacccgttacgtacggaacgggtacggtaccggtacggggtccgggtacggtacgggacgttaacgttccttacctaccgtacctacccgaaccctaccgtaaaccctaacccgtaacgtacggaaccgtacgggtaaccgaaggaaggttacgttacgggttaaccggtaacctttttaaggtttaacccgaacgtttcggaaacccgtaaacgtttaaacctaaccggttttaaagaccccgtttcccggtaacccccttttccgggaaccgttaaccccggggtttaacgggggtaaccccgggggtaaccggggaaaaacggggttccggttaaacggggggaactaaaacccggttaaaaccggttaaaacccgggtaaaacccggttccggggttttgggggaacccccttaaacgggtccccccggtaaaaccttccgttaaacccgggtttcccgtttaacgggtttaccccgtaccccccctttacgtttaccccccccgtaaccccgggtaaccctttaaacgccgtttaaaccccgttacggtttaccccggttaaccccggg

SEQ ID NO: 52129 - DNA, 830 bp, Homo sapiens
  misc_feature: GYAE6OF01A0GT2.18.11.A11.1.454.CMB.1.raw
  modified_base (212)..(212): a, c, t, g, unknown or other
  misc_feature (212)..(212): n is a, c, g, or t
  modified_base (225)..(225): a, c, t, g, unknown or other
  misc_feature (225)..(225): n is a, c, g, or t
tcagtacgagtatgcacgaccggtgctcgatttagctacgactgcaggggcagcaagatggtgttgcagacccaggtcttcatttctctgttgctctggatctctggtgccgacgggacatcgtgatgacccagtctccagactccctggttgtgtctcgtgggcgagacgggccaccatcaactgcaagtccagccagtagttgtttttanacagctaccaaanaaactaacaactacttagcttaggtaaccagacaacgaaaaccaggacacgaccccctaaaggtccctcgaatttacgtgggacctaacgtccgtaacccggggacggttcccgggggtacccctacggtaacccgtactttaccgaaggtacggaccgaagggtccgggtaacgttacggggaacctaacggtactttaccgaccttaccttaccaaccctaattacccgaaaccctaaacccgtcgacgaacggtaccgttaaggaaagtaacgtaggttacgggtaaccttaggttttaaacgtttaacgtacggttaaccgtaacggtaactaaacgttaaccgtaagttaaccggttccccttaccttaccggttacgtacccgggttaccgggtaacggggtaaccggtaaacccgggtaagggtaacgggtaacgtaacgttaaccgtaaaaccggtaacgtttcggacggtaccgtaccggttaacccgaacccgttacgttacccggtttaccttaccgtttaaccctaaccgtttacccccgttaccccggtaacccttaaccgtttaccgtaaccggttaaccttaaaacccgg

SEQ ID NO: 52130 - DNA, 799 bp, Homo sapiens
  misc_feature: GYAE6OF01AKDBX.18.11.A11.1.454.CMB.1.raw
tcagtacgagtatgcacgaccggtgctcgatttagctacgactgcaggggtctaggcaagattggtgttgcagacccaggtcttcatttctctgttgactactggatctctggtgccgtacgggacatcgtgatcgacccacgtctccaggacctccctcggttgtcgtctcgtgggcgaggacgggccaccacgtccaaacgtgtcgaagtccacgcccgaagtacgttcgttttactacacgtctaccaactaataaccaacttacgttacgcctttaggtaccagacaacgaaaccacggtaacaccgtacccccgttaaggtccgtctagtttaccgcgggaccacgtccccggtaccgggggacggtcccggggtccctaggtaccggtatttcggaaggtacgtccgacgggtacgggttcggtacgggaacctaacgttactttacccgaccttacctacccgaaccgtacgtcccgaaccctaacccgtcgaccgtacggctacggaacgtactacggttacgtacttgtttaaccttacgtacgtacacggtaccttaactaccgttagtccgttaccctccctacgttaccgtaccgggtaccgggtcgggtaacgggtaccctaagggtttcggaacggtaccgtaacccggtaaaccgggtaccgttacgggtcggtacccgttacggtacccgtaacccgtttgttacccggttacggtttcccttacgttacctttcccccggttcccgggtaccgtacgtttaccgtaacgtaaccgttacccg

SEQ ID NO: 52131 - DNA, 641 bp, Homo sapiens
  misc_feature: GYAE6OF01BNFOI.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagttgttttatacacgctaccaaacaataacaactacttagcttggaccagcaagaaaccaggaccacgccccctaaggtcctctatttacgtgggcacgtccgtaacccggggtacggttcccgggggtccctcggacccgtattaccgaggacggcaggtccggggtcgtaggggaccagtactttaccgacctcgtccaaccacgttaccaaccctaacccgtgaccgtaggcctaggaacgtgttggtacggtacttaggttttattaaccgtgtacacgtactaacgttactattaccgtcctcctctcgtcggtccgggacggacggaccgtagggtcgtaagacttaacgaacgtacgtaggtcggctcgacctaaccgctttctcggttaccttccgtattcccctcccgtacctattccgtacgcgttaacccg

SEQ ID NO: 52132 - DNA, 756 bp, Homo sapiens
  misc_feature: GYAE6OF01DKVMZ.18.11.A11.1.454.CMB.1.raw
  modified_base (217)..(217): a, c, t, g, unknown or other
  misc_feature (217)..(217): n is a, c, g, or t
tcagtacgagtatgcacgaccggtgctcgatttagctacgactgcaggggcagcaagatggtgttgcagacccaggtcttcatttctctgttgctctggatctctggtgccggacggggacatcgtgatcgacccagtcctccagacctccctggttgtgtctcgtgggcgagagggccaccatcaactgcaacgtccagccagtagttagttttanacagcctaccaaactaataaacaacttacttagtcttacggtaccagacaacgaaaaccaggaccaccgacccccttaaggtcctactaactttacgtgggctacgtaccggtacccggggtacggtcccgggggtccctcggaccgtattcgaggaggcgagggcgggtcgtgggacagtacttccacttcctacacctactaccaaccctaacgtcgacgacggtactacgaaggtattcgggtacgtacgttaagttttattaacgtcgtacgaagtaacctaagtttaactacgtttaccgttcccccttccgttacccgttacggtacccgggtttcccggggacggggtaaccggggaaccggttaaggggttacgggaacgtaaaccgttaaccggaaaaccggttaccgtaggttccggtacctacggtaacccgaaccccttaagtttcccgtttacggttcccctttaccgtaccctttcccccgttacccggaccttaacggttaccctacggtaacctaaacccggg

SEQ ID NO: 52133 - DNA, 1043 bp, Homo sapiens
  misc_feature: GYAE6OF01BP1ZD.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtgccggacggggacatcgtgatcgacccagtcctccagacctccctggttgtgtctcgtcgggcgaggacgggcccaaccatccaactcgacaacgtccagccagtagtttgttttaatacacgtactaccaaaaccaaacttaaacctaaaccttacgtttacgtccgtttaggtacccaggaccaaacggaaaacccgacggtaacccgaaccggtaaccccccccgttaaaacgggtcccttaccttaacgtttttaccggtacgggggacctaccgttaccccgggttaacccccggggggtaaccggggtttcccccggggggttaccccgttacggtaacccggttaacgtttccggaaacgggaccggggaccgaacggggtcccgggggttaccggttacgggggaacctagggttaacttttccctaaccgtttcccttacccgaaccctaaccttacccccgaaaccccgtaaacccgttcggacccgagggtaacccgtaacgggtaaacgttacgttacggggttaacggttacgttttaaacggtttttttaacgttaacgtttcgggttaaacctaacggtaaaccctttaaaacgttttaacccggttaacttttaaccccgggtttacccccctttaccccgtttacccccgtttaacccgggttaaccccgggggttttacgggggaaccccgggggtttaaaccgggggtaaacccgggttaaaggggtaccggggtaaaccgttaaacggttaaaccccgggtaaaacccggttaacgggttacgggtacccgggttaccgtacccgacccgttaaccgttacccggtttacgttaaccgtttccgttaccctcccgtttaacccccgttacccccggtacctttaaacccgtccttaaccgtaaccgtttaacccg

SEQ ID NO: 52134 - DNA, 877 bp, Homo sapiens
  misc_feature: GYAE6OF01APZI1.18.11.A11.1.454.CMB.1.raw
  modified_base (219)..(219): a, c, t, g, unknown or other
  misc_feature (219)..(219): n is a, c, g, or t
tcagtacgagtatgcacgaccggtgctcgatttagctacgactgcaggggcagcaagatggtgttgcagacccaggtcttcatttctctgttgctctggatctctggtgccggacggggacatcgtgatcgacccagtcctccagacctcctggttgtgtctcgtgggcgagacgggccaaccatccaactgacaagtccagccagtagttgttttaanacacgtcctaccaaactaactaaaccaacttactagcttacggtaccagacaagaaaccaggaccacgacccctaaggtcctactatttactgggcacgtccgtacccggggacgtcccgggtcctaggacccgtatttacgaggtacggcacgggtaccgggtcgtacgggaactacggtaacttttccgaaccttctacccgaaaccgtacttaacccgaacccgttaaacccgtcgggtaccctaagggtaccctaagggtaaaaccggttacggttacgggttaaccgggtctttaacggttttaacgttttaaccgttacggttaaccgtaacgtaaccggttaaacttaaccgtttaacgtttaacccgggtttccccttttaccgtaacccgttttaccccggtacccggggttttaacccgggggaccggggtttaaaaccgggtaaccggtaaacgggggttaccggaaacggttaaaccgtaaccccggtaaaaacgggtacgttaccgggttacggtaaccgtttacccggaacccgtaacccgttaaaccgttccggtttaaccgtttccctttaaccccgtaaccgtttcccccggtaccccccgtactttacccgtaccgttaacccgttaaaccttaacccgg

SEQ ID NO: 52135 - DNA, 616 bp, Homo sapiens
  misc_feature: GYAE6OF01AWN3P.18.11.A11.1.454.CMB.1.raw
  modified_base (433)..(433): a, c, t, g, unknown or other
  misc_feature (433)..(433): n is a, c, g, or t
tcagtacgagtatgcacgaccggtgctcgatttagctacgactgcagggggcagcaagatggtgttgcagacccaggtcttcatttctctgttgctctggatctctggtgccgacggggacatcgtgatgaccccagtctccagactccctggttgtgtctcgtgggcgagagggccaccatcaactgcaagtccagccagagtgtttatacagctccaacaaataacaactacttagcttggtaccagcaagaaaccgaggacacgccccctaaggtcctctattacgtgggcactccgtacccggggacgtcccggggtccctggaccgtatcgagaggcgaggcgggtcgtagggacagtactttcactctccaccatccaaccaaccctgacaggctagaagtatggtgtctagtttaattctgtacanactaatactaatactcccctcctctacgtaccggttccgggacgggtaacgggaaccgagggtacggagtaacgtacgtaaaaccggacgttgggttcggcgtacgaccgtaaccctagttcccttaggtccctttaccgtacttacccttcccccggacaacttccgtacgtaacttaaccg

SEQ ID NO: 52136 - DNA, 634 bp, Homo sapiens
  misc_feature: GYAE6OF01DEGLH.18.11.A11.1.454.CMB.1.raw
  modified_base (214)..(214): a, c, t, g, unknown or other
  misc_feature (214)..(214): n is a, c, g, or t
  modified_base (297)..(297): a, c, t, g, unknown or other
  misc_feature (297)..(297): n is a, c, g, or t
tcagtacgagtatgcacgaccggtgctcgatttagctacgactgcaggggcagcaagatggtgttgcagacccaggtcttcatttctctgttgctctggatctctggtgccggacggggacatcgtgatgacccagtctccagacctccctggttgtgtctcgtgggcgagacgggccaccatcaactgcaagtccagccagtagttgttttanacagcctaccaaacaataacaacttacttagcttggtaccagacagaaaccaggacaccgaccccctaagtcctacattacgnggcatccgtaccggagtcccgggtcctgaccgtattcgagacggcacggcggtcgtgggacagtacttcgactcacacgataccaaccaacctgaccgaggactagaagtgtaggtcgtacttagttttatacctgtacctagaactatactactacgttccctaccttctacgtccgggttacgggaccgggtaagggacccgtaagggtacggtagaaccgtaacgtaaacggtacgttagggtccgtaccgtcgtaccgaaccgttcgttacgttctttccgtaccttaccgtttccccttacccggtacctagttacctacgtacttaacccg

SEQ ID NO: 52137 - DNA, 538 bp, Homo sapiens
  misc_feature: GYAE6OF01BFJF1.18.11.A11.1.454.CMB.1.raw
  modified_base (141)..(141): a, c, t, g, unknown or other
  misc_feature (141)..(141): n is a, c, g, or t
  modified_base (339)..(339): a, c, t, g, unknown or other
  misc_feature (339)..(339): n is a, c, g, or t
  modified_base (513)..(513): a, c, t, g, unknown or other
  misc_feature (513)..(513): n is a, c, g, or t
  modified_base (530)..(530): a, c, t, g, unknown or other
  misc_feature (530)..(530): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccngactccctggttgtgtctctgggcgagagggccaccatcaactgcaagtccagccagagtgttttatacagctccaacaataacaactacttagcttggtaccagcagaaaccaggacacgccccctaaggtcctcattactgggcatctacccggggagtccggggtccctggaccgattcagaggcaggccgggtntgggacagatttcactctcaccatccaccaacctgacaggctgaacgatgtggctaggtttacttacgtgtcagtcaatactattactccctctctcacgttcggcggtacgggacctagggtaggagtactacgaaaccgtatggtcggctgaccacctatcttgctttaccnttcccttcccgctatcngacttacg

SEQ ID NO: 52138 - DNA, 622 bp, Homo sapiens
  misc_feature: GYAE6OF01CZ75E.18.11.A11.1.454.CMB.1.raw
  modified_base (297)..(297): a, c, t, g, unknown or other
  misc_feature (297)..(297): n is a, c, g, or t
  modified_base (344)..(344): a, c, t, g, unknown or other
  misc_feature (344)..(344): n is a, c, g, or t
tcagtacgagtatgcacgaccggtgctcgatttagctacgactgcaggggcagcaagatggtgttgcagacccaggtcttcatttctctgttgctctggatctctggtgccggacggggacatcgtgatgacccagtctccagactccctggttgtgtctcgtgggcgagagggccaccatcaactgcaagtccagccagagttgttttatacagcctaccaaacaaataaacaacttacttacgcttggtaccagcaacgaaaccaggacacgcccctaaggtcctctactttacnggcactccgtacccgggacgtcccgggtcctcgaccgtattcgaggngcgaggcgggtcgtcgggactagtactttcaactctaccaccatccaacctaacctgcaggctagaacgatggtgacttaagtttactactgtacagtactaatactacttacgtccctcctctcgtacggttcggcgggtaacggaccgtaagggtgaagtaacgtaaccgtaaacgtacgtcgggtacggtctacgtccctaaccgttacttccgttcggttaccttaccggtacttccccgttcccgtacctcgtttactccgtaacttaaaccg

SEQ ID NO: 52139 - DNA, 640 bp, Homo sapiens
  misc_feature: GYAE6OF01ALWMG.18.11.A11.1.454.CMB.1.raw
  modified_base (429)..(429): a, c, t, g, unknown or other
  misc_feature (429)..(429): n is a, c, g, or t
  modified_base (470)..(470): a, c, t, g, unknown or other
  misc_feature (470)..(470): n is a, c, g, or t
  modified_base (477)..(477): a, c, t, g, unknown or other
  misc_feature (477)..(477): n is a, c, g, or t
  modified_base (483)..(483): a, c, t, g, unknown or other
  misc_feature (483)..(483): n is a, c, g, or t
  modified_base (628)..(628): a, c, t, g, unknown or other
  misc_feature (628)..(628): n is a, c, g, or t
tcagtacgagtatgcacgaccggtgctcgatttagctacgactgcaggggcagcaagatggtgttgcagacccaggtcttcatttctctgttgctctggatctctggtgccggacgggacatcgtgatcgacccagtcctccagacctcctggttgtgtctcgtgggcgagcggccacatcaactgcaacgtccagccgtagtagttgttttaatacacgtctaccaaacaaagtaaacaacttactacgtcgttacggtaccagacaaacgtaaacgaacggaacctacggaccccgtaacgtcctactaacgtttacgacggtactaccgtaccggtaacccggggacgtcccggggtccctaggaccgtattacgaggacgtacgacggtcggtcgtaggactaggtacttcgactctacactacncaaccacgtcacgagcagaacgtcgtgtacggtattagttntaacgtntacganataactacgtataccgttcctactcggtacgtacggtaccggaggaacggtaacgaggtagaacgtactaacgaacgtacgttgggacgtacgtcgacgtaaccgtcgtagttccgtacttacgccttcccgtacccgctacgtntacgtcctaacg

SEQ ID NO: 52140 - DNA, 732 bp, Homo sapiens
  misc_feature: GYAE6OF01CTOMB.18.11.A11.1.454.CMB.1.raw
  modified_base (225)..(225): a, c, t, g, unknown or other
  misc_feature (225)..(225): n is a, c, g, or t
  modified_base (235)..(235): a, c, t, g, unknown or other
  misc_feature (235)..(235): n is a, c, g, or t
  modified_base (500)..(500): a, c, t, g, unknown or other
  misc_feature (500)..(500): n is a, c, g, or t
  modified_base (718)..(718): a, c, t, g, unknown or other
  misc_feature (718)..(718): n is a, c, g, or t
tcagtacgagtatgcacgaccggtgctcgatttagctacgactgcaggggcagcaagatggtgttgcagacccaggtcttcatttctctgttgctctggatctctggtcgccggacggggacatcggtagatcgacccagtcctaccagtacctcccgtggttgtgtctcgtgggcgaggacgggccaaccatacaaactgacgaacgtccagccaagtaggttntttaatacancctaacaaacaaactaaacaacttactacgcgttacggaccagacaagaaaccgaggaccaccgtaccctaacggtcctactacgttacgcggacctagtcccggtaaccgggtccggttcccgggtaccctggaaccgtacttacgaggacggaccgacgggtccggtagacgggaactaacgttactttaccactacctaaccaaccctaaactacccgaacctaaaccgtcgaccggtaaggaccttaaggaaaggttacgnggttaacggtaactttaacgttttaactaaccgtgtaacgaacgtaacttaaacgtaacttacttaaccgtacccttccgttacacggttaccgggttacgggaacgggtaacggaaccggaagggtacgtaacgaacgtaaccgaaaacggtacgtcggtacgacagtacccaccttacgtacgttcgttctaccgtacgttcccttcccgacttancgtaacacgtaacc

SEQ ID NO: 52141 - DNA, 777 bp, Homo sapiens
  misc_feature: GYAE6OF01BCH7B.18.11.A11.1.454.CMB.1.raw
  modified_base (211)..(211): a, c, t, g, unknown or other
  misc_feature (211)..(211): n is a, c, g, or t
  modified_base (312)..(312): a, c, t, g, unknown or other
  misc_feature (312)..(312): n is a, c, g, or t
tcagtacgagtatgcacgaccggtgctcgatttagctacgactgcaggggcagcaagatggtgttgcagacccaggtcttcatttctctgttgctctggatctctggtgccgacgggacatcgtgatcgacccagtctccagactccctggttgtgtctcgtgggcgagacggccaccatcaactgacaagtccagccagagttgttttanacagcctaccaaacaataactaactacttagcttcggtaaccagacaacgaaaaccgaggaaccaccgtacccccgtaaggttccctactaactttaccgngggacctacgttacccggtaacccggggtacggttccccggggtaccctacggaaccgtattaccggaaggtacggcgacgggtcgggtacgtacggggacacggttactttaccgaccgttcctaccaaccctactacccaaaccctaacccgtacggaccgacgggtacctaaggtaaacgtacgttagggtacggtaaccgtttaagttttaacgttacgttcgtaacgtaacgtacttaaacttacttaagttaccgttacccctttaccgtaccgttacccgtacgggtttccgggaacgggtaacggtaaccggtaaggggtacggaaagtacgtaaaccgtaacgtacgttgggtacggtccgtaccgtaccgtaacgttcgttacccgtactttccgttacgttacccgttaccccgttaccccgaccttacttaccgtaccggtaccttaacccgg

SEQ ID NO: 52142 - DNA, 519 bp, Homo sapiens
  misc_feature: GYAE6OF01E5AX7.18.11.A11.1.454.CMB.1.raw
  modified_base (447)..(447): a, c, t, g, unknown or other
  misc_feature (447)..(447): n is a, c, g, or t
  modified_base (485)..(485): a, c, t, g, unknown or other
  misc_feature (485)..(485): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagcccccctaaggtcctacatttactggggcatcctacccggggagtccggggtccctgaccgattcagaggcagcgggtctgggacagtactttcactctcaccactcaacccaacctgcaggctagagatgtggctagtttattactgtcagcaatactatacgtcctctctcacgttcggacggngggaccaggtgagatacgaaacgactgtgctgacacgntctcgtcttcactccttcccgacatctgactacg

SEQ ID NO: 52143 - DNA, 630 bp, Homo sapiens
  misc_feature: GYAE6OF01BEF9L.18.11.A11.1.454.CMB.1.raw
  modified_base (215)..(215): a, c, t, g, unknown or other
  misc_feature (215)..(215): n is a, c, g, or t
  modified_base (407)..(407): a, c, t, g, unknown or other
  misc_feature (407)..(407): n is a, c, g, or t
  modified_base (443)..(443): a, c, t, g, unknown or other
  misc_feature (443)..(443): n is a, c, g, or t
  modified_base (560)..(560): a, c, t, g, unknown or other
  misc_feature (560)..(560): n is a, c, g, or t
tcagtacgagtatgcacgaccggtgctcgatttagctacgactgcaggggcagcaagatggtgttgcagacccaggtcttcatttctctgttgctctggatctctggtgccggacggggacatcgtgatgacccagtctccagacctcccgtggttgtgtctcgtgggcgaggagggccaccatcaactgacaagtccagccagagttgttttanacagcctaccaaacaataacaactattagcttggtaccagacaacgaaaccacggaccacgaccccctaaggtcctactatttacgtcggctacgtccgtaccggggacggtcccggggtccctaggaccgtagttaccgaggacggccgacgggtcgggtacgtaggggaccaggtactttacgaccttcnccacactccaaccactgacgaggtcagaagtgtggngtactagtttagtactgtaccagactaacgtattacgtactccctcctcgtccgtacgggttccggaacggggtacggaaccgtagggacgtaaggtactaacgaacggacttcggngtacctgaccctacgtacttcgtacttccttacgtaccttcccgtcccacctacgtctacgtaacctacg

SEQ ID NO: 52144 - DNA, 609 bp, Homo sapiens
  misc_feature: GYAE6OF01BZAGV.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagttgttttaatacagctccaaacaataacaactacttagcttaggtaccagcaagaaaccaggacacgccccctaaggtcctactatttacgtgggcacgtcgtaccccggggaggtcccggggtccctggaccgtattcgagaggcaggtcgggtctagggacagtacttccactctacaccatccaaccaactgacgaggctagaagagttggtggtactagtttacttcgtgtacagactaatactatacgtcccttcctctctacggtcggacggacggaaccgtaagggtacggaagtactaaccgaaacgtacgtaggtggactcgacccaaccgtcttcgtacggttccttaccgtacctttcccgttaccccgaccctacgttccgttacgacttaaacccg

SEQ ID NO: 52145 - DNA, 803 bp, Homo sapiens
  misc_feature: GYAE6OF01DVYQM.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtgccggacgggacatcgtgatcgaccagtctcagactcctggtgtgtctcgtggcgaggacggccacatcaactgacacgtcacgccagagttgtttactacacgacctaccaaaactaaactaaactaaaccttacgttacgtacgtttacggaaccagaccgaaacgaaaaccgacggaaccaaccgtacccccgtaacggtacctactacgtttacgtcggataccgttaccggtacccgggaggtccccgggtacctacgaccgattaccgaggacggacgtacgggcggttacggtcgggaacgtacggttaactttaccgacctttacccgacaaaccctactaaccctaacccaaccgttacgaccgtacggtacctaaacgggtaagtaacgttgggttacggtactttaaacgggttttactttaaacttgggtaaaccacggttaaactaaccgttaaacgttaaccggtttaccttcccctttaccctaccgttacggttaacccgggtacgggtaccgggaaccgggtaaccgtaagggtaaccggtaagtaaaccgtaacgtaaactacgggttacggtacgtaccgtcggtaacctacccgtagtttcccgtacgttcctttcgtaaccccgtttcccgtaccccggaccttaaccggttcctaaccggtaaccttaaaccg

SEQ ID NO: 52146 - DNA, 712 bp, Homo sapiens
  misc_feature: GYAE6OF01BOV0R.18.11.A11.1.454.CMB.1.raw
  modified_base (212)..(212): a, c, t, g, unknown or other
  misc_feature (212)..(212): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagacggccaccatcaactgacaagtccagccagtagttgtttttanacagcctaccaaacaactaaacctaactaacttagtcttacggtaaccagacaacgaaaccgaggaccacgaccccctaaggtcctactactttacgtcgggactacgtccgtacccgggtacggtcccggggtccctacggaccgtacttcgaaggaggactagggtcgggttccgtaggggacctaaggtacttttaccaacttcccgtacctaaccctactacccaacctaacccgttcgaccgacggctaaggaacgtagttcggtacggtaccgtttagttttaacttacgttacgtaacgtacgtaaacttaaacgttacttaacgttaccgtttcccctaccttccgttaccggttaccgggtccgggtaacgggaacgggtaacccgtaagggtaggaacgtaacgtaacaaacggtacgtgacggtctacgaccacgtcgttctacgttcctacctctttccccgtacctctacgtacctcgaaccttacg

SEQ ID NO: 52147 - DNA, 810 bp, Homo sapiens
  misc_feature: GYAE6OF01B9M7D.18.11.A11.1.454.CMB.1.raw
  modified_base (212)..(212): a, c, t, g, unknown or other
  misc_feature (212)..(212): n is a, c, g, or t
tcagtacgagtatgcacgaccggtgctcgatttagctacgactgcaggggcagcaagatggtgttgcagacccaggtcttcatttctctgttgctctggatctctggtgccgacgggacatcgtgatgacccagtctccagactcctggttgtgtctctgggcgagacggccaccatcaactcgacaagtccacgccagtagttagttttanacgacgtcctaccaaacaaactaacctaaactacgttagcgttacggtaaccagacgaaacgaaaccgaacggaccaacccgtacccccgttaaacggttccctacttaacgtttaccggtcggggtacctaccgttacccggttaaccccgggggtaccggggttccccgggggttaccccgtacggtaaccccggtatttaccggaagggtacggaccggacgggtccggggttacgtacggggaacgtaacggtttactttaccgtacgttaccctaccgtaaccctacttaacccaacccgtaaccgtaccggtacgaacggtaccgtaacgggaagttacggtcgggttacggttacgtttaacgttttaactttacgttacggtcctaacggtaacttaaacgtacttacgtaccgttcccttacctccgttccgttaccgggttcgggaccgggaacgggtaccgtaagggtcgggaagtaacgtaaccgaaacggtacgttggaccggtacgtcgaaccctaccgttcgttccttgttcccttcttacccgttcccgttacccgaccttacgtcttacgtccttaaccgg

SEQ ID NO: 52148 - DNA, 766 bp, Homo sapiens
  misc_feature: GYAE6OF01AHFJU.18.11.A11.1.454.CMB.1.raw
  modified_base (717)..(717): a, c, t, g, unknown or other
  misc_feature (717)..(717): n is a, c, g, or t
tcagtacgagtatgcacgaccggtgctcgatttagctacgactgcaggggcagcaagatggtgttgcagacccaggtcttcatttctctgttgctctggatctctggtcgccggacggggacactcgtgaatcgacccagtcctccagacctcccgtggttgtcgtctcgtgggacgaggacggccaacatacaactgacaacgtccagccagtacgttagttttaacacacgtacctaccaaaactaaactaaacctaaacttaccgttaggtccgttacggtaaccacgaccgaaacggaaaccgacggacctaccgtaccccgtaaggtcctacttagttacggcggcctacgtccggtacccgggtacggttcccgggtcctacggaccgtacgtacgacggacggcgagggtccggtacgtacgggaactacgtttaccgttactaccgtccctaccgtaaacctactaaccccggtaaaccaaacccggtttcggaacccggttaacgggtacccgtaaagggtaacgttacggttacgggttacgttaaccgttttaaacgttttaccgttacggttaccgtaaacgtaccgtaaacgttaaaccttacgtaccgtttaccgtcccttcgtacggtccgtacggtcgggacgacggaacggtaggtacgactaagtaacgaaacgtcgtggtacgcgactacctacgttntccgttacgtccttacgtccttccgtcctactctactagtaactaccgg

SEQ ID NO: 52149 - DNA, 635 bp, Homo sapiens
  misc_feature: GYAE6OF01CDQ7F.18.11.A11.1.454.CMB.1.raw
  modified_base (223)..(223): a, c, t, g, unknown or other
  misc_feature (223)..(223): n is a, c, g, or t
  modified_base (404)..(404): a, c, t, g, unknown or other
  misc_feature (404)..(404): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctcgtgggcgagagggccaccatcaactgcaagtccagccagtagtgttttatacagctaccaaanaataacaactacttagcttggtaccagcaagaaaccaggaccacgaccccctaaggtcctcatttactgggcatccgtaccgggacgtcccggggtcctgaccgattcgagaggcgaggcgggtctacgggacagtattccgaactctcaccataccaaccaactgacgaggctacgaagntgtacggctaaggtttactacgtagtcgagactaattactacgtaacgtccttaccctctaccgaccgggtttacgggcccgggaaacggggtaccgaaagggttacggaacgtaacgtaaccgaaacggttacgtacgggttcggacgttcgaaccgtacccgtacttaccgtacgttccttccgtactttccccgttaccccgcctaacgtccgtacgtacccttaacg

SEQ ID NO: 52150 - DNA, 684 bp, Homo sapiens
  misc_feature: GYAE6OF01AT2HE.18.11.A11.1.454.CMB.1.raw
  modified_base (218)..(218): a, c, t, g, unknown or other
  misc_feature (218)..(218): n is a, c, g, or t
  modified_base (308)..(308): a, c, t, g, unknown or other
  misc_feature (308)..(308): n is a, c, g, or t
tcagtacgagtatgcacgaccggtgctcgatttagctacgactgcaggggcagcaagatggtgttgcagacccaggtcttcatttctctgttgctctggatctctggtgccggacggggacatcgtgatgacccagtcctccagacctcccgtggttgtgtctcgtgggcgagagggccaccatcaacgtgacaagtccagccagtagttagttttanacagcctaccaaacaataaacctaactacttagcttggtaaccagacaacgaaaccgaggaccacgacccctaaggtcctactattacgnggcacgtccgtacccgggcgtcccgggtccctacggaccgtatacgaggacggcgaggtcgggtacgtcggacagtactttcactcctaccactactaccacctaacgtcgacgacggtctaggaagtgtcgggtcgtacttagttttacttacgtagtacctagacttaacttacgtacgttacctcccgttaccgtccgtaccgtacgggttacccggggagggtaaccgggtaacgtaagggttcggaaacgttacgtaacgaaaacccgggtgttccggtacggtctaccgtaccgtacccgttattcccgttacgtccgtttaacacccgtttccccgttaccccgcttaattcccgtaacgacttaaccg

SEQ ID NO: 52151 - DNA, 685 bp, Homo sapiens
  misc_feature: GYAE6OF01B7JSN.18.11.A11.1.454.CMB.1.raw
  modified_base (211)..(211): a, c, t, g, unknown or other
  misc_feature (211)..(211): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctcgtgggcgagagggccaccatcaactgcaagtccagccagtagttgttttanacagctaccaacaataacaactacttagcttgaccagcagaaccagacacgcccctaacggtcctactattacgtggcacgtccgtacccgggtacggtcccggggtccctcggaccgtattcgagacggcgacggtcgggtcgtagggacaggtactttcctactttcacctactaccaccaacctcgacgacggactaggaaggttggtcggtacgttaagttttactacgttcgtactagtactaaacttacttagttacgttaccccttccgttaccttaccggttaccggtttaccggggacgggtaaccgggtaaccggtaacggggtacggtacgtaacgtaaccgtaaaacggtaacgttcggtacggtccgtacggacctacctacgtttaccgtcgttacccttacgttaccttcccgttaccccgtaccttacgttactaccggtactaccgttcgttacccg

SEQ ID NO: 52152 - DNA, 791 bp, Homo sapiens
  misc_feature: GYAE6OF01CUQ4Q.18.11.A11.1.454.CMB.1.raw
  modified_base (543)..(543): a, c, t, g, unknown or other
  misc_feature (543)..(543): n is a, c, g, or t
  modified_base (552)..(552): a, c, t, g, unknown or other
  misc_feature (552)..(552): n is a, c, g, or t
  modified_base (779)..(779): a, c, t, g, unknown or other
  misc_feature (779)..(779): n is a, c, g, or t
tcagtacgagtatgcacgaccggtgctcgatttagctacgactgcaggggcagcaagatggtgttgcagacccaggtcttcatttctctgttgctctggatctctggtgccggacggggacatcgtgatcgacccagtctccagacctcccgtggttgtgtctcgtgggcgaggacggccaccatcaactgacaacgtccagcctaagtagtttagttttaacacacgtcctaaccaaaactaaactaaaacctaaacttaccttagtacgtttacggaccagaccaaacgaaaaccgacggaaaccacccggtacccccgttaaacggtccctacttaaacgtttaccggtcgggtacctaacggttaccccgggtaacccccggggttacgggttccccccggggtccctacggtacccgtaacgttacggaacggacgggccgtacgggtcccggggttacggtacgggtaactaacgttacgtttccaaccgttccctaccgaaacctactacccgaaccctaaccgtgaccgaacggntaggaacgngtcggtagtacttagtttactactcgtacgacaacttaactacgttacttaccgtcccttctaccgtacggttaccggtaccgggggaacgaaccggggtaaccgtaaaggggtcgtaaacgtacgtaaaaccgtaaacggtccgtaggtaccggctaccgaccttaaccgtacgtttcccgttattccctacgtaccccgttcgtaccccctatacttaacccgtnaaaccttacccg

SEQ ID NO: 52153 - DNA, 691 bp, Homo sapiens
  misc_feature: GYAE6OF01EP60D.18.11.A11.1.454.CMB.1.raw
  modified_base (211)..(211): a, c, t, g, unknown or other
  misc_feature (211)..(211): n is a, c, g, or t
  modified_base (304)..(304): a, c, t, g, unknown or other
  misc_feature (304)..(304): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagacctccctggttgtgtctcgtgggcgagagggccaccatcaactgcaagtccagccagagttgttttanacagcctaccaaacaataaacctaactacttagtcttacggtaccagacaagaaaccaggaccacgaccccctaaggtcctactactttacgngggactacgtccggtaacccggggacggttcccgggggtccctggaacccgtattcgaggacggcgaggtcgggtcgtgggaacagtactttcgacctctaccaccatacccaaccctaaccgtcgaccgacggcgtaagaacgtagttcgggtacggtacttaaggttttacttaccgttagtaccgtaagtaacctaaattaccttaattaccgttcccttcccttactacgtaccgggttcgggaccgggaaggtaacccgtaagggtcggaacgtacgtaacaaacggtacgtcggtcggtccgtacgacccgtacgtacgtttcctacgttacctttcgaaccttccccgttacccgaccttaagtcctacgtaccttaacg

SEQ ID NO: 52154 - DNA, 613 bp, Homo sapiens
  misc_feature: GYAE6OF01EPONH.18.11.A11.1.454.CMB.1.raw
  modified_base (304)..(304): a, c, t, g, unknown or other
  misc_feature (304)..(304): n is a, c, g, or t
  modified_base (323)..(323): a, c, t, g, unknown or other
  misc_feature (323)..(323): n is a, c, g, or t
  modified_base (364)..(364): a, c, t, g, unknown or other
  misc_feature (364)..(364): n is a, c, g, or t
tcagtacgagtatgcacgaccggtgctcgatttagctacgactgcaggggcagcaagatggtgttgcagacccaggtcttcatttctctgttgctctggatctctggtgccggacggggacatcgtgatgacccagtctccagactccctggttgtgtctcgtgggcgagagggccaccatcaatgcaagtccagccagtagttgttttatacagctaccaaacaaataaaccaactacttagcttacggtaccagacaagaaaaccgaggaccaccgaccccctaaggtcctactatttacgnggcacgtccgtacccgggngtcccggggtccctgaccgattcgagcggcaggcgggtcgnggggcagtattcactctcaccataccaccaactgcaggctagaagtgtggtggtcttaatttactactgtacagtactaaattactattaccgtccctccttccgtacgttaccggtccgggacggaacgggaaccgtaagggtacgtaacgactaaccgaaacgtacgtggacgtctacgacctacgtcgttacgttcgttccttaccgtacttcccccgttcccacctaatcctacgtactaaccgg

SEQ ID NO: 52155 - DNA, 876 bp, Homo sapiens
  misc_feature: GYAE6OF01ES7TI.18.11.A11.1.454.CMB.1.raw
  modified_base (297)..(297): a, c, t, g, unknown or other
  misc_feature (297)..(297): n is a, c, g, or t
tcagtacgagtatgcacgaccggtgctcgatttagctacgactgcaggggcagcaagatggtgttgcagacccaggtcttcatttctctgttgctctggatctctggtgccggacggggacatcgtgatgacccagtctccagacctccctggttgtgtctcgtgggcgaggacgggccaccatcaactgacaagtccagccagagttgttttatacagcctaccaacaaataacaactacttagcttggtaccagacaagaaccaggacacgacccctaaggtcctactatttacngggacactccgtaccccggggacggttccccgggggtcccctaggtacccgagtttaccgacggaacgggccggacggtccgggggtcctacgggggaaccttaacggtaactttttaccgaacccttccgtaccaacccgtaacctaaccccaacccgtaaaaccccgttcgggaccgtaacggggtaccgttaagggtaaacggtacgttacgggaccggtttaacgttttaacggtttttaaccgtttaccgtttaccggtaaacggtccaaacgttaaaccgtttaaccgttaacggttaccccgtttaccccttccccgtttacccgttaacccgggtttaaccccggggttccggggggtaacccgggggtaaacccggggtaaaccggggttacggggtaacggggtaaacgttaccgtaaaacccggttaaaccgggttaacggtcgggtacggtaccggtacccggtaaccctaaccgtttaccgttagttcccggtttaacccgttcttaacccccggtttcccccgtacccgttacctacctttccgtaaccgtaaccgttaacccgg

SEQ ID NO: 52156 - DNA, 650 bp, Homo sapiens
  misc_feature: GYAE6OF01DKB5Y.18.11.A11.1.454.CMB.1.raw
  modified_base (211)..(211): a, c, t, g, unknown or other
  misc_feature (211)..(211): n is a, c, g, or t
  modified_base (286)..(286): a, c, t, g, unknown or other
  misc_feature (286)..(286): n is a, c, g, or t
  modified_base (332)..(332): a, c, t, g, unknown or other
  misc_feature (332)..(332): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctcgtgggcgaggagggccaccatcaactgcaagtccagccagagttgttttanacagctaccaacaataacaactacttagcttaggtaccagacaacgaaaccaggaccacgacccctaaggtcctnacttacgtggcactaccgtaccggacggtcccgggtcctcgacgtntcgagacggcacggcgggtcgtacgggacaaggtactttacacttactaccacctaactaccaacccaactcggacgacggtactagaacgtattcggtacggtacttaagttttacttaacgtgtacgaagtactaacttacttaattccgttaccctaccttcctaccgtaccgggttccgggacgggaacggtaaccggaaggtagggtacgtaacgtacgaaacggtacgtggtacgtaccgtgacctaccgtacgttcgttcgtacccttactaccgttcccttacccgtacctatccgtacgaacttaacgg

SEQ ID NO: 52157 - DNA, 648 bp, Homo sapiens
  misc_feature: GYAE6OF01DYM48.18.11.A11.1.454.CMB.1.raw
  modified_base (210)..(210): a, c, t, g, unknown or other
  misc_feature (210)..(210): n is a, c, g, or t
  modified_base (410)..(410): a, c, t, g, unknown or other
  misc_feature (410)..(410): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagacctccctggttgtgtctctgggcgagagggccaccatcaactgcaagtccagccagagttgttttanacagctaccaaacaataacaactacttagcttggtaccagcaagaaaccaggacacgccccctaaggtcctactactttacgtgggcatccgtacccggggaggttcccggggtccctgacccgattcgaggaggcaggcgggtcgtgggacagtatttcactctcgaccactccaaccaacctgacaggctagaacgtntgtaggacttaagtttatacttagtcaagacaattactattaccgtcctcctactctaccggttcgggacgggtaacggaacccgtaagggtacgggaacgtacgtaacgaaaaccggtacgttggtacggtactcggacctaacccgtaactttaccgttcggtttaccttaccgtaccgtttacccccgtttacccccggaccttactttaccgttacgtaaccgtttaaacccgg

SEQ ID NO: 52158 - DNA, 693 bp, Homo sapiens
  misc_feature: GYAE6OF01C28R7.18.11.A11.1.454.CMB.1.raw
  modified_base (214)..(214): a, c, t, g, unknown or other
  misc_feature (214)..(214): n is a, c, g, or t
  modified_base (353)..(353): a, c, t, g, unknown or other
  misc_feature (353)..(353): n is a, c, g, or t
tcagtacgagtatgcacgaccggtgctcgatttagctacgactgcaggggcagcaagatggtgttgcagacccaggtcttcatttctctgttgctctggatctctggtgccggacggggacatcggtgatcgacccagtctccagacctcctggttgtgtctcgtgggcgagacgggccaccatcaactgcaagtccagccagtagttgtttanacagctacaaacaataacactacttagcttggacagacagaaaccaggacaccgacccctaaggtcctactattacgtggctactccgaccgggacggtcccggggtcctggaccgtattcgagaggcgaggcgggtcngggacaggtactttccgaacttctaccacctactaccaaccctaaccgtgacgacggactagtaacggtagttgggtacgtacttaagttttaacgttacgttcggtactaaggtaactaacttaacttaattaccgttccctccgttactaccgtacgggttaccgggccgggaaggggtaccctaaaggggtcggaacggattaacccggaaaacgttaacgtcgggttacggtacctacggacccttaaacccgtacgtttaccgttcggttacccgttacccttaaccgtttccccttccccggaccgttaactcccgttaacgtaaccctaaccg

SEQ ID NO: 52159 - DNA, 711 bp, Homo sapiens
  misc_feature: GYAE6OF01A6JU2.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctcgtgggcgagacgggccaccatcaactgacaacgtccagccagtagttgttttaactacagctaccaaacaataaccaactacttagcttcggtaccagcaacgaaaccaggaccacgaccccgtaaggtcctactatttacgtcgggctacgtccgtaacccgggggtacggttccccgggggtcccctcgggaacccgtacgttaccgaacggacgggccgtaacgggtccggggtacgtacggggaactaaggtacttttaccaccgttcctaccacctactaccaaccctaaccgtcgacgaggtcctaggaacgtagtcggtacggtacttaagttttactacgttcgtacacgtactaaatacttaagtccgttccctacccttctaaccggttcggttaccgggacgggtaaccgggaacgtaaggggtcggaacgtaacttaaccggaaacgtacgtaggtcggtactcgacctaccgtagttccgtacggttctacctaccgttcccgttaccccggacttaggttccctaagtaccttaccg

SEQ ID NO: 52160 - DNA, 544 bp, Homo sapiens
  misc_feature: GYAE6OF01B570A.18.11.A11.1.454.CMB.1.raw
  modified_base (403)..(403): a, c, t, g, unknown or other
  misc_feature (403)..(403): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctaccaacaataacaactactagcttggtaccagcaagaaaccaggaccacgaccccctaaggtcctactatttacgtgggcatccgtacccgggacggtcccggggtaccctggaccgtagttcgagaggcgaggcgggtctgggacagtactttcactctacacatccaccaactgacaggctagaagntgtgactagtttactacgtagtacagacatactatacgtcctcctctctacggtcggcgacggaccaggtagagactacaacgtatgtgctgaccactcgtctcgttctctacttcccgtacccgctatcctgtactaacg

SEQ ID NO: 52161 - DNA, 730 bp, Homo sapiens
  misc_feature: GYAE6OF01D8DGV.18.11.A11.1.454.CMB.1.raw
  modified_base (220)..(220): a, c, t, g, unknown or other
  misc_feature (220)..(220): n is a, c, g, or t
tcagtacgagtatgcacgaccggtgctcgatttagctacgactgcaggggcagcaagatggtgttgcagacccaggtcttcatttctctgttgctctggatctctggtgccgacgggacatcgtgatgacccagtctccagacctccctggttgtgtctcgtgggcgaggacgggcccaccatacaactgacaacgtccagccagtagtttgtttttaanacagcctaccaaaacaaactaaaccaacttacttagtcgtttacggtaccagacaacgaaacccgaggacccaaccgaccccccgttaaaggtccctactaactttacgtcggctacgtccggtacccggggtcggttcccggggtccctacggaccgtagttccgaaggacggcgacggtcgggtacgtagggactagttacttcactctaccaccactaccaacctaccgtcgacgtacggactaggaacgtagtcggtcggtacttaacgttttaacgtacgttcgtacgaagtacgtaacttaacttacgttccttcccttcctacgttaccggttaccggttaccgggacgggtaacgggtaaccggtaagggtacggtaacgtaaccgttaaccgaaacggtacggttacggtcggtacgtaccgactaaccgtcttaccgttcggtttaccttcctaccgtttccccttacccggtaccttaagttccgtaactaccgttacg

SEQ ID NO: 52162 - DNA, 838 bp, Homo sapiens
  misc_feature: GYAE6OF01A5W1S.18.11.A11.1.454.CMB.1.raw
  modified_base (212)..(212): a, c, t, g, unknown or other
  misc_feature (212)..(212): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtcgtctcgtgggcgaggagggccacatcaactgcaacgtccagccagtagttgtttanacagctaccaaacaaataacaacttacttacgcttaggtaaccagacaagaaaccacggaacacgacccccttaaaggtcccttactaactttaccgtaggggaccacgttaccgtaaccccgggggacggttccccgggggtaccccttcggaacccggacttttaccgaaggtacgggaccgtacgggtccggggttaccgtacgggggaactaacggtaacgttttcccgaaccttccgttaccaaccgtactaccgtaacccaaacccgtacgtaccgaacgggtacctaaggaaacgtacgttcgggtacgggtaaccgttacggttttaaactttaccgttacggttaccgaaggacctaaaacgttaccttaaacgttaccgttacccgtttccccttaccggttaccgtaaccgggtttccggggaacgggtaacgggtaaaccggtaacgggtacggggtaacgaaaccttaaccggaaaaccggttaacgttacgggtacgggtaaccttccggaacccgtaccgtaaactttccggttacttcccggttaaccctaccgtttaccccgttaccccggaacctaaccgtttacgtaacggtaacccttaaacccgg

SEQ ID NO: 52163 - DNA, 663 bp, Homo sapiens
  misc_feature: GYAE6OF01EXRVA.18.11.A11.1.454.CMB.1.raw
  modified_base (300)..(300): a, c, t, g, unknown or other
  misc_feature (300)..(300): n is a, c, g, or t
  modified_base (332)..(332): a, c, t, g, unknown or other
  misc_feature (332)..(332): n is a, c, g, or t
  modified_base (344)..(344): a, c, t, g, unknown or other
  misc_feature (344)..(344): n is a, c, g, or t
tcagtacgagtatgcacgaccggtgctcgatttagctacgactgcaggggcgagcaagatggtgttgcagacccaggtcttcatttctctgttgctctggatctctggtgccggacgggacatcgtgatgacccagtctccagacctccctggttgtgtctcgtgggcgagagggccaccatcaactgcaagtccagccaagtagttgtttttaatacagcctaccaaacaaataacaaactacttagcttggaccagcaagaaaccaggaccacgcccctaaaggtcctacaatttcgnggaccatccgtaccgggacgtcccggggtccngaccgtatcagngcaggccggtctgggacagtatttcactcctacacactccaaccaaccgtgaccgaggctaaggaacggtataggtacggtcttaaacgtttagtttacctcgttaccgataactaaattaccgtaattacccgttaccctaccgttccgtacgttaccggttaccgggacgggaaaccgggtaccggtaaacgggtgggaataaccgtaaacgtaaaccgaaccgttggtacggtaccgtacgaccgaccttattacggttcctttacttaccctaacttccccgttaaccccgacctaattcccgtagaccctaaag

SEQ ID NO: 52164 - DNA, 588 bp, Homo sapiens
  misc_feature: GYAE6OF01BNBGI.18.11.A11.1.454.CMB.1.raw
  modified_base (208)..(208): a, c, t, g, unknown or other
  misc_feature (208)..(208): n is a, c, g, or t
  modified_base (383)..(383): a, c, t, g, unknown or other
  misc_feature (383)..(383): n is a, c, g, or t
  modified_base (388)..(388): a, c, t, g, unknown or other
  misc_feature (388)..(388): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttanacagctccaaacaataacaactacttagcttggtaccagcaagaaaccaggacagcccctaaggtcctacatttacgtgggcatccgtaccggggagtcccggggtccctgaccgattcgagacggcaggcggtctgggacagtattcactctacacatcaaccaacctgacagntgaanatggtggactaagtttactactgtacagtactaaatactaatacgtcccttctctaccgacgtttcgggacggaacggacccgtaaaggtcgggaagaataaccgaaacggtaacctggtggcctagacctaacctacgttctaggttccttaccgaagtttccccttaccccgacctaattccgtacgaaccgttaacg

SEQ ID NO: 52165 - DNA, 763 bp, Homo sapiens
  misc_feature: GYAE6OF01BMZV2.18.11.A11.1.454.CMB.1.raw
  modified_base (210)..(210): a, c, t, g, unknown or other
  misc_feature (210)..(210): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctcgtgggcgagagggccaccatcaactgcaagtccagccagagttgttttanacagctaccaacaataacaactacttagcttaggaccagacaagaaaccaggaccacgaccccctaaggtcctactatttacgtgggactacgtccggtacccggggacggttcccggggtccctggaccgtattcgaggacggcgaggtccggggtacgtaggggaactaggtactttccgaccttctaccgaacctactacccaacccgtaaccgtcggaccgtacggacgtaacggaagtacgttgggtacggtacttaacgtttttacttaacgttcggtactaacggtacttaaacttaaccttaacgttacccgttacccctttaccccgttaccgttaacccggttaccggggtttacccgggaacggggtaaccgggtaaccggtaaggggttacggtaacggtaacttaaaccgggaaaccgtacggttcgggtacggtacgtaccggtaccgtaaccgtaccgtttaccgttcgttcccgtttaccgtaccgtttccccgttaccccgtaccgtacgtttccctacggttaaccttaacccgg

SEQ ID NO: 52166 - DNA, 824 bp, Homo sapiens
  misc_feature: GYAE6OF01AOZJP.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtgccggacggggacatcgtgatcgacccagtcctaccagacctcccgttggttgtcgtctcgtgggcgaggacgggcccaaccatcaactgacaacgtccagcctagtagttgttttacacagcctaccaaaactaataaccaacttacgttacgtcgtttacggaccacgaccaaacgaaaaccgacggaacctaccggacccccttaaggtcctacgttaagtttaccgtgggtaccaccgttaccggtaaccccggggtacgggttccccggggtaccgtcggtaacttccggtaacgttcgaacgggcgggtaccgtacggggccggggtttacgggtacgggtaaccgtaacggttaacttttacccgaaccttacccgtaccgtaacccgtaacccttacccgaaacccctacccggtagaaccggacggtacgtaagggtaacgtacggtttacgggttacgttaccggttttaagttttaaccgtttaccgtacgtaaccggaacgttaactaatttaacccttaagttaccccgtttacccttcccttaccggttacgttacccgggtcgggtaaccggaaccgggtaacggagggtacggaacgtacgtaaacgaacggttgtaccggtcggtaccacgaccgtacccgtagttacttccgttcttacccgtacttacccgtacccttcgacctttcgctaaacccg

SEQ ID NO: 52167 - DNA, 881 bp, Homo sapiens
  misc_feature: GYAE6OF01CQBRN.18.11.A11.1.454.CMB.1.raw
  modified_base (212)..(212): a, c, t, g, unknown or other
  misc_feature (212)..(212): n is a, c, g, or t
  modified_base (225)..(225): a, c, t, g, unknown or other
  misc_feature (225)..(225): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagaccttcctggttgtgtctgtgggcgaggagggccaccatcaactgcaagtccagccagtagttgttttanacagctaccaaanaataacaactacttagcttggtaccagcaagaaaccaggaccacgtacccccgtaaaggtcctactaagtttaccgtgggacctaacgttccggtaccccggggtaagggttcccccggggttaccctacggaacccggttagtttaacccggagggtaacgggtccgaacggggtccggggttccgttacgggggaactacgggttaacttttccgaaccgtttcctaaccctaacctaacgttacccccgaaacccttaaaccctcgggacccgtaacgggacctttaacgggaaaagtacgttacgggtacggttaaccgttttaagggttttaaccgtttaacgtacggtttaaccgtaacggtaaccttaaaacgttaccgttaaacgtttcgttacccccgttaccgtttacccgttaccggtaaccggtttacccggggacggggtaaaccgggtacccgttaaaggggtacggggtaacgtaaccgtttaaacggaaaacccggtacgttaagggtccgggtactacccgggtaccctaacccggttacgtttaccgttaaccggtttcccttaccgttaaaccgtttccccccggttacccccggaacccttaactttcccccgttaagaacccgttttaaaccccg

SEQ ID NO: 52168 - DNA, 647 bp, Homo sapiens
  misc_feature: GYAE6OF01AQR7B.18.11.A11.1.454.CMB.1.raw
  modified_base (370)..(370): a, c, t, g, unknown or other
  misc_feature (370)..(370): n is a, c, g, or t
  modified_base (459)..(459): a, c, t, g, unknown or other
  misc_feature (459)..(459): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctcgtgggcgaggagggccaccatcaactgacaagtccagccagtagttgttttatacacgctaccaacaataaccaacttacttagcttggaccagcaacgaaaccaggaccacgcccccctaaggtccctactatttaccgtgggtcacgtccgtacccggggacgtcccggggtcctacggaccgtatcgaggcggcgacggtcggtcgngggactacgtactttcactctccacctactccaccctaaccgtgacgcggacgtagaagcgttggcgtacttagtttacttcgtgtacncgtactaatacttacgttacgtcccttcctctaccgtacggttcgggacgggtacggaaccggtaggacgtaacgaactacgaaacgtacgtgtcgggctacggcccaaccgttgttacccggttcttcccttaccgtaccgtttccccgttaccccgtacttaccgttcttaccgaacttaacccgg

SEQ ID NO: 52169 - DNA, 549 bp, Homo sapiens
  misc_feature: GYAE6OF01AV008.18.11.A11.1.454.CMB.1.raw
  modified_base (353)..(353): a, c, t, g, unknown or other
  misc_feature (353)..(353): n is a, c, g, or t
  modified_base (371)..(371): a, c, t, g, unknown or other
  misc_feature (371)..(371): n is a, c, g, or t
  modified_base (377)..(377): a, c, t, g, unknown or other
  misc_feature (377)..(377): n is a, c, g, or t
  modified_base (386)..(386): a, c, t, g, unknown or other
  misc_feature (386)..(386): n is a, c, g, or t
  modified_base (390)..(390): a, c, t, g, unknown or other
  misc_feature (390)..(390): n is a, c, g, or t
  modified_base (398)..(398): a, c, t, g, unknown or other
  misc_feature (398)..(398): n is a, c, g, or t
  modified_base (417)..(417): a, c, t, g, unknown or other
  misc_feature (417)..(417): n is a, c, g, or t
  modified_base (496)..(496): a, c, t, g, unknown or other
  misc_feature (496)..(496): n is a, c, g, or t
  modified_base (501)..(501): a, c, t, g, unknown or other
  misc_feature (501)..(501): n is a, c, g, or t
  modified_base (511)..(511): a, c, t, g, unknown or other
  misc_feature (511)..(511): n is a, c, g, or t
  modified_base (524)..(524): a, c, t, g, unknown or other
  misc_feature (524)..(524): n is a, c, g, or t
  modified_base (534)..(534): a, c, t, g, unknown or other
  misc_feature (534)..(534): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctcgtgggcgagagggccaccatcaactgcaagtccagccagagttgttttaatacagctaccaaacaataaccaactacttagcttggtaccagacaagaaccaggacacgacccctaaggtcctcatttactggcactccgtacccgggacgtcccggggtccctgaccgattcgaggacgcgacggcgggtcngggacagtacttcactcncaccanaccaccacncgcngcagagtntggtgctagtttatacgtntacagtacaatactatcgtcctccctctcgtacggttcggacggaggaaccgtaggtggaagactaacgaacacgtcgngctanaccgtacgtntcgtacgtctacncttcctcccnctatcctgtactacg

SEQ ID NO: 52170 - DNA, 570 bp, Homo sapiens
  misc_feature: GYAE6OF01BBX0N.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaaacaataacaactacttagcttggtaccagcaagaaaccaggaccacgccccctaaggtcctacatttactgggcagtccgtacccgggagtcccggggtccctgaccgattcgaggaggcaggcgggtcgtgggacagtactttcactctacacctatcaaccaacctgcaggcctagaacatggtggacttagttttacttacgtgtcaagtactaaattactatacgtcctacctctacgacgttcgggcggaacgggtaccaagggtcggaatagtaccgaaacgtactggtaggctgacctaccgtctctcgtccttcacttccgtcccgactattcctagtctaacg

SEQ ID NO: 52171 - DNA, 974 bp, Homo sapiens
  misc_feature: GYAE6OF01DY3Q2.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtcggccgacgggacatcgtgatcgaccctagtcctccagcctccctggttgtcgtctcgtgggcgaggagggccacgatcaactgacaacgtccagccgagtagtttagttttaactacgacgtcctaccaaactaaactaaacctaactacttacgtcgtttacggaccagacaacgaaaaccgacgaccaccgacccccgttacgtaccctactactttacgtcggtactaccggtacccggtacccgggtaccgggtaccccggggtaccccgtacgtacgttacgacggacggacgaacgggtccgggtcgtacggggaactaacggtactttactaccgtcctaccctaacctacctaaccctaaaccctaaccgttacgggaccgaacgggttacgtaacggtaaacgggtacgtttcggggttaaggaaccgtttttaaggttttaaacgtttacccgtaggtaaacccccgttaaggtaaaccctttaaaagttacccttttaaaacgggttcccctttaacccccccgttccgggttttaacccctttaaaccccgggggtttaccgggttttaaccccgggggggaaacccgggttaacccgggggggtttaaaacccgaacggggggggttttaaggaaacgtttaaaccccggtaaaacgggttaaaaacccccgtgggtttttaacgggccccgggtaaacccttaaccgggaccccgttaaaccctttgggttaaacccggtttttaccccggttttccccgttttaaacaaccccgttttccccccgtttaaaccccgcctttaacggtaaccccggtttaaccctaaactttaaccggtttaacccccggg

SEQ ID NO: 52172 - DNA, 728 bp, Homo sapiens
  misc_feature: GYAE6OF01DN61G.18.11.A11.1.454.CMB.1.raw
  modified_base (303)..(303): a, c, t, g, unknown or other
  misc_feature (303)..(303): n is a, c, g, or t
  modified_base (653)..(653): a, c, t, g, unknown or other
  misc_feature (653)..(653): n is a, c, g, or t
  modified_base (668)..(668): a, c, t, g, unknown or other
  misc_feature (668)..(668): n is a, c, g, or t
tcagtacgagtatgcacgaccggtgctcgatttagctacgactgcaggggcagcaagatggtgttgcagacccaggtcttcatttctctgttgctctggatctctggtgccggacggggacatcgtgatgacccagtctccagacctcctggttgtgtctcgtgggcgagcggccacatcaactgcaagtccagccagtagttgttttacacagcctacaaacaataacaactacttagcttaggtaccagacaagaaaccaggaaccaaccgtaccccctaaggtcctactaacgtttacgngggacctagtacccggtaaccccggggacggttccccgggggtccctacggaacccgtagttaccgaacggtacgggaccgacgggtccgggttaccgtacggggaactaggttacttttaccgaccttcctacccaaccgtaactacccaacccgtaacctggaccgagggtactaaggaagtacgtgggttacgtaccgttaaggttttacttaacgttgtacctaaaggtactaaattacgttaagttaccgttccccttacttccgtacggtacggtttccggggacgggaacgggtaaccggaaggggtacggtaacgaactaacggaaaccgtactgggtaccncgtacgaccaccgtntacgttcgttacgttacctccgttccccgttaccccgcttagtacctcgtaacttaaccg

SEQ ID NO: 52173 - DNA, 821 bp, Homo sapiens
  misc_feature: GYAE6OF01E5PV7.18.11.A11.1.454.CMB.1.raw
  modified_base (223)..(223): a, c, t, g, unknown or other
  misc_feature (223)..(223): n is a, c, g, or t
tcagtacgagtatgcacgaccggtgctcgatttagctacgactgcaggggcagcaagatggtgttgcagacccaggtcttcatttctctgttgctctggatctctggtgccggacggggacatcgtgatcgacccagtcctccagacctccctgggttgtgtctcgtgggcgaggacgggccaaccatacaactgacaacgtccagaccagtagttgtttaanacagcctaccaaactaactaactaacttacttagtccgttacggtaccagacgaacgaaaccgaggaccacgtacccccgtaaggtcctactacttacgtcgggcctacgtacccggtacccggggtaccggtcccggggttacccgtacggtacccgtagtaccgaggacgggaccgtagggtccgggtacggtacgggactacggttacttccgtacgttacctaccacctactaccctaacccgtaacctacggacgtacggtacgtaaggtaacggtacgttcgggtacggttactttaagttttaaccgttacgttacggtaccgaaacggtaccttaaaacgtttaccgttaacgttaacccgtcccccgtttacttacccgtaccggtttacccggggttacccggggaacggggtaaccgggtaaaccgtacgggggtaggtaaccgttaaacggtaaacccggtaaaccggtacgggttacggcggtaccgttcccggaaccttaacccgtacctttaccggttacgttacccttacgtaccctttccccgtaccccggtctaaccgtcgtaaacgtaccttaacccgg

SEQ ID NO: 52174 - DNA, 617 bp, Homo sapiens
  misc_feature: GYAE6OF01DTVVC.18.11.A11.1.454.CMB.1.raw
  modified_base (210)..(210): a, c, t, g, unknown or other
  misc_feature (210)..(210): n is a, c, g, or t
  modified_base (291)..(291): a, c, t, g, unknown or other
  misc_feature (291)..(291): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctcgtgggcgagagggccaccatcaactgcaagtccagccagagttgttttanacagctaccaacaataacaactacttagcttgtaccagacaagaaaccaggacacgaccccctaaggtcctacatttacgnggctacgtccgtacccggggagtcccggggtcctaggaccgattcgagaggcaggcggtcgtagggacagtactttcaactcgtaccacctataccaaccaacctgaccgaggtctaggaagtcgtggtaggacttaaggttttactacgtgtacgacgactaaacgttactaagttaccgtcccttacccttcgtaccgtacggttccgggacgggaacgggtaaccgtaagggtaggactaacgtaacgaaacgtacgtggtacgcgtcgaccaccgtattctcggttcttaccgtacttcccgtcccactacttcacgatacg

SEQ ID NO: 52175 - DNA, 824 bp, Homo sapiens
  misc_feature: GYAE6OF01BJ1QE.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtcgccggacgggacatcgtgatcgaccagtctccagacctcctggttgtgtctcgtgggcgaggacggccaccatccaactgacaacgtccgagccagtagtttgtttttaacacacgtacctaaccaaaactaaactaaacctaacttacgttacgtacgtttacggtaaccagacctaaacggaaacccgacggaaccctaacccggtaccccccgttaaggtcccttacgttaacgttttaccggtacgggtacctaccgttacccggtaacccgggggtaccggttaccccggggtccctaggacccgtacttcggaaggacggtacgacgggtccggtacgtacgggacctagttacttcacttccacctaccaacgttacccaacccgtaacgtcgacgtacggtactaagggtaacgtagttacggtcgggttaactttaagtttttacttaacgtacggtaccaaggtaaccttaaagtttacccttaacgttacccgttcccgttacccttcggttaacccgtacggggttacccgggaacgggtaaccggaaccggttaaggggtacgtaacgttaaccgtaaacgtaaaccggtagttcggtaggtaccgttacgaaccgtaccgttacgttccgttaccggtttacctacccgttcccgttaccccgttacccgtactactttacccgtagttacccttaaccgg

SEQ ID NO: 52176 - DNA, 770 bp, Homo sapiens
  misc_feature: GYAE6OF01B69AP.18.11.A11.1.454.CMB.1.raw
  modified_base (215)..(215): a, c, t, g, unknown or other
  misc_feature (215)..(215): n is a, c, g, or t
  modified_base (302)..(302): a, c, t, g, unknown or other
  misc_feature (302)..(302): n is a, c, g, or t
tcagtacgagtatgcacgaccggtgctcgatttagctacgactgcagggggcagcaagatggtgttgcagacccaggtcttcatttctctgttgctctggatctctggtgccggacggggacatcgtgatgacccagtcctccagacctccctggttgtgtctcgtgggcgagacgggccaccatcaactgcaagtccagccagagttgttttanacagcctaccaaacaataaccaactacttagcttaggtaccagcaacgaaaccaggaccacgacccctaaggtcctactacttacgngggcacgttccggtacccggggtaggttcccggggtccctacggaccgtacttccgaaggacgggacacgggtcggggtacgtggggaactacggtactttcctaactcgtaccaaccactacccaaccaaccgttggacgtacggtctacggaacgagttggtacggtaccttaagtttttacctacgttcgtaacgtacgtaactaaacgttaccttaacgttaaccgttcccccttaccgtttacccgttaccggttacccgggtttcccggggaacggggtaacccggggtaacccgtaaaggggtacggggtaaaccggtaacttaaaccggtaaaacccgggtaagtttcgggtaccggtaccgttacgaccccgttaaccgtacgtttacccgtcggtttaccttaccgtaacccgtttccgttaccccgtactaacgtttcccgttaagacctttaaccg

SEQ ID NO: 52177 - DNA, 766 bp, Homo sapiens
  misc_feature: GYAE6OF01DN60F.18.11.A11.1.454.CMB.1.raw
  modified_base (216)..(216): a, c, t, g, unknown or other
  misc_feature (216)..(216): n is a, c, g, or t
  modified_base (318)..(318): a, c, t, g, unknown or other
  misc_feature (318)..(318): n is a, c, g, or t
tcagtacgagtatgcacgaccggtgctcgatttagctacgactgcaggggcagcaagatggtgttgcagacccaggtcttcatttctctgttgctctggatctctggtgccggacgggacatcgtgatcgacccagtcctccagacctccctggttgtgtctcgtgggcgaggacggccaccatcaactcgacaagtccagccagtagttgtttanacagacctaccaaacaaactaactaacttacttagcttacggtaccaagacaacgaaaccgacggaaccaccgacccccgttaaggtcctactactttacgnggactacgtccggtacccgggacggtcccggggtacctacggaccgtactcgaggacggcgacgggtccggtacgtacgggaactaggttactttaccaccttacccgtacccaaccgtaacctacccaaccccgtaacccgtcggaaccgacggtacgtaaggaaacgttggttacggttacggaccgtttaagttttaaccttaacgttacgtaacgaagttaacctaacttacctttaacgttaccgttacccctcccgttaccgttaccggttaccgggttaccggggacggggtaaaccgggtaaccggtaagggtacggaacgtaacgttaaaccgaaacggttaccggtggttaacgaccgtacgtacccaacgtcttccgtttagtcccttaacttcccgttcccgttaccccacttaacgttcaaccgttacgtaaccg

SEQ ID NO: 52178 - DNA, 562 bp, Homo sapiens
  misc_feature: GYAE6OF01BFC4I.18.11.A11.1.454.CMB.1.raw
  modified_base (208)..(208): a, c, t, g, unknown or other
  misc_feature (208)..(208): n is a, c, g, or t
  modified_base (285)..(285): a, c, t, g, unknown or other
  misc_feature (285)..(285): n is a, c, g, or t
  modified_base (352)..(352): a, c, t, g, unknown or other
  misc_feature (352)..(352): n is a, c, g, or t
  modified_base (369)..(369): a, c, t, g, unknown or other
  misc_feature (369)..(369): n is a, c, g, or t
  modified_base (514)..(514): a, c, t, g, unknown or other
  misc_feature (514)..(514): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttanacagctccaaacaataacaactacttagcttggaccagcaagaaaccaggacacgccccctaaggtcctcatttacngggcatcgtacccggggagtcccggggtccctggacccgattcgaggaggcaggcgggtctgggacngtatttcactctcaccntaccaccaactgcaggctagaagatggtggctagtttatacgtgtcagacaattactatacgtccctctctcgtacgttccgggacgggacggaaccgtaaggtcggaagtactacgaaacgtactggtacggctgaccaccgtnttctcgttccttacgacttcccgttacccgctatcctcgacttaaccg

SEQ ID NO: 52179 - DNA, 894 bp, Homo sapiens
  misc_feature: GYAE6OF01B6ROF.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtcgccggacggggacatcggtgatcgacccagtcctccgagtcctcccgtggttgtcgtcgtcgtggggcgacggacggcccaaccataccaactcgaccaacgtcccgaagcctaaggtagtttgttttaacacgacgtaccttaaccaaaactaaactaaacctaaacgtttaaccttaggtaccgtttaacggggtaaccaacggaaccaaaacggaaaaccccgagggtaacccacccgtaacccccggttaaacggttcccttaagtaacgtttacggtacggggtacctacccgttacccggggtaacccggggtccgggttaccccggggtcccgttaacggaaccgttaacgttacggaaacggggtacggccggacggggtaccggggtacgttaacgggaaccgtttactaacgttttcccaaccgtttacacccaaaccttacgaacccaaacccttaaccgtcgaaccggtaacggtacccgttaagaacggtagttacggtaccggttaagtttacgtttaacgttacgttacggtaactaacggtaaacctaaacttaacgtaacgtttacccgtacctttaccctacggttaccggttaacgggtacccgggtacgggaaaccgggtaaccgggtaacgggtaacggtaacgtaaaccgtaacgtaaaccggttagtacggtaacgtccgtaaccggcctaacgtcttacggttactccttacccgttaccttcccggttaccctacgttaactccgtaacgtaactacccg

SEQ ID NO: 52180 - DNA, 799 bp, Homo sapiens
  misc_feature: GYAE6OF01CZVCK.18.11.A11.1.454.CMB.1.raw
  modified_base (215)..(215): a, c, t, g, unknown or other
  misc_feature (215)..(215): n is a, c, g, or t
tcagtacgagtatgcacgaccggtgctcgatttagctacgactgcaggggcagcaagatggtgttgcagacccaggtcttcatttctctgttgctctggatctctggtgccggacggggacatcgtgatcgacccagtcctccagacctccctggttgtgtctcgtgggcgagacgggccacatcaactgcaacgtccagccagtagttgtttanacacgcctaccaacaaactaaacctaacttacttacgcgttggtacccagacaacgaaaaccgacggaccaaccgtacccccgtaacggtcctactaacgtttacgtcgggactaacgtccggtaaccccggggtacggtccccgggttccgtacggaacccgtacttcgaggacggacgacggcggggtactaggggactaacgtcgtttaccacgtcctacctaaccctacttacccaacccgtaaccctcgggacgaacggtactaagggtaaacgtgttacgggtacggtacgtttaaacgttttacttaacgtcgtacaacgtaaccttaacttacgtaacgttacccgttacctcccgtttaccgtccggttacccgggttacggggaccgggtaaaccgggtaaccggtaaggggttacggaagttaaccggtaaaccgtaaaccggttacgttacgggtaaccggtccgtacggtaacccctaacggtacgtttccgttacgttaacccgtttccttaacccgttacccccgttaccccgtaccttaccggtttacgtcccgtaaaccttacccgg

SEQ ID NO: 52181 - DNA, 586 bp, Homo sapiens
  misc_feature: GYAE6OF01C3AUJ.18.11.A11.1.454.CMB.1.raw
  modified_base (169)..(169): a, c, t, g, unknown or other
  misc_feature (169)..(169): n is a, c, g, or t
  modified_base (288)..(288): a, c, t, g, unknown or other
  misc_feature (288)..(288): n is a, c, g, or t
  modified_base (531)..(531): a, c, t, g, unknown or other
  misc_feature (531)..(531): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagngggccaccatcaactgcaagtccagccagagttgtttatacagcctaccaacaataacaactacttagcttggtaccagcacgaaaccaggacacgccccctaaggtcctcatttacgnggcatccgtacccgggagtcccgggtcctcgaccgtattcagacgcaggcggtcgtgggacagtattcgactctacaccatccacctaacctgcaggtctagaagtatggtacggcttaagttttactacgtgtacagtactaattacctaattacgtccctccttccgtccgtacggtccgggacgggaacggaccgaagggtcgaagactacgaaacgtacgtgtacgctcgacctacgtnttcgtcgtttacctccgtacttcccgttaccccgactattcctagtaactaaccg

SEQ ID NO: 52182 - DNA, 642 bp, Homo sapiens
  misc_feature: GYAE6OF01CUL5E.18.11.A11.1.454.CMB.1.raw
  modified_base (211)..(211): a, c, t, g, unknown or other
  misc_feature (211)..(211): n is a, c, g, or t
  modified_base (347)..(347): a, c, t, g, unknown or other
  misc_feature (347)..(347): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagacctccctggttgtgtctctgggcgagagggccaccatcaactgcaagtccagccagtagttgttttanacagtctaccaacaataacaactacttagcttggtaccagcaagaaaccaggacacgccccctaagtcctctactttactggcatccgtacccgggagtccgggtccctgaccgattcagtaggcgagtcgggtcngggacagtatttacacgtctacaccataccaacctaaccgtgaccgaggtctacgaagtacgtcggtacggtccttaagtttacttacgtagtacaacgtactaaattacctaattaccgtcccctaccgttccttacgtaccggtttaccgggacgggtaacgggtaccgaagggttacggaagtaaccgtaacgaaaccggtacgtaggtacggccgtacgccaaccgttcgtcgttacgttccttacccgtacttacccgttccccgaccctattacctgtaaccttaaccg

SEQ ID NO: 52183 - DNA, 748 bp, Homo sapiens
  misc_feature: GYAE6OF01B616F.18.11.A11.1.454.CMB.1.raw
  modified_base (219)..(219): a, c, t, g, unknown or other
  misc_feature (219)..(219): n is a, c, g, or t
  modified_base (307)..(307): a, c, t, g, unknown or other
  misc_feature (307)..(307): n is a, c, g, or t
  modified_base (729)..(729): a, c, t, g, unknown or other
  misc_feature (729)..(729): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatcgacccagtcctccagacctcccgtggttgtgtctcgtgggcgaggacggccaccatacaactgacaagtccagccagtagttagttttanacagctaaccaaacaaataacaacttacttagcttcggaccagacaacgaaaccaggacacgaccccgtaagtcctatacgtttacgnggactacgtaccgtacccgggggtacgttcccggggtaccctacgaccgtacttacgaaggacggcgacgggtcgggttacgtacgggaacctagttactttaccgaccttccgtacccaacctaacgtaccccaaccctaacccgtcgaccgtacggtacgtagaaacgtcgttgggttaccggttacttaaggttttacttaccgtagttaccgaacgtaaccttaaaggttaaccttacgttacccgttacccgttacccgttaccgttaacccggtaaccgggtttccggggaacggggtaaccgggaaccgggtaaagggtaccgggttaagtaaaccggttaaccgtaaaacggtgttacggcggtatccgaacgtaacctggttacctcggtttccctacgaccttcccgtaccncgaattcacgtaactaccg

SEQ ID NO: 52184 - DNA, 699 bp, Homo sapiens
  misc_feature: GYAE6OF01DSJVZ.18.11.A11.1.454.CMB.1.raw
  modified_base (212)..(212): a, c, t, g, unknown or other
  misc_feature (212)..(212): n is a, c, g, or t
  modified_base (219)..(219): a, c, t, g, unknown or other
  misc_feature (219)..(219): n is a, c, g, or t
  modified_base (380)..(380): a, c, t, g, unknown or other
  misc_feature (380)..(380): n is a, c, g, or t
tcagtacgagtatgcacgaccggtgctcgatttagctacgactgcaggggcagcaagatggtgttgcagacccaggtcttcatttctctgttgctctggatctctggtgccggacggggacatcgtgatgacccagtctccagacctcccgtggttgtcgtctcgtgggcgaggagggcccaacatcaactgacaagtccagccagtagttntttttanacagacctaccaaactaaactaacaaacttacttagcgttacggtaaccagacaaacggaaaaccacggaaccaccgacccccgttaaaggtcctacgtatttacgcggactacgtccgtacccggggacgttcccgggcctaggaccgtatcgaggaggngacggtcgggtactagggactaagtacttcaactcacgaccatcagcactccgtggacgtactaggtaagtattttcgacttagtttaacttacgttagtaaccaaacgtaacggtcgacctaacgtccgaccgtaccgtacctacccggttacgggacccggaacgggtaccgaaccggtacggtaagggtaacggttaaacttaaacccgggtaggttacggcgggtacctacggaaccctaaccgttaagttccgttagttccctttacgaccttcccgtacccgtactacccgtatacggtaaccacgtttaccg

SEQ ID NO: 52185 - DNA, 515 bp, Homo sapiens
  misc_feature: GYAE6OF01A0RQU.18.11.A11.1.454.CMB.1.raw
  modified_base (472)..(472): a, c, t, g, unknown or other
  misc_feature (472)..(472): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggaccagcaagaaaccaggacagccccctaaggtcctcatttactgggcatcgtacccgggagttcccggggtccctggaccgattcgaggaggcagcgggtctgggacagatttcactctcaccatcaccaactgacaggctgaagatgtggactagtttatactgtacagtacaatactatagtcctcctctcacgttcggcggaaggaccaggtgagatacgaacgactgngctagccactatctgtcttcacttcctcccgcatctagctacg

SEQ ID NO: 52186 - DNA, 681 bp, Homo sapiens
  misc_feature: GYAE6OF01BMLV2.18.11.A11.1.454.CMB.1.raw
  modified_base (213)..(213): a, c, t, g, unknown or other
  misc_feature (213)..(213): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctcgtgggcgaggacgggcccaccatcaactgcaagtccagccagagttgttttanacagctaccaaacaaataaacaactacttacgcttaggtaccagacaagaaaccaggacacgaccccctaaggtcctactattacgcggacactaccgaccggggacgtcccggggtccctcggaccgtagttcaggacggacgacggtcgggtcgtgggaacctagtactttacacttccgtaccaccactaccaaccaacctagcgaacggtctaggaacgagttggtaggtactaagttttataaccgttgtaccgaagtactaattacctaacgttcttacccttctacctcgtaaccgggttcgggacgggaaccggtaccgaaagggttcggaacgtaactaaccggaaaccgttagtcggtacggtacctcggaaccctaacgtcgttactacccgtttcgtacccgttcttacccccgttacccgacccttaagttcccgttaccggtaaccttaaccgg

SEQ ID NO: 52187 - DNA, 655 bp, Homo sapiens
  misc_feature: GYAE6OF01BBWOF.18.11.A11.1.454.CMB.1.raw
  modified_base (227)..(227): a, c, t, g, unknown or other
  misc_feature (227)..(227): n is a, c, g, or t
  modified_base (314)..(314): a, c, t, g, unknown or other
  misc_feature (314)..(314): n is a, c, g, or t
  modified_base (414)..(414): a, c, t, g, unknown or other
  misc_feature (414)..(414): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatcgacccagtctccagactcccgttggttgtgtctcgtgggcgaggacgggcccaaccagtccaactcgacaaacgtcccagccagtacgttgttttaanacagcctaccaaacaactaacaacttacttagccttggaccagacaacgaaaccaggaccaccgcccctaacggtcctctattacgnggcacgtccgtacccgggcgtcccgggtccgtcgaccgtatccgagacgcgacgggtcggtacgtggacagtacttcactctacacactccgaacctacncgactagtcgactagtaacgtatcggtacgtacgttagtttactacgtacgtactagtacctaatacttactacgtccctccgtcttacggtaccggtaccggcgggaaccggtaacgagggtacgagaacttaacgaacggtactgggtcgtaccgtactacccgtacttacgttcgtaccgtttcctaaccgttacccttccccgtacccgtaccttacttacccgtacgttaaacccg

SEQ ID NO: 52188 - DNA, 793 bp, Homo sapiens
  misc_feature: GYAE6OF01DN38U.18.11.A11.1.454.CMB.1.raw
  modified_base (212)..(212): a, c, t, g, unknown or other
  misc_feature (212)..(212): n is a, c, g, or t
  modified_base (781)..(781): a, c, t, g, unknown or other
  misc_feature (781)..(781): n is a, c, g, or t
tcagtacgagtatgcacgaccggtgctcgatttagctacgactgcaggggcagcaagatggtgttgcagacccaggtcttcatttctctgttgctctggatctctggtgccggacgggacatcgtgatcgaccagtcctccagacctcctggttgtgtctcgtgggcgagcggccacatcaactgacaagtccacgccagtagttgttttanacgagtcctaccaaactaactaacctaacgtacttacgcgtttacgaccgagtacgaacgaaaaccacgggacaccgtacccccgttaaggtcctacgtaactttacgcgggactacgtccggtacccggggtacggtcccggggtcctacggtaaccgtacgttacgagggtacggacgtacgggtccgggttacgtacgggtaactaacgttacttttaccgaccttaccgtaaccctaaccctaactaccccgaaacccctaaaccggttcggaccgtaacgggtaccgttaaggaaaacggtcggttcggtacggtacgtttaacgttttaacgttacgtacgtacctaacgtaactaaacttacgttaacgttacccgttcccgtaccttccgtacccggtaccggtttaccggggcgggtaaaccgggaccggtaagggtaacgggtactaacgttaaccggtaaaacgtcggttacggtaccggtcgtacggtacccacgttacgttcgttcggttacccttaccgttcccgttacccgttaccccgtacgtcttaccgttntacccgtaaccg

SEQ ID NO: 52189 - DNA, 890 bp, Homo sapiens
  misc_feature: GYAE6OF01DFVKO.18.11.A11.1.454.CMB.1.raw
  modified_base (142)..(142): a, c, t, g, unknown or other
  misc_feature (142)..(142): n is a, c, g, or t
  modified_base (169)..(169): a, c, t, g, unknown or other
  misc_feature (169)..(169): n is a, c, g, or t
tcagtacgagtatgcacgaccggtgctcgatttagctacgactgcaggggcagcaagatggtgttgcagacccaggtcttcatttctctgttgctctggatctctggtcgccggacggggacatcgtgatcgacccagtccnccagacctcccgtggttgtcgtctcgngggacgaggacggccaccatcaactgacaacgtccagccgaaggtagtttagttttaacaccgacgtacctaccaaaacaaactaaacctaaccttaacttacggtaccgttacggtaacccaggaaccaaacggtaaaacccgacgggaaccaccccgtaccccccgttaaggtcctactaacgtttacgcgggtacctacgtaccccggtacccggggacggtccccggggtcctacggaccgtatacggacggacgggcgtagggtccgggtacgtacgggacgtacgttacttaccgacccttacacccgtaacctaaccgtaccccgaaacccgtaacccgtacggaccggaacggtaccgtaaggtaacggttaggttacggtacggttaccgttttaaggttttaccttaccggtacgttaacgtaaccgtaacgtttaaccgttaaccgttacgtttaccccgtttccccttacccgtttacccgtacgggttacccgggggttaccggggaacggggtaacgggtacgtaaccgggtaacgggggtacggtaacgtaaacccgtaaaccggaaaccgggttacgttggggttaccccgaggtttacccgaaacccgttaaccgttcggtttacccgtttacgttaccccggtttaacctcccgttttacccccgtacccctacgtttaaaccgtccttacggttaaaacccg

SEQ ID NO: 52190 - DNA, 695 bp, Homo sapiens
  misc_feature: GYAE6OF01B6MP1.18.11.A11.1.454.CMB.1.raw
  modified_base (219)..(219): a, c, t, g, unknown or other
  misc_feature (219)..(219): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatcgacccagtctccagacctccgtggttgtgtctcgtgggcgaggacggccaaccatacaactgacaacgtccagccagtagttagttttanacgagcctaccaaacaaactaaacctaacttacttagtcgttcggtaacacgacaacgaaaccgagaccacgtaccccgtaagtcctatacgttacgcggactactccggtaccggggacggttcccgggtccctacgtaccgtattcgagacggcgaggtcggtcgtaggacgtacgttacttacgacctcgtaccacctaactacccaacccgtacgtacgaccgtacggtcgtaagaacggtagttacggtacggttactttaacgtttacttacgtacggtactaacggacttaaacttacgttacctacgtaccctacgttctaacgtcgggttacggcggtaacggaaccgtaggtacgtagacgtaagtaaccggagtaggtcgacgtaccgtacgtaccgtcgttacgtcgtttacctacgttcccttacccgtccccgtaccttacgtactccgttaaacgttaccg

SEQ ID NO: 52191 - DNA, 557 bp, Homo sapiens
  misc_feature: GYAE6OF01DWGAS.18.11.A11.1.454.CMB.1.raw
  modified_base (287)..(287): a, c, t, g, unknown or other
  misc_feature (287)..(287): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagttgttttatacagctaccaaacaataacaactacttagcttgtaccagcagaaaaccaggacacgccccctaaggtcctcatttacngggcatccgtacccgggaggtcccggggtccctgaccgattcagaggcaggcgggtctgggacagtattcactctcaccatccaccaacctgacaggctagaagatggtggctaagtttattactgtcagacaattactatacgtcctcctctcgtacgttcggcggaaggacctaaggtggacgtatacgaaacgacgtggtcgctacgaccaccgtagtcttcgttcttaccgtacttcccgttcccgacctagtcctgacttaaccg

SEQ ID NO: 52192 - DNA, 771 bp, Homo sapiens
  misc_feature: GYAE6OF01CSVTD.18.11.A11.1.454.CMB.1.raw
  modified_base (215)..(215): a, c, t, g, unknown or other
  misc_feature (215)..(215): n is a, c, g, or t
  modified_base (228)..(228): a, c, t, g, unknown or other
  misc_feature (228)..(228): n is a, c, g, or t
  modified_base (313)..(313): a, c, t, g, unknown or other
  misc_feature (313)..(313): n is a, c, g, or t
tcagtacgagtatgcacgaccggtgctcgatttagctacgactgcaggggcagcaagatggtgttgcagacccaggtcttcatttctctgttgctctggatctctggtgccggacggggacatcgtgatcgacccagtcctccagactccctggttgtgtctcgtgggcgagacgggccaccatcaactgcaagtccagccagtagttgttttanacagcctaccaanaaataaccaacttacttagcttacggtaccagacaacgaaaaccaggaaccaccgaccccccttaaggtcctactaactttacgngggtacctacgttccggtaccccggggtacggttccccggggtaccctacggacccgtacgtttcgaacggacgggcgacgggtcgggtacgtgggaactacgtgtttaccaccgtctaccaacctactacccgaacctaaccgtcgaccgtaggacgttaggaagtcgttagggtcggtacgtttaacggttttaacttacgttacgttaccgaagtaaccgtaaactttaccgttaaacttacccgtttcccctttaccgttaccgtttccggtacccgggtttaccgggggaaccggggttaccgggaacccgtaagggggtacgtaagtaacgtaaccggtaaaacggtcgtaggtcggtactaccgacccgaccgttacgttaccgttacggttcccttaccttccgttaccccttccccggtactacgtttccgccgttaacccgtaacccg

SEQ ID NO: 52193 - DNA, 887 bp, Homo sapiens
  misc_feature: GYAE6OF01AK1V4.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtgccgacggggacatcgtgatcgacccagtctccagacctccctggttgtgtctcgtgggcgaggacggccaccatccaactgacaacgtccagccagtacgttgttttatacagcctaccaaacaaactaacaacttacgttagccgtttacggtaaccagacaaacgaaaccgaggaaccaccgacccccgtaaggttccctactattttaacggcgggactacgttccggtaaccccggggtacggttccccggggttcccgtcggacccgtatttaccggacggtacgggacctaacggggtccggggttacgtacggggaaccgtaacggttacgttttaccaacccgtttcctacccaacccgtaaccttaccccaaaccccgtaaccccgttacgaccggtacggtaaccttagggtaaaccgaggtttggttaccgggtacgtttaacgtttttaagttaccgttacgtaacgtaacgttaacctaaatttaacgttaccgttaaccgttcccccgtttacccttccgtttaacccggtcccgggtttaacccggggtaaccggggtaaccggggtaaacccggtaaacggggttacgggtaaaccgtaaaccggttaacccgtaaaaccgggtaccggttaccggtgggttaaccctccgggaaccccttaaccgttacttcccggtttacggttaccccgtttaacctaccggttttacccccttaccccggaccgtttaaccttccgtaacccgttaaccttaacccgg

SEQ ID NO: 52194 - DNA, 716 bp, Homo sapiens
  misc_feature: GYAE6OF01EA556.18.11.A11.1.454.CMB.1.raw
  modified_base (218)..(218): a, c, t, g, unknown or other
  misc_feature (218)..(218): n is a, c, g, or t
  modified_base (674)..(674): a, c, t, g, unknown or other
  misc_feature (674)..(674): n is a, c, g, or t
tcagtacgagtatgcacgaccggtgctcgatttagctacgactgcaggggcagcaagatggtgttgcagacccaggtcttcatttctctgttgctctggatctctggtgccggacggggacatcgtgatcgacccagtctccagactccctggttgtgtctcgtggggacgaggacggccaccatcaactgacaacgtccagccagtagttgttttanacagtacctaccaaacaaactaaaccaaccttacttagtacttacggtaccagacaacggaaaccaggaaccacgtacccccgttaaggtcctactacttacgtgggactacgtccggtaccggggacggttcccggggtccctaggaccgtattcgaggtacgcgaggcgggttcgtagggacagttacttcaccgtctaccactacctacctacccaaccgtgacgtaggacctaggaacgtgttcgggtacgtaccgtttaaggttttaacttaccgttgtaccgaacggtaacttaaacttaccttaacgttcccgttaccccttaccttaccgttacgtaccgggttccgggaacgggaccgggtaacgaacgggtggtaaaccgtactaaccggtaacgtacgttggcgtaccgtacgaccgtaaccttgttaccttcgttccttacccncgtttcccctacccggtacctagttacctacgacccttaacg

SEQ ID NO: 52195 - DNA, 781 bp, Homo sapiens
  misc_feature: GYAE6OF01CW590.18.11.A11.1.454.CMB.1.raw
  modified_base (223)..(223): a, c, t, g, unknown or other
  misc_feature (223)..(223): n is a, c, g, or t
  modified_base (339)..(339): a, c, t, g, unknown or other
  misc_feature (339)..(339): n is a, c, g, or t
  modified_base (599)..(599): a, c, t, g, unknown or other
  misc_feature (599)..(599): n is a, c, g, or t
tcagtacgagtatgcacgaccggtgctcgatttagctacgactgcaggggcagcaagatggtgttgcagacccaggtcttcatttctctgttgctctggatctctggtcgccggacggggacatcgtgatcgacccagtctccagacctccgtggttgtgtctcgtagggcgaggacggaccacctatacaactgcaacgtccacgccagtagttagttttanacacgtcctaaccaactaaactaaaccgtaacttacttacgtcgttacggaaccagaccaaacgaaaccgacggacctaacccgaccccgttaaggtccctagttactttaccggnggacctacgttacccggtaccccggggtacggtcccggggttacccacggtacctacgtagacggacggcggacggtcgggtacgacgggtaacagtttcttaccgaacctcctacctaaccctaacttacccaaacccgtaaccgttcggacgtacggtacgtaacggaagtttagtacgggtacgggttactttaacgttttaaccggtacttacggtaacctaacgtaaccttaaagtttaccaacggttttacccncccgtttactacccgttacggtcggggttaaccgggaccggttaaacgggaaccgtagggtacgaaaacgtgtaaaaccgaacggttcgtagtccggaagtcccaactacgttaccttggttacctttacacccgttaccttccccggtaccctacttaacttccgacgtaaccttacccgg

SEQ ID NO: 52196 - DNA, 779 bp, Homo sapiens
  misc_feature: GYAE6OF01DFCMM.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtgccggacggggacatcgtgatcgacccagtcctccagacctccctggttgtgtctcgtgggcgaggacgggccaccatcaactgcaacgtccagccagtagttgttttacacacgcctaccaaacaataacctaacttacttagctttacggtaccagacaacgaaaccgacggaccaccgaccccccgttaaggtcctactaacgtttacgcgggcctaacgtccggtaccccggggacggttccccggggtacccgtcgacccgtattacgaggacggcgacgggtccgggtacgtacggggactacgtactttaccgacttcctaccaccctactacccaaccctaaccgcgaccgtacggacctaggtaagtacgttcggtacggtaccgtttaaggttttacttaacgttcgtaccgaagtaacgtaaacgtttaccttaacgttacccgttacccttcccgttaccgtacccggttacgggtttaccggggaccgggggtaaacgggtaaccggtaaacggggttacggggaaacgtacgtaaacccgtaaacgggtacgttcgggtaccggtactaccggtacctaaccgtcgtttacgttcgttaccttaccgtactttacccccgggttcccaacttacgtcccgtagtaaccttaacccgg

SEQ ID NO: 52197 - DNA, 617 bp, Homo sapiens
  misc_feature: GYAE6OF01CBE2V.18.11.A11.1.454.CMB.1.raw
  modified_base (222)..(222): a, c, t, g, unknown or other
  misc_feature (222)..(222): n is a, c, g, or t
  modified_base (233)..(233): a, c, t, g, unknown or other
  misc_feature (233)..(233): n is a, c, g, or t
  modified_base (269)..(269): a, c, t, g, unknown or other
  misc_feature (269)..(269): n is a, c, g, or t
  modified_base (300)..(300): a, c, t, g, unknown or other
  misc_feature (300)..(300): n is a, c, g, or t
  modified_base (455)..(455): a, c, t, g, unknown or other
  misc_feature (455)..(455): n is a, c, g, or t
  modified_base (530)..(530): a, c, t, g, unknown or other
  misc_feature (530)..(530): n is a, c, g, or t
  modified_base (569)..(569): a, c, t, g, unknown or other
  misc_feature (569)..(569): n is a, c, g, or t
  modified_base (599)..(599): a, c, t, g, unknown or other
  misc_feature (599)..(599): n is a, c, g, or t
tcagtacgagtatgcacgaccggtgctcgatttagctacgactgcaggggcagcaagatggtgttgcagacccaggtcttcatttctctgttgctctggatctcgtggtgccgacggggacactcgtgagtcgacccgagttcaccagtacgttcccgtggttgtgttcttcgtggggcgagagggccacatcaactgcaagtccagcgagtagttgtttanacagctacaanaaataacaacgtacttagcttggaccagcaagaacnggtacagacccctaaggtcctctaatttcgnggacaactccggtaccgggacgtccccgggtcctacgaaccgtagttccgaggacggtcagggcgggtactagggaactaagacgtttcacttacacaacctatccaacaacctgacgacggctagaaagtcgtgacggtctaagtttattacgngtaccaagtacaaattatacttagtccctacctagtcgtaacggttccgggaaggaacggtaaccaagggtgaanaacgtaacaaaccgcttggtacggactacggactaccgngttcgacgtcttacctactccttaccccgntatccttagaccttaacg

SEQ ID NO: 52198 - DNA, 736 bp, Homo sapiens
  misc_feature: GYAE6OF01DC39G.18.11.A11.1.454.CMB.1.raw
  modified_base (315)..(315): a, c, t, g, unknown or other
  misc_feature (315)..(315): n is a, c, g, or t
  modified_base (675)..(675): a, c, t, g, unknown or other
  misc_feature (675)..(675): n is a, c, g, or t
tcagtacgagtatgcacgaccggtgctcgatttagctacgactgcaggggcagcaagatggtgttgcagacccaggtcttcatttctctgttgctctggatctctggtcgccggacgggacatcgtgatcgacccagtcctccagtacctcccgtggttcgtgtcctcgtgggcgaggacggcccaccatcaactgacaacgtccacgccagtagttagtttacacagcctaaccaaacaataacaacttattacgccttaggaccagacaagaaaccaggaccaccgacccctaaggtcctacgtactttacgnggactactacccggtacccgggtacggtcccggggtcctacggtaccgtattccggaggtacggaccgaacggccggggttacgacgggtactaacggttacttttacccgaccgttaccttacccgaaaccgtaccttaacccgtaacccctaaccgttcggaccgtaaccgggtacttaaaggtaaaccgttgttaacgggtacgtaacccgttttaagggtttttaacttacgggtcctttacgaacgttaactaactttacctaagtttacccgttccctaccgtacttccggtaccggtttcgggaccggaaggtaccggtaggtacgagtaacgtacaaacgtacgtgaccgtnacgtccacgtacttcgtacgttctacctaccgtccttacccgactcctactcgtacttacg

SEQ ID NO: 52199 - DNA, 554 bp, Homo sapiens
  misc_feature: GYAE6OF01DFE2E.18.11.A11.1.454.CMB.1.raw
  modified_base (286)..(286): a, c, t, g, unknown or other
  misc_feature (286)..(286): n is a, c, g, or t
  modified_base (317)..(317): a, c, t, g, unknown or other
  misc_feature (317)..(317): n is a, c, g, or t
  modified_base (340)..(340): a, c, t, g, unknown or other
  misc_feature (340)..(340): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgtttatacagcctaccaacaataacaactacttagcttggtaccagacagaaaccaggacacgaccccctaaggtcctcattacnggcatcgtaccggagtccgggtcctgaccgnttcagagcagcggtctggacagntttcactctcaccatcaccaactgacaggctagagactggtgactagttttactacttggtacagtactaacttactatacgttcctacctctacgtacgttcgggcggaacgggacctaagggtgagtactacgaaacgtactaggtcgactcgacctacgacttcttcgttccttactaccttccgtccctacctatacctgtacttaaccg

SEQ ID NO: 52200 - DNA, 757 bp, Homo sapiens
  misc_feature: GYAE6OF01CH4UO.18.11.A11.1.454.CMB.1.raw
  modified_base (140)..(140): a, c, t, g, unknown or other
  misc_feature (140)..(140): n is a, c, g, or t
  modified_base (219)..(219): a, c, t, g, unknown or other
  misc_feature (219)..(219): n is a, c, g, or t
  modified_base (426)..(426): a, c, t, g, unknown or other
  misc_feature (426)..(426): n is a, c, g, or t
tcagtacgagtatgcacgaccggtgctcgatttagctacgactgcaggggcagcaagatggtgttgcagacccaggtcttcatttctctgttgctctggatctctggtcgccggacggggacatcgtgatgacccagtcnccagacctcccgtggttgtgtctcgtgggcgaggacggccaccatcaactcgacaacgtccagccagtagttgtttaanacagtcctaccaaactaaactaaacctaacttacgttacgtcgttacggaaccagacaaacgaaaccgaggaaccaccgacccccgtaagtcctactacgttacgtggacctagtacccggtaaccgggtccggttcccgggtacccgtacgaccgtagttcgaggacggccgagggtcgggtccgtagggactagtacgtttaccncgttacctaccaaccgacctaccaaccctacgtacgacgacggtacgtaaggaagtagttacggtacggtacgtttaacgttttaacgttaaccttagtacgaactaacgttaacttaacttaccgttaaccgtttcccctaccgttaccgttaccggtaaccgggttccgggaaccgggtaacgggaaccgggtaaggtacgggtaacgaacgttaaaccgaaacggtaagtcggtagaccgtacgaccgtaccgtaacttccgttaccggtttcccttacgtcccgttacccccgttcccaactaccgttcctaaccgtacttaacccg

SEQ ID NO: 52201 - DNA, 765 bp, Homo sapiens
  misc_feature: GYAE6OF01CPFK7.18.11.A11.1.454.CMB.1.raw
  modified_base (222)..(222): a, c, t, g, unknown or other
  misc_feature (222)..(222): n is a, c, g, or t
tcagtacgagtatgcacgaccggtgctcgatttagctacgactgcaggggcagcaagatggtgttgcagacccaggtcttcatttctctgttgctctggatctctggtgccggacggggacatcgtgatcgacccagtcctccagaccttccgtggttgtgtctcgtgggcgaggacgggccaccatacaactgacaagtccagccagtagtttgttttaanacacgtacctaaccaaaactaaactaaacctaaacttacttacgtcgtttacggtaccaagacaaacgaaaaccgacggaaccaccgacccccgttaacggtccctacgtaactttacgcgggactacgttacccggtaacccggggtacggttccccggggtaccctacggaccgtacgttacgacgggtacggcgacgggtccggggtacggtacggggaactacgttactttacccaaccgtttccgaccctaaaccctactaacccaacccctaaccgttcgaccgaggtaccgtaaggaacgtagttggtacggtactttaggtttaacttacgtagtacaacgtaactaacttactacgttaaccgttccctaccttcgtaccgttaccgggtaccgggacgggtaacggaaccggtaaggtacggaactaacgtaacgaaacggtacgtcggtacggtcgaccgccgtaactcgttcgttacttcccgttacctccgttaccccgtccccgtactactaccgttacgaacttaccg

SEQ ID NO: 52202 - DNA, 758 bp, Homo sapiens
  misc_feature: GYAE6OF01A0RAT.18.11.A11.1.454.CMB.1.raw
  modified_base (213)..(213): a, c, t, g, unknown or other
  misc_feature (213)..(213): n is a, c, g, or t
tcagtacgagtatgcacgaccggtgctcgatttagctacgactgcaggggcagcaagatggtgttgcagacccaggtcttcgatttctctgttgctctggatctctggtgccggacggggacatcgtgatgacccagtctcagactccctggttgtgtctcgtgggcgagacgggccaccatcaactgacaagtccagccagagttgttttanacagctaccaacaataacaactacttagcttaggaccagcacgaaacctaggaccacgtcccctaaggtcctacgtactttacgtgggacctacgttcccggtaacccggggtacggttccccgggggttacccctacggtaacccggtacgttaccgaaggtacgggcgtaacgggtccgggttacggtacgggaactaacgggttaactttaccaaccgttccgtaacctaacccgtactcccgaaacccgtaacccgtcggaccgtaacggtacttaacgggaaacgttcgtagggtacggtacctttaagggttttacttacgttaggtacctagtaacctaaacttaacgttacgttacgttccccttaccgtaccgttacggtaccggttaccgggacggggaaccgggtaccggaagggtacggtaacgtacttaaccgaaaccggtacgtcgggtacggctaccgtaccgacccttagttaccttcggttccttcgtacttccccgttacccgtactacgttctaccgtcttaaccg

SEQ ID NO: 52203 - DNA, 606 bp, Homo sapiens
  misc_feature: GYAE6OF01E4OVB.18.11.A11.1.454.CMB.1.raw
  modified_base (211)..(211): a, c, t, g, unknown or other
  misc_feature (211)..(211): n is a, c, g, or t
  modified_base (301)..(301): a, c, t, g, unknown or other
  misc_feature (301)..(301): n is a, c, g, or t
  modified_base (557)..(557): a, c, t, g, unknown or other
  misc_feature (557)..(557): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctcgtgggcgagagggccaccatcaactgcaagtccagccagtagttgttttanacagctaccaaacaataaccaacttacttagcttaggtaccagacaacgaaaccaggaccacgaccccctaaggtcctactactttacgnggactactccggtacccggggacgtcccggggtccctggaccgtatcgaggacggcgaggtcgggtcgtagggacagtactttccactctcaccactccaaccactcgcgaggctagaagctggtagtacttagtttatacgtgtacaacgactaattactagtaccgttccctccctactacgtacggttcgggacgggtacggaacgagggtacgaagtactacgaaacgtacgtggtcgctcgacctaccgtntacgttcgtcttactaccttcccgtcccgacttatccgtagaccttacg

SEQ ID NO: 52204 - DNA, 567 bp, Homo sapiens
  misc_feature: GYAE6OF01BT2TF.18.11.A11.1.454.CMB.1.raw
  modified_base (222)..(222): a, c, t, g, unknown or other
  misc_feature (222)..(222): n is a, c, g, or t
  modified_base (230)..(230): a, c, t, g, unknown or other
  misc_feature (230)..(230): n is a, c, g, or t
  modified_base (259)..(259): a, c, t, g, unknown or other
  misc_feature (259)..(259): n is a, c, g, or t
  modified_base (286)..(286): a, c, t, g, unknown or other
  misc_feature (286)..(286): n is a, c, g, or t
  modified_base (295)..(295): a, c, t, g, unknown or other
  misc_feature (295)..(295): n is a, c, g, or t
  modified_base (312)..(312): a, c, t, g, unknown or other
  misc_feature (312)..(312): n is a, c, g, or t
  modified_base (376)..(376): a, c, t, g, unknown or other
  misc_feature (376)..(376): n is a, c, g, or t
  modified_base (414)..(414): a, c, t, g, unknown or other
  misc_feature (414)..(414): n is a, c, g, or t
  modified_base (421)..(421): a, c, t, g, unknown or other
  misc_feature (421)..(421): n is a, c, g, or t
  modified_base (427)..(427): a, c, t, g, unknown or other
  misc_feature (427)..(427): n is a, c, g, or t
  modified_base (436)..(436): a, c, t, g, unknown or other
  misc_feature (436)..(436): n is a, c, g, or t
  modified_base (444)..(444): a, c, t, g, unknown or other
  misc_feature (444)..(444): n is a, c, g, or t
  modified_base (447)..(447): a, c, t, g, unknown or other
  misc_feature (447)..(447): n is a, c, g, or t
  modified_base (460)..(460): a, c, t, g, unknown or other
  misc_feature (460)..(460): n is a, c, g, or t
  modified_base (465)..(465): a, c, t, g, unknown or other
  misc_feature (465)..(465): n is a, c, g, or t
  modified_base (475)..(475): a, c, t, g, unknown or other
  misc_feature (475)..(475): n is a, c, g, or t
  modified_base (491)..(491): a, c, t, g, unknown or other
  misc_feature (491)..(491): n is a, c, g, or t
  modified_base (495)..(495): a, c, t, g, unknown or other
  misc_feature (495)..(495): n is a, c, g, or t
  modified_base (505)..(505): a, c, t, g, unknown or other
  misc_feature (505)..(505): n is a, c, g, or t
  modified_base (524)..(524): a, c, t, g, unknown or other
  misc_feature (524)..(524): n is a, c, g, or t
  modified_base (536)..(536): a, c, t, g, unknown or other
  misc_feature (536)..(536): n is a, c, g, or t
  modified_base (540)..(540): a, c, t, g, unknown or other
  misc_feature (540)..(540): n is a, c, g, or t
  modified_base (544)..(544): a, c, t, g, unknown or other
  misc_feature (544)..(544): n is a, c, g, or t
  modified_base (554)..(554): a, c, t, g, unknown or other
  misc_feature (554)..(554): n is a, c, g, or t
  modified_base (558)..(558): a, c, t, g, unknown or other
  misc_feature (558)..(558): n is a, c, g, or t
tcagtacgagtatgcacgaccggtgctcgatttagctacgactgcaggggcagcaagatggtgttgcagacccaggtcttcatttctctgttgctctggatctctggtcgccgacggggacatcgtgatgacccagtcctccagacctcccgtggttgtacgtctcgtggggcgaggacgggccaccatcaactgcaacgtccagccaggtatgtttacacngctacaanaactaacactacgtagcgttacgtaccancaacgaaccgtgactcgacccaagtcnctaggttcnggctcgtcgtaccgggngtcccgggtcctggcccattcgacgagccgtttggcggtcaaagggctttagactttcacttcnccaactactctaccacaggggccaggcctttagagttncccggtnaaagtnttacccgtncgggtacnganacccctatactcnctctntcggggttcncggcggaaaagccagngggnacccttttanaaccgatttgccccgtgcncttttaaaacgncttntctncttcctcacnctcncaaaatttc

SEQ ID NO: 52205 - DNA, 870 bp, Homo sapiens
  misc_feature: GYAE6OF01C7H5K.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtgccggacggggacatcgtgatcgacccagtcctccagacctccctgggttgtgtcctcgtgggcgaggacgggccaccatcaactgcaagtccagccagtagttgttttaactaacgagtcctaccaaaactaaactaaaccaaacttacttagtcttaggtaaccagaccaacgaaaaccgaggaaccaaccggtaccccctaaggtcctactaactttacgtcgggactacgtaccggtaacccggggtacggtccccggggtccctacggaaccgtcttacgaggacggccgaacggccggggtcgtacgggacctagttactttccaccgttacctaccaaccctactacccaacctaaccctacgacgacggtactaggaataggtgtacggtactttaacgttttacgttaccgttagttaccgaacgtaactaaacgtttaccgttaaacgtttacccgtttacccccttaccgtttaccgtttacccggtttacccgggttaccgggggtaacgggggtaaaccgggtaaaacccgggttaaaggggttaccgggggtaaataaaccgtaaaccccggtaaaaccggggttacgtttacggggtaaccgggttacccgtacggtaaccccgtaacccgtaccttttacccgggttaaccttttcccgtttacccccgttaacgtttacccccccgtttccccggttaaacccttaccggtttaaccgttaaacccggaacctttaaaacccggg

SEQ ID NO: 52206 - DNA, 766 bp, Homo sapiens
  misc_feature: GYAE6OF01A0ECS.18.11.A11.1.454.CMB.1.raw
  modified_base (233)..(233): a, c, t, g, unknown or other
  misc_feature (233)..(233): n is a, c, g, or t
tcagtacgagtatgcacgaccggtgctcgatttagctacgactgcaggggcagcaagatggtgttgcagacccaggtcttcatttctctgttgctctggatctctggtgccggacgggacatcggtgatcgaccagtcctaccacgccttcccgttggttgtcgtctcgtgggacgaggacggccaaccataccaactgacacggtccacgtccagtagtttgttttaacacncgtactaccaaataactaaactacttacttacgtcgttcggaccagacaacgaacgagaccaccgtaccctaggtcctactagttcgtacggctacgtaccggtaccggggtacggtccccgggtaccgtacgtaccgtacgtacgagggtacgacggtacggtcggtcggtaggacctacgttacttaccgaccttcgaccctaccaacccgtaccaaaccctaaccgtacggccggtaacggacgtaaacggtacggtagttacggtcggttaccctttaagtttaccgttaccgttgtaaccgtaacgtaacttaacttaacgttaaccggttacccttccttacccgttaccgtacccggttaccgggttacggaccgggggtaacggtaacccggtagggtacgggtaactacggtaaaccgtaacggtacgttgggacggttacaccggtaacctaccgtacgttcccgttacgttccgttacctacccgttccggtacccacggttacttcgtaacgtacttacgg

SEQ ID NO: 52207 - DNA, 583 bp, Homo sapiens
  misc_feature: GYAE6OF01BBKG3.18.11.A11.1.454.CMB.1.raw
  modified_base (385)..(385): a, c, t, g, unknown or other
  misc_feature (385)..(385): n is a, c, g, or t
  modified_base (448)..(448): a, c, t, g, unknown or other
  misc_feature (448)..(448): n is a, c, g, or t
  modified_base (482)..(482): a, c, t, g, unknown or other
  misc_feature (482)..(482): n is a, c, g, or t
tcagtacgagtatgcacgaccggtgctcgatttagctacgactgcagggggcagcaagatggtgttgcagacccaggtcttcatttctctgttgctctggatctctggtgccggacggggacatcgtgatgacccagtctccagactccctggttgtgtctcgtgggcgaggagggccaccatcaactgcaagtccagccagtagttgttttatacagctaccaaacaataacaacttacttagcttggtaccagacagaaaccaggacacgaccccctaaggtcctcatttaccgtggggacagtccgtacccggggacggtcccgggggtccctggtaccgattacgaggaggcaggcggtcgtagggacagtattcgactcnccaaccatccaaccaaccgtgacaggcttagaacgtatcggtaggctagtttaatctgtacanactaatactatacgtcctctcctctcggtccggnggacggacagggtgagatacaaacgatggtcgcgtcggctacgtacttcgtcgtctttccgacgttcccttacccgtaccctagtctagtacccgtaaccg

SEQ ID NO: 52208 - DNA, 553 bp, Homo sapiens
  misc_feature: GYAE6OF01A10JD.18.11.A11.1.454.CMB.1.raw
  modified_base (521)..(521): a, c, t, g, unknown or other
  misc_feature (521)..(521): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagttgttttaatacagcctaccaaacaaataacaaaccttacttagctttggtaccagcaagaaacaggacacgccccctaaggtcctctatttacgtcgggcatccgtaccgggacggtccggggtccctgaccgattcagaggcagcgggtcgtgggacagtattcactctcaccactcaccaacctgcagctgaagatggtgactagtttattactgtacagactaattactattacgtcccttcctcctacgtacggttccgggcgggtacggaccgaagggtggaacgataccgaaacgtacgtggtgctcgacactntctcgtcttcacttcctccgctatctgactac

SEQ ID NO: 52209 - DNA, 744 bp, Homo sapiens
  misc_feature: GYAE6OF01D3HB0.18.11.A11.1.454.CMB.1.raw
  modified_base (681)..(681): a, c, t, g, unknown or other
  misc_feature (681)..(681): n is a, c, g, or t
  modified_base (689)..(689): a, c, t, g, unknown or other
  misc_feature (689)..(689): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagacctccctggttgtgtctcgtgggcgaggcggccaccatcaactgcaagtccagccagtagttgtttttaacacacgcctaccaaacaactaacaaccttacttagtcttcggtaccagacaacgaaaccaggaccaccgaccccctaaggtcctactaacgttttacgcgggtacctacgtacccgttaccccgggggtaggtttccccgggggtaccctacgggtacccgtaatttccggaacggagggtaccgagggtcgggttacgtacgggactacgtactttaccgaccttactaccacctacgtacccaacccgtaaccgtcgacgacggattaggaaagtctggtacgtacgtttaagtttactttaaccggtgttacgaacgtactaaacttaccgttaacgttaaccgttcccttaccccgtacgtttaccgaacggggtttccgggaacgggaaccgggtaacccggaagggttacgggaaccgttaagaacccgtaacgacgtggttaccggcttacgacgtacctnttccgttnttcccttaaccgtctttccccggtaaccccacttagtacccgttgaacgtaaccc

SEQ ID NO: 52210 - DNA, 743 bp, Homo sapiens
  misc_feature: GYAE6OF01CQHPP.18.11.A11.1.454.CMB.1.raw
  modified_base (222)..(222): a, c, t, g, unknown or other
  misc_feature (222)..(222): n is a, c, g, or t
  modified_base (643)..(643): a, c, t, g, unknown or other
  misc_feature (643)..(643): n is a, c, g, or t
tcagtacgagtatgcacgaccggtgctcgatttagctacgactgcaggggcagcaagatggtgttgcagacccaggtcttcatttctctgttgctctggatctctggtcgccgacggggacatcgtgatcgacccagtctccagacctcccgtggttgtgtctcgtgggcgaggacgggccaccatacaactgacaacgtccagccaggtagttgttttaanacagtctaccaaacaaactaaccaacttacttagcgttcggtaccagcaaacgaaaccgaggaccaccgtacccccgttaaagggtcccttacgtaacgttttaccggcggggtaacctacgttaccccgggtaaccccgggggtacgggttcccccgggggttacccctacgggtaacccgtaacgtttaccggaacgggtaacggccggtaacgggtccggggtacgtacggggaactagttacttttcccgaacttccgaccaccacttacccgaacctaaccgtgacgtacggacgttaagaaggtgtcggttcggtactttagtttacttaccgtgtacgaacgtactaactactacgttccgttcctccgttctacgtacgggttcgggacgggtaacggtacgacggtacgganaaccgtaacgtaaacggcgttgggtcgtaccgtcgacctacgtcgttcttacgttcctaccgtacttccccgtacctactacgtcgtctaacgttacccg

SEQ ID NO: 52211 - DNA, 831 bp, Homo sapiens
  misc_feature: GYAE6OF01C9EFG.18.11.A11.1.454.CMB.1.raw
  modified_base (172)..(172): a, c, t, g, unknown or other
  misc_feature (172)..(172): n is a, c, g, or t
  modified_base (354)..(354): a, c, t, g, unknown or other
  misc_feature (354)..(354): n is a, c, g, or t
  modified_base (815)..(815): a, c, t, g, unknown or other
  misc_feature (815)..(815): n is a, c, g, or t
tcagtacgagtatgcacgaccggtgctcgatttagctacgactgcaggggcagcaagatggtgttgcagaccaggtcttcatttctctgttgctctggatctcgtggtcgccggacgggacactcggtgatcgacccagtcctaccagtacctcccgtggttgtcgtctcgngggcgaggacggccacatcaacgtgacaacgtcacgccgaagtagtttagtttaacacgactacctaaccaaactaaactaacctaaacttacgttagtaccgtttacggaaccacgaacaaaacggaaaccgacggtaaccaaccggtaacccgttaacggttcctacgtaacgtttacgngggacctaccggtaccggtaaccggggtccggttcccgggtacctacggacccgtagttaccgaacgggacggccgacgggtccgggttacgacgggaacttacgttacgtttaccaaccttaccgtaaccaacccttaccgtaaacccgtacctaaaccgtcggacccggtaacggtactaaggtaacggtcgttacggttacggtaactttaacgttttacgtttacgtaacggttaccgaagtaccttaaagtacctttacgtaccggtttaccccttcttaaccgggtaccgttaccgggggtaccgggaacggggtaaacggtaacgggtaacggtaggtaacccggtaacgtaaacccgtaacgggtacgttaggtcccggaaccttaccggaccttaccgtcgtttacgtcgtttccgttaacctaccgtttccccggacgttactaaccgttntaaccgtaacgtaccg

SEQ ID NO: 52212 - DNA, 796 bp, Homo sapiens
  misc_feature: GYAE6OF01DPHRG.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtgccggacgggacatcgtgatcgacccagtcctccagacctcccgtggttgtgtctcgtgggacgaggacgggcccaccagtaccaactcgacgaacgtccacgaccgagtagtttagttttacacagccctaaccaaactaaactaaacctaaccttacttacgtccgttacggtaccagaccaaacggaaaccacgggaaccacccgtacccccgttaacggtccttacgtactttacggacggtacctacgtaccccggtacccggggtacggttccccggggtaccctacggacccgttagttaccggaacgggacggtccgacgggttacccggggtcgtacggggaacctacgttacgtttacccaccttacccgacccaaccctacgtaccccaacccgtacgtcgaccgacggtaccgtagaacgtgtacggtgaactttagtttactacgtgtacagtactaacttacgtactaccgttcccttcctacgttccggtacgggtccgggaacgggtaacggtacggacgggtagtacgtaaaccgttacggaaaccgtggtacggtcggtaccacgtcccgttaaactccgtttacgttaccggttcccttaccggttaacccctttccccgggttacccctacgttaacccttaccgttacgttaaacccgttaacccgg

SEQ ID NO: 52213 - DNA, 800 bp, Homo sapiens
  misc_feature: GYAE6OF01DXIIF.18.11.A11.1.454.CMB.1.raw
  modified_base (226)..(226): a, c, t, g, unknown or other
  misc_feature (226)..(226): n is a, c, g, or t
  modified_base (319)..(319): a, c, t, g, unknown or other
  misc_feature (319)..(319): n is a, c, g, or t
tcagtacgagtatgcacgaccggtgctcgatttagctacgactgcaggggcagcaagatggtgttgcagacccaggtcttcatttctctgttgctctggatctctggtcgccggacgggacatcgtgatcgacccagtcctccacgaccttcccttggttgtgtctcgtgggcgaggacggccaccatacaacgtgacaacgtccagccgagtagtttgttttaanacgatacctaccaaacaaactaaacctaacttacttagtcgttacgtaccagacaacgaaacacgacaccgacccctaagtcctactattcgnggactacgtccggtaccgggacggttcccgggtcctcgaccgtacgtcgaggacggtcgacggtccggtacgtacgggaactagttacgtttaccaccgttacctaccgaacctaaccgtaacccaaccccgttaaccgtcgtacccgtaggtaccgttaggaaacgttacggttagggtacggttaccgttttaagttttacgttaaccttagttaccggaattaaccgtaactttactaaccgtttcccgttaccctttccgtaccgtttacggtacccgggtttacggggacgggtaacgggtaacccgtaaggggtacggtaaccgtaacgttaaaccgaaaccggttacgttacgggtaccggtataccccgggtaccttaaccgccggtttttacgacgttttcccttaaccgtacccgtttacccccttacccggtaaccctttagtaccccggtaacgttaccccgttaaacg

SEQ ID NO: 52214 - DNA, 748 bp, Homo sapiens
  misc_feature: GYAE6OF01CAFZT.18.11.A11.1.454.CMB.1.raw
  modified_base (199)..(199): a, c, t, g, unknown or other
  misc_feature (199)..(199): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtcctccagacctccctggttgtgtctcgtgggcgagacgggcccaccatcaactgcaagtccanccagtagttgttttataccagcctaccaaactaaactaaaccaaccttacgttacgtccgtttacggtaccagacaaacggaaaacccgagggaacccgaacccgtacccccccgttaaggttcccttactaacgttttaccggacggggtaccacgttaccccggtaaccccgggggtacggttccccggggttccctacggaccgtacgttcggacggacggcgacggtccggggtacgtacggggtaccaaggttacctttacaccgttcctacccaccctacgtcccaaaccctacgtcgaccgaggtacgtaggaacgtagtggtacggtactttaagtttcttacgtgtacacggtaactaactacgttactacgttccctacgtccgttacgtaccggtcgggacggtacgggaacgtaggtagtacgaacgttacgaaacgtacgtcggaccgtacgtacgtacccacgttcttccgttagttcccttacgtaccccgtttacccgtccccaccggttaatcccgttagacccttaaccgg

SEQ ID NO: 52215 - DNA, 732 bp, Homo sapiens
  misc_feature: GYAE6OF01BJRPY.18.11.A11.1.454.CMB.1.raw
  modified_base (387)..(387): a, c, t, g, unknown or other
  misc_feature (387)..(387): n is a, c, g, or t
  modified_base (399)..(399): a, c, t, g, unknown or other
  misc_feature (399)..(399): n is a, c, g, or t
  modified_base (441)..(441): a, c, t, g, unknown or other
  misc_feature (441)..(441): n is a, c, g, or t
tcagtacgagtatgcacgaccggtgctcgatttagctacgactgcaggggcagcaagatggtgttgcagacccaggtcttcatttctctgttgctctggatctctggtgccgacgggacatcgtgatcgacccagtctccagactcccgtggttgtgtctcgtgggcgagacgggccaccatacaacgtgacgaacgtccagccgagtacgtttgttttaacacacgtccttaaccaaactaaactaaacctaacgttacttaacgtcgtttaggaaccagacgaaacggaaaacccgacgggtaccacggtacccccgttaaaggtcctactaatttacggcggctaacgtccggtaaccgggacgtcccgggtacctagaccgtntacgaggacggngaacggtcggtccgagggtacagttacgtttaccacttaccnccgtaacctacgtaacccaaccctaaccggtcgacgtaacggtctaacgtaaggtactacggtagggttaccttaagttttaaacgttcgttacggaactaggtaactaaacgtacttacgtacgttaccctactccgtaccgggtacgtaccgggtacggtaaccggtacgaaacgggttgaaacgtacgttaacgaacccgtaagtcccggtagacccgtcctacaccggtaacttcgtacctcgttacttaccgttccacccgttacgaatttcaacgtcttaaccgg

SEQ ID NO: 52216 - DNA, 611 bp, Homo sapiens
  misc_feature: GYAE6OF01BQYMN.18.11.A11.1.454.CMB.1.raw
  modified_base (215)..(215): a, c, t, g, unknown or other
  misc_feature (215)..(215): n is a, c, g, or t
  modified_base (299)..(299): a, c, t, g, unknown or other
  misc_feature (299)..(299): n is a, c, g, or t
tcagtacgagtatgcacgaccggtgctcgatttagctacgactgcaggggcagcaagatggtgttgcagacccaggtcttcatttctctgttgctctggatctctggtgccggacggggacatcgtgatgacccagtctccagacctccctggttgtgtctcgtgggcgaggacgggccaccatcaactgacaagtccagccagagttgttttanacagctaccaacaataacaacttacttagcttaggtaccagcaagaaacccaggacacgcccctaaggtcctacgtatttacgngggctacgtccgtaccgggagtcccgggtacctgacccgtattcgaggacggtacaggccgggtgtacgggaacagtaactttccaactctaccacctactccaaccaacctgaccgaaggtctaaggaagtacgtggtaggaccttagtttaacttactggtacacgtactaaatacttaatcgtaccctcctactacgtacgttcgggacggaacggaccgaagggtgacgactaacgaacgagttgacggtctggaccacgtactcgttcgtaccttcacttcccgttcccacttagtcctagacttac

SEQ ID NO: 52217 - DNA, 750 bp, Homo sapiens
  misc_feature: GYAE6OF01COHOL.18.11.A11.1.454.CMB.1.raw
  modified_base (218)..(218): a, c, t, g, unknown or other
  misc_feature (218)..(218): n is a, c, g, or t
  modified_base (459)..(459): a, c, t, g, unknown or other
  misc_feature (459)..(459): n is a, c, g, or t
tcagtacgagtatgcacgaccggtgctcgatttagctacgactgcaggggcagcaagatggtgttgcagacccaggtcttcatttctctgttgctctggatctctggtgccggacgggacatcgtgatcgacccagtcctccagacctcctggttgtgtcctcgtgggcgaggacgggccaccatccaactgaccacgtccagccagtagtgttttanaccagctaccaacaactaacaacttactagcttggtaccagacaagaaccacggaacacgacccccgttaaggtaccttcgtactttacgtcgggactacgttaccggtacccggggtacggttccccggggtacccgtacggacccgttagttacgaacgggtacggcggtacggtcgggtccgtacgggactagttactttccaaccttcgtacccaactactcccgaacctaacccgntaccgaacggtacctaggaacgtacgtacggtacgtaaccttagttttaacttacgtggttaccaacggtactaacttacgttaacttaccgttcccttaccttcccttaaccggtaccggttcgggaacgggtaacccggggaaccgtaaacggggtacggtaacgtaacgtaaacccggtaaacgtacggtacggtcggtaccgacggtaccaccgtttacgtcgttaccgtttccttaaccgtcctttcccgttaccccggacttactccgttacgaaccttaaccgg

SEQ ID NO: 52218 - DNA, 804 bp, Homo sapiens
  misc_feature: GYAE6OF01A477V.18.11.A11.1.454.CMB.1.raw
  modified_base (226)..(226): a, c, t, g, unknown or other
  misc_feature (226)..(226): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatcgacccagtctccacgaccttcccgttggttgtgtcctcgtggggcgaggacggccaccatacaactgacaacgtccagccagtagttgttttacacngacctaccaaacaactaactaacttacttacgtacttacggaaccacgacaacgaaaccgaacggaccaccgtaccccgtaacggtccctacttaactttacggtacggactacgttaccggtaacccggggtccgggttacccgggtccccgtacggacccgttaacgttcggaacggtacggacggaccgggtccgggtacgtacgggacctacggttactttaccgaccttaccacccgaccctaactacccaaccgtaaccgtacgaccgaacggtacgtaacggaacgtagttaccgggttacgtaccgtttaagtttaaccgtttacggttagacgtacgtaacttaaacttaccttaacgtccgtttcccttacgttacccgttacggttaacccggggttaccgggacggggtaacccgggtaacggtaaggggtaacgtaacggtacgttaaacgaaaccgtacggtcgggttcgaccgtacgacctaacgtccgttagttcccgttaccttaccgtacccgttacccgttacccgtactaccttacgttacccggtaatttaacccgg

SEQ ID NO: 52219 - DNA, 830 bp, Homo sapiens
  misc_feature: GYAE6OF01DERI7.18.11.A11.1.454.CMB.1.raw
  modified_base (449)..(449): a, c, t, g, unknown or other
  misc_feature (449)..(449): n is a, c, g, or t
tcagtacgagtatgcacgaccggtgctcgatttagctacgactgcgaggggcagcaagatggtgttgcagaccctaggtcttctatttctctgttgctctggtacttctcgtggtcggccggacggggacatcgtgactcgacctagtctaccgagtaccttccgttgggttcgtcgtcgtacggtggggacgacggacgggccaacctaagtaccaaacgtcggaaccaacgtaccgacgtaccgtaggttagtttagttttaacaccacgtacctaaccaaaactaaactaaccgttaacttaccgttacgtaccgttacggaacccagaacccgtaaacgaaaccgtacggaacctaccgtacccgttaaggtcctacttaacggtttacgcggtactaccgtccggggtaacccggcgggttcccggtaacctcggtaaccggtntaccggaggacggccgtagggtcgtacgtacggatacgtacttacgaccttcgactaccgaactaccgacccgtaacgacgtcgacggttacgacgtaagtacgtagtacggttaacgttagtttacgttacgtagtaacgttaacgattaacgtacgttacgttacctcccgtacttccgtacggtttacggcgggtaacgggaccgggtaaggtaacggtacggtaaggtaacccttaaacggaacgtacggttacgggcgttaaacccgcgtaaaccgttaccgggttcacccggttttagttacccctaccgtttccccgttaaccgtttcccccggttaacctaagttccgtttaaacccggcttttaaccccggg

SEQ ID NO: 52220 - DNA, 734 bp, Homo sapiens
  misc_feature: GYAE6OF01BOL5V.18.11.A11.1.454.CMB.1.raw
  modified_base (186)..(186): a, c, t, g, unknown or other
  misc_feature (186)..(186): n is a, c, g, or t
  modified_base (204)..(204): a, c, t, g, unknown or other
  misc_feature (204)..(204): n is a, c, g, or t
  modified_base (220)..(220): a, c, t, g, unknown or other
  misc_feature (220)..(220): n is a, c, g, or t
  modified_base (430)..(430): a, c, t, g, unknown or other
  misc_feature (430)..(430): n is a, c, g, or t
tcagtacgagtatgcacgaccggtgctcgatttagctacgactgcaggggcagcaagatggtgttgcagacccaggtcttcatttctctgttgctctggatctctggtgccggacggggacatcgtgatcgacccagtcctcagacctcccgttggttgtgtctcgtggggcgaggacggccaccntcgaactgacaagtccanccagtagttagtttanaacacgactaaccaaactaaataacctaattacgttagcttacggaccagacaacgaaacgacgacaccgtacccctaaggtcctataacgttacgtggactacgtaccggtaccggggtaccgtcccgggtccctaagtacccgtattacggaaggcggtacgacgggtcggtacgtagggaactagtacttcgactctacccaactanacccaaccgtaactgaccggagtacgaagtaacgtgtttacggcggttaattacggttttaactaaccggttgttaaacggactaaacgaaacttacgttaattacccgtaccctttagtacccttacggtaaccgggttcggggacggtaaaccgggtaaccgagggtacgtaagtaaacccggaactaaacggtaaccttgggacgtacgtaccggtaacccaacgttacttcgttacgttaccttacccgtaactttccccgttaaccccggacttaacgtctaaacccggtcgttaaacc

SEQ ID NO: 52221 - DNA, 857 bp, Homo sapiens
  misc_feature: GYAE6OF01D26HQ.18.11.A11.1.454.CMB.1.raw
  modified_base (243)..(243): a, c, t, g, unknown or other
  misc_feature (243)..(243): n is a, c, g, or t
tcagtacgagtatgcacgaccggtgctcgatttagctacgactgcaggggcagcaagatggtgttgcagacccgaggtcttcatttctctgttgctctggattctctggtcgaccggacggggacatcgtagatcgacccagtcctccgagtaccttcccgtggtttgtcgtcgtcggtgggcgaggacggcccactatacaacgtgacctacgccacgccgtaagtacgtttagtttttaanacacgaccctaacaaaacctaaaactaacctaacttaacgttacgtaccgtttacggaaccaacgaacgaaacgaaaccgaacggaaccctaacccggtaaccccttacggttacctacttaacgtttaccggtcggtactacgttaccccgggtaccggggtaccggttaccccgggtcctacgaccgttacgtacgaacgggacggacgacgggtccggtagtacgggactaagttccgttacaccttacaccgtaacctaacgtacccaaacccgtacgtacggaacgtcggtaacgtaagggaacgttacgttagggtacgttaacgtttaacggttttaccttaacgggttaccgtaaaccgtaacggtaaactttaaaccgttaaacgtttacgtttaccccggttacccgttttccctaacccggtttacgggtaaccgggtttcccggggggaaccgtaacgggttaacgggtacgggtagtaacgtaacgtaacgaacgtacggtacggtacacggttaccgctaaccgttcgttacgttaccttacgttcccttaccgttaccccgtaccccttattaccgtacggtaaactactttaacccgg

SEQ ID NO: 52222 - DNA, 702 bp, Homo sapiens
  misc_feature: GYAE6OF01EQTJR.18.11.A11.1.454.CMB.1.raw
  modified_base (215)..(215): a, c, t, g, unknown or other
  misc_feature (215)..(215): n is a, c, g, or t
  modified_base (310)..(310): a, c, t, g, unknown or other
  misc_feature (310)..(310): n is a, c, g, or t
tcagtacgagtatgcacgaccggtgctcgatttagctacgactgcaggggcagcaagatggtgttgcagacccaggtcttcatttctctgttgctctggatctctggtgccggacggggacatcgtgatcgacccagtctccagacctccctggttgtgtctcgtgggcgagacgggccaccatcaactgcaagtccagccagtagttgttttanacagcctaccaaacaataaaccaacttacttacgtcttacggtaccagacaagaaaccgaggaaccacgaccccctaaggtcctactatttacgnggacacgtaccggtacccgggtacggtcccggggtccctacggtaccgtattcgaggtacggcagggtccgggtcgtagggacctagtactttcactctaccactactaccacctaaccgtcgaccgtaggctaggaagacgttggtacggtacttaagttttacttaccgtgtacgacgtaactaacttaccttaattaccgtcccttcccttactcgtacccgggttcgggaccgggtaacgggaaccgtaaggggtacgggtaactaacggtaaccgaaaccggttacgtcgggtacgtaccctagacccttaccgtactttaccgtcgttcccttcctaccgtttccccgtaccccgtacgttaacttcccgtaggtacccttaaacg

SEQ ID NO: 52223 - DNA, 929 bp, Homo sapiens
  misc_feature: GYAE6OF01DKK04.18.11.A11.1.454.CMB.1.raw
  modified_base (212)..(212): a, c, t, g, unknown or other
  misc_feature (212)..(212): n is a, c, g, or t
tcagtacgagtatgcacgaccggtgctcgatttagctacgactgcagggcagcaagatggtgttgcagacccaggtcttcatttctctgttgctctggatctctggtgccgacgggacatcgtgatcgacccagtctccagacctccctggttgtgtctcgtggcgagacggccaccatcaactgacaagtccagccagtagttgttttaanacagcctaccaaacaaataacaactacttagcttgtaccagacaacgaaaccacggaccaaccgtacccccgtaacggtcccttactacgtttacgtcgggactaacgttcccggtaaccccgggggtacggttccccgggggttacccctacgggtaacccgtactttaccggaacggtacgggaccggaagggtcccggggtacgttacggggaaccgtaacggttaactttttccgaaccctttaccttaccccaaccgtaaaccttaccccgaaacccctaaccccgtagggtacccgaacggggtaaccgtaaacggtaaaggttaaccgttgggttaacggttaaccgttttaaaggtttttacgtttaaccgtacgggtttaaccaacggttaaacctaaacgttttaacccgttaactttaacccggtttcccccgttcccttttaccggttaacccggttacccggggttttaccggggaacccgggggtaaacggtaaacccgggttaagggttacggggtaaaccgttaaaccggttaacccggtaaaaaacggggttcccgttagggtttaccccggaacgttacccgggtaaccccaacccggtttaaacgtttcccgggtttactttacccctttacgttaccccggtttaccccgttcccccggtaactacccgtttctaaccggtaaacctttaaccccgg

SEQ ID NO: 52224 - DNA, 752 bp, Homo sapiens
  misc_feature: GYAE6OF01ACGI5.18.11.A11.1.454.CMB.1.raw
  modified_base (343)..(343): a, c, t, g, unknown or other
  misc_feature (343)..(343): n is a, c, g, or t
  modified_base (726)..(726): a, c, t, g, unknown or other
  misc_feature (726)..(726): n is a, c, g, or t
tcagtacgagtatgcacgaccggtgctcgatttagctacgactgcagggcagcaagatggtgttgcagacccaggtcttcatttctctgttgctctggatctctggtgccgacggggacatcgtgatcgacccagtcctccagacctcccgtggttcgtgtctcgtgggcgaggacgggcccaccgataccaactcggaccaacgtccacgccgaggtagtttgttttaacaccacgacctaccaaacaaactaaacctaaccttacgttacggtcttaccggtaaccacgaccaacgaaaccgacggaccaccgtaccccgtaacggtcctatacttacggnggaccacttaccgggtacccgggacggttcccggtccgtacggaccgtacttcgacgggacggcgacggtccgggtagtacgggactagttactttccgaccttcaccaacctacgtacccaacccgaactcggacgacggtataacggagtacgttcggtaacgtacgtttaacgtttactacgttacgaccgtaacgtacctaaacttaccgttaacgtacccgttccccctccttacggttacccgtaaccggggtcgggaacccggggaagtaacccggtagggtaaccaacggtactaaaccgtaacgtacgttgcgtacgtccgaacctacgttacctgtttcctaacgtttccctaaccgttccccgttaaccccngttacctactaaccgtccgttaaccg

SEQ ID NO: 52225 - DNA, 782 bp, Homo sapiens
  misc_feature: GYAE6OF01BWO2Y.18.11.A11.1.454.CMB.1.raw
  modified_base (231)..(231): a, c, t, g, unknown or other
  misc_feature (231)..(231): n is a, c, g, or t
  modified_base (713)..(713): a, c, t, g, unknown or other
  misc_feature (713)..(713): n is a, c, g, or t
tcagtacgagtatgcacgaccggtgctcgatttagctacgactgcaggggcagcaagatggtgttgcagacccaggtcttcatttctctgttgctctggatctctggtcgccggacggggacatcgtgatcgacccagtcctccagtaccttcccgttggttgtgtctcgtgggcgaggacgggccacataccaacgtcgacaacgtccagcctaaggtagtttgttttanaacacgtacctaaccaaactaaataacctaacttacgttagcgttacgtaccagacgaacgaaccaggaccaccgtaccccgtaagtcctactacttacgcggacacgtaccggtaccgggtacggtcccgggtccgacgacgtagtcgaggacgacgacggtcgggtacgtacgggactaaggttaccttaccgaccttaccgtacctaccgtaacctaacccgtaacccgtaaccgtcgtaccgaacggtaccgttaaggaagttacggttacggtaccggttactttaacggttttacgttaccggttacgtaaccggtaacgtaacttaaacgttacccgtttaacgttaccccgttacctttacccgtcccgtttacgtacgggttaccgggacgggtaacggacggtaagggtacgtaacggaacgttaaccgtaacggtacgttaggtccgtagtaccgaccgtaacgtcgtttntaccggtttacctacccgtaccgtttcccgtacccgtacgttaccgttaccgtaccgtacttaacccgg

SEQ ID NO: 52226 - DNA, 720 bp, Homo sapiens
  misc_feature: GYAE6OF01DSZ5M.18.11.A11.1.454.CMB.1.raw
  modified_base (325)..(325): a, c, t, g, unknown or other
  misc_feature (325)..(325): n is a, c, g, or t
tcagtacgagtatgcacgaccggtgctcgatttagctacgactgcaggggcagcaagatggtgttgcagacccaggtcttctatttctctgttgctctggatctctggtcgccggacggggacatcgtgatcgacccagtcctccagaccttcccgtggttgtgtctcgtggggcgaggacgggccaccatacaactggacaacgtccagccagtagttagttttatacagctaccaaacaaactaaacaacttacttagtcgttacggtaaccagacaaacgaaaccgaggaccaccgtaccccgtaagtcctactatttacgnggtacacgtccgtaccgggtcggtcccgggtcctcggaccgtattcgacggacggtcgacgggtcggtacggtagggactaggttactttcactcctacaacctactaccaacctaacgtgacgacggactaggaagtagtacggttcggtaacgtttaagttttaacttacggttacgtacaacgtaacttaaacttacttaacgtttacctaccctttcccttaccgtaccggttacgggttaccggggtaccggggaacgggtaacccggtaagggtacgggaacgtaaacgttaaaccggaaacgtaacggtcggtacgtacgtaccgtacctaacgtcttcgttacgttcctaccgtacttccccgtacccactactctagtacttaccg

SEQ ID NO: 52227 - DNA, 807 bp, Homo sapiens
  misc_feature: GYAE6OF01EAH1K.18.11.A11.1.454.CMB.1.raw
  modified_base (216)..(216): a, c, t, g, unknown or other
  misc_feature (216)..(216): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatcgacccagtctccagactccctggttgtgtctcgtgggcgagacgggcccaccatcaactgcaacgtccagccagtagttagttttanacagctaccaaacaataaccaactacttagtcgttacggtaccagacaacgaaaccgacggaaccaccgtacccccgttaaggtcctacttaacgtttacgtcgggaccttacgtacccggttaccccggggtacgggttccccgggggtttaccctacggtaaccggtacgtttaccgaacgggtacgggaccgacggggtccggggttaccggtacggggtaactaacggttaccttttaccgtaccttaccctaccgtaaccacttaacccgaaccctaaccgtcggaacgacggtacgtaggaagtacgttggtacgtacgtttaagtttactttacgtcggtaacgtataaccgttaaattacgttacttacccggtttcccttcccgttacttacccgggttaccggggtcgggtaaccggaaccggttaaccggttagggtcgtaaacgttaaccgtaaaccgtaaccggtagttccggggaatccctaccggtacctaacccgtttacgttccttaacggttcccttaacccgctttacccccgttaccgaccttaccgtttccacgggttaacccttacccg

SEQ ID NO: 52228 - DNA, 731 bp, Homo sapiens
  misc_feature: GYAE6OF01ATKXA.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtgccggacggggacatcgtgatgacccagtctccagacctccctggttgtgtctcgtgggcgaggacgggccaccatcaactgacaacgtccagccagtagttgttttaatacagacctaccaaacaaataactaaccttacttagtcgttaggtaccagacaacgaaacccaggaccaccgtacccccgtaacggtcctactactttaccgtcgggctacgtcccggtacccggggtacggttccccggggtaccctacggacccgtattacgacggaggcgacgggtccggtcgtacgggacaggtactttccactcctccaccgactacccaaccaaccgtcggaccgaggtacctaggtaagtacgttaggtcggtaacctttagttttaacttacggtcgtaccgtacgaacttaactacttaacgtcccgttaccctccctaccgtaccggtaccgggtccgggtaacgggaacggtaacccggaagggtacgtaacgtacgttaaaccgaaccgtacgttcggtacggcctactccggtaaaccctcgttcttaccggttcccttaccttaacccgttccccgtcccccgtacttatcccgtacgtacttaacccgg

SEQ ID NO: 52229 - DNA, 750 bp, Homo sapiens
  misc_feature: GYAE6OF01E2LQT.18.11.A11.1.454.CMB.1.raw
  modified_base (157)..(157): a, c, t, g, unknown or other
  misc_feature (157)..(157): n is a, c, g, or t
  modified_base (171)..(171): a, c, t, g, unknown or other
  misc_feature (171)..(171): n is a, c, g, or t
  modified_base (213)..(213): a, c, t, g, unknown or other
  misc_feature (213)..(213): n is a, c, g, or t
  modified_base (399)..(399): a, c, t, g, unknown or other
  misc_feature (399)..(399): n is a, c, g, or t
tcagtacgagtatgcacgaccggtgctcgatttagctacgactgcaggggcagcaagatggtgttgcagacccaggtcttcatttctctgttgctctggatctctggtcgccggacggggacatcgtgatgacccagtctccagacctcctggtgtntctcgtgggcgagnggccacatacaactgacaacgtccagccagacgttgttttanacagctaccaaacaactaaacaacttacttagtccttaggtaaccaggacaacgaaaaccacgggaacctaccggacccccgttaaacggtcctactaacttttcgtcgggactaacgttaccgtaacccggggtacgtcccggggttcccagaccgtattcgagtacggcacgggcgggttacgngggaactagactttcgaactcaccacctaacgtaccaacctaccgtcggacacggtaccgtagaacgtacgtcggcggttacttaggtttacttctcgtcacgtacgtaagttacttatagtaacgttacggtttaccgggtacggttaccggggaaccgtaaacggggtaacccgtaaacgggtacgggtaacgtaaaacggttaaaccgaaaccggttaaacgtcgggttaaccggcgtaccggaccctaacttacgttccgttctttaaccgttcccgttaaacccttccccggtttaaccccgtccctaaaggttccgttaaccttaaacccgtacgtttaacccgg

SEQ ID NO: 52230 - DNA, 873 bp, Homo sapiens
  misc_feature: GYAE6OF01BV6Y4.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtcgccggacggggacatcgtgatcgacccagtcctccagaccttcccgtggttgtgtcgtcgtcgggacgaggacgggccaccatacaactgactaacgtccacgccgaagtagtttgtttttaacacgacgacctaaccaaactaaataaacctaacttacttacgtacttacggtaccagacgaacgaaaccgaacggaaccaccgtacccccgtaacggtcctacttacgttacgcggtactacgtaccggtaccggggtacggtcccggggtccctacggaccgtacgtacgacggcggacgagggtcgggtcgtacgggactacgttacttccgacttacctacccactaccgacctaaccctacgtacgacggacgtacgtaggaacgtacgtcggttacggtactttaacggttttaacttaccggtacgttaccgtaagtaaccgttaacgtttaaccgttacggttacccgtttcccttaccccgtttccggttacccggtttaccgggtaccggggtaaccggggtaaacggggtaccggtaaggggttaacgggtaacgtaaccggttaaaccggtaaacggttaccggtacgggttaccgggtaccgttaaacccggtacccgttaaccggttaccggtttaccgtttacccggtttacccgtttaaccccgttaccccgttttaacccccggttaaccccgtaccgtttaaccccggtttacttaaaccccgggtttaacccgttaaacccgg

SEQ ID NO: 52231 - DNA, 590 bp, Homo sapiens
  misc_feature: GYAE6OF01CD0VF.18.11.A11.1.454.CMB.1.raw
  modified_base (207)..(207): a, c, t, g, unknown or other
  misc_feature (207)..(207): n is a, c, g, or t
  modified_base (288)..(288): a, c, t, g, unknown or other
  misc_feature (288)..(288): n is a, c, g, or t
  modified_base (530)..(530): a, c, t, g, unknown or other
  misc_feature (530)..(530): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgtttanacagctaccaacaataacaactacttagcttggtaccagcaagaaaccaggacacgccccctaaggtcctacactttacgngggcagtccgtacccggggagtcccggggtcctggaccgtattcgagtaggcaggcggtctcgggacagtactttacgactcgtcacctatccaaccaaccgtgacgaggctagaagtatggtcggactagtttacttacgtgtcgagtactaattactattacgtccctactcctacgaccgggttcggacggacgggtacctaagggtcggaacgtactacgaaacgtacgtcggcgtcncgacgacctattcgtagtcttacacttcccgttacccgcttagtcctacgacttaaccgg

SEQ ID NO: 52232 - DNA, 883 bp, Homo sapiens
  misc_feature: GYAE6OF01CUP8M.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtgccggacggggacatcgtgatcgacccagtctccagaccttcccgtggttgtgtctcgtgggcgaggcggccaccatcaactcgacaacgtccacgccaggtagtttgttttaacacgacgtcctaccaaactaaactaaacctaacttaaccttaggtccgtttaggtaccaggaccaaacggaaaaccgacggaaccacccggtaccccccgttaaaggttcccttacttacgtttaccgcgggtacctaacggttacccggtaaccccgggggtacggttccccgggggttccctacggtacccgtagttcggaggaccggcgtacgggtccgggtcggtacgggaactagtcttttaccgacttcctaccaacctactacccgaaccgtaaccttcggacgtacggtacgttaacggaagtacggttcggttacggtacgttttaacgtttttaacgtaccgttacgtaccgtaacggtaacctttaaacgtttccgttaaaccgtttcccgtttccccgttacccgtttacccggttaaccggtttaaccccggggttacgggggacccggggtaaaccgggtaaccgggttaaggggttacgggtaaccgttaacggtaaacccgttaaaccggtacggttacgggccgggttactacccggaccgttaacccgttcggtttcgttaccggtttcccttaacccggttccctttacccccggttcccccgtaacgttaccttttaccccgacgttaaccttaaacccgg

SEQ ID NO: 52233 - DNA, 606 bp, Homo sapiens
  misc_feature: GYAE6OF01DSRI9.18.11.A11.1.454.CMB.1.raw
  modified_base (289)..(289): a, c, t, g, unknown or other
  misc_feature (289)..(289): n is a, c, g, or t
  modified_base (296)..(296): a, c, t, g, unknown or other
  misc_feature (296)..(296): n is a, c, g, or t
  modified_base (348)..(348): a, c, t, g, unknown or other
  misc_feature (348)..(348): n is a, c, g, or t
  modified_base (398)..(398): a, c, t, g, unknown or other
  misc_feature (398)..(398): n is a, c, g, or t
  modified_base (497)..(497): a, c, t, g, unknown or other
  misc_feature (497)..(497): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagtagttgttttaatacacgtcctaccaaacaaataaccaacttacttaagcttagtaccagacagaaaccaggacacgacccctaagtcctntattacnggcactcgtacccgggagtccgggtcctgaccgtatcgagagcaggccggtntggacagtacttcgactctacacactcaccaactgcgaggctagaacgtntggtgtctaagtttactatgtcaagtactagttactagttaccgtcccttctctcgtaccggttcgggacgggtaacggtaccgtaaggtacgggtaanacgttacgaaaccgtacgtaggtacggtactcgaccctaacgtactttcttacggttcctttaaccgctttccccgttacccgtacctagttccctacgtactaacccg

SEQ ID NO: 52234 - DNA, 765 bp, Homo sapiens
  misc_feature: GYAE6OF01EKLI0.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagacctccctggttgtgtctcgtgggcgaggacgggccaccatcaactgacaacgtccagccagtagttgttttaatacagcctaccaaacaataacaacttacttagtcttacggtaccagacaacgaaaccaggaccaccgaccccctaaggtcctactacgtttacgtgggctacgtccggtaccccggggtacggtcccgggggtccctacggaccgtattcgaggacggcgacggcgggtcgtagggacagtactttaccactcctaccacctactacccaaccctaaacccgtggaccaagggaccttaaggaaacggtagttgggtcggttaacttaaggtttttaacttacgttggtaccgtaacgtaaccttaaaacgtttaccttaacgttacccgttcccctttccgttaccttaccggttacccggggtttaccggggaccggggtaaccgggtaaccggtaagggggttacggaaaggttaacctaaccggtaaaaccggtacggttaggtcggccttacggaaccctaccgtacgttccgttacggtttcctaacccttacgtttacccccgtcccgtaacccgttacttacccgtagaacccttaaccgg

SEQ ID NO: 52235 - DNA, 776 bp, Homo sapiens
  misc_feature: GYAE6OF01DNXTC.18.11.A11.1.454.CMB.1.raw
  modified_base (216)..(216): a, c, t, g, unknown or other
  misc_feature (216)..(216): n is a, c, g, or t
tcagtacgagtatgcacgaccggtgctcgatttagctacgactgcaggggcagcaagatggtgttgcagacccaggtcttcatttctctgttgctctggatctctggtgccggacggggacatcgtgatcgacccagtcctccagacctcctggttgtgtctcgtgggcgaggacgggccaccatcaactgcaagtccagccagtagttgttttanacagacctaccaaacaactaactaaccttacttagcttacggtaccaagaccgaacgaaaaccacggaaccacccgtaccccccgttaaggttccctacttaacgtttaccgtacgggtaccctaggttacccccgggtaccccggggtaaccggggttcccccggggttacccgtacggtaacccgtactacggacgggacggacgaacgggtcgggtaccggtagggactaacggttcttactactaccctacctaacctactacccaaccgtaccgtggaccgtacggtacgtaaggtaacgtaggttcggttacggttaacgttttagttttaacgttacgtacgtacgtaacgtaacttaacgttaacttaaccgtaccgtttccctacccgttaccgtccgtacgggtccgggacggaacgggtaacggtaggttacggaataacctaacggtaaacgtggttacggtacgtccgaccgtaccgtacctacttacgttacttccgtccttaaccttccccgttacctacctacgttaccaggtaccttaaccgg

SEQ ID NO: 52236 - DNA, 803 bp, Homo sapiens
  misc_feature: GYAE6OF01BOA00.18.11.A11.1.454.CMB.1.raw
  modified_base (93)..(93): a, c, t, g, unknown or other
  misc_feature (93)..(93): n is a, c, g, or t
  modified_base (225)..(225): a, c, t, g, unknown or other
  misc_feature (225)..(225): n is a, c, g, or t
tcagtacgagtatgcacgaccggtgctcgatttagctacgactgcaggggcagcaagatggtgttgcagacccaggtcttcatttctctgttnctctggatctctggtgccggacggggacatcgtgatcgacccgagtcctccagaccttcccgttggttgtgtctcgtgggcgagacggccacatcaactgacaacgtccgagccagtagtttacgttttaanacgacgcctaccaaaacaaactaaacctaacttacttacgtccttaggtacccagaccaaacgaaaaccgacggaaccacccgaccccgttaacggtcccttacgttaacgtttaaccgcgggtaccctacgttaccccgggtaaccccgggggtacgggttccccgggggtacccccgtaggtaacccgttacgtttaccggaagggtacggccggtacggggtccggttacggtacgggaactacggttactttactacccttctacccgacctacgtacccaaccaaccgtcgcgaacgcgtaagaacgtgtcggtagtacgtttagtttaacgttacgtcgtaacgtaacaacgttaaacttcctaacgttaccgtccccttccctacgttcccggtaccggtacggggtacggaacggttaaccgaaggggttaggaaccttacgttaaccgaaacggtaccggtgggtaccgtaccgtaccggtaccctaacgtcgtttcccgttagtttccctaccgtttacccgttccccttacccgggttactaccggtcccttaacaccgttaaccgg

SEQ ID NO: 52237 - DNA, 969 bp, Homo sapiens
  misc_feature: GYAE6OF01EIEG9.18.11.A11.1.454.CMB.1.raw
  modified_base (219)..(219): a, c, t, g, unknown or other
  misc_feature (219)..(219): n is a, c, g, or t
  modified_base (223)..(223): a, c, t, g, unknown or other
  misc_feature (223)..(223): n is a, c, g, or t
tcagtacgagtatgcacgaccggtgctcgatttagctacgactgcaggggcagcaagatggtgttgcagacccaggtcttcatttctctgttgctctggatctctggtgccggacggggacatcgtgatcgacccagtctccagacctcctggttgtgttctcgtgggcgaggcggccaccatacaactgacaacgtccagccagtagtttgttttaanacanctaccaaactaataacctaacttacgttagtccgtttacggtaccagacaaacgtaaaccgacggacccaaccgtacccccgttaacggttcccttacttaacgttttaccggtcgggaccttaccgttcccgggtaaccccgggggttaccggggttccccgggggttacccctacgggtaacccgttaacgttaccggaacgggtacgggtaccggtacggggtacccggggttaccgggtaacggggtacctaacgggtttacctttacccgtaaccctttacccgtaccctaaacccgtacgttaaacccaaaccccgttaacccgttacgggaccgtacggggtacgtaacggtaaacgggttacgttacggggttaccggtttaacgttttaagtttttaaccgttttacgttaccgggttaacgtaaacggtaactttaaaacttttacccggtttaaacttttccccggtttaccccctttaccctttacccgggttaacccgtttacgggggttacccgggggtaaccgggggtaaacccggtaaaccgggtaacggggtaggttaaccgttaaccgttaaacccgtaaacggttaccgttaggggtacccggttacgtacccgaacccggttaacttcccggttacttttacccggttcctttaacccgttaccgtttccccccgttaacccggttacccttaacggtttccgttaaacggtaccttaaaccccgg

SEQ ID NO: 52238 - DNA, 812 bp, Homo sapiens
  misc_feature: GYAE6OF01CPRP3.18.11.A11.1.454.CMB.1.raw
  modified_base (305)..(305): a, c, t, g, unknown or other
  misc_feature (305)..(305): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcggtgatcgacccagtcctccagacctccctggttgtgtctcgtggcgagaggccacatcaactgacaacgtccagaccagtacgttgtttaatacagtcctaccaaactaaataactaactacgttagcttggaccagcaagaaacaggacaccgacccctaaggtcctactacgtttacgnggactacgtaccgtaccggggtcgttcccggggtccctacggaccgtagttcgaaggacggtccgtacgggtcgggtcgtacgggactacgtactttaccgaccttactaccaacccgtacttacccgaaccctaaacccgttggaaccgtaacggtaccgttaaggaaaccggtgttacggtacggtaacttaacgggtttttaataccgtacggttacaacggtacctaaatttaaccgtaacgttaccgttaccccttacttccggtaacccgtaacggggttccgggaaccggggtaaacgggtaacccgtaaggggttaaccgggtaacgttaaccggttaaacccggtaaacccgggttaggtaccgggttaaccggtaccgttaccgaccccgttaaacccgttacgtttacccgtttacgggttacccttaacccgttaacgtttcccccccgttaaccgtaacccgttcgttaaccgttaccgtaaaccggttaaccc

SEQ ID NO: 52239 - DNA, 689 bp, Homo sapiens
  misc_feature: GYAE6OF01AHM1S.18.11.A11.1.454.CMB.1.raw
  modified_base (210)..(210): a, c, t, g, unknown or other
  misc_feature (210)..(210): n is a, c, g, or t
  modified_base (223)..(223): a, c, t, g, unknown or other
  misc_feature (223)..(223): n is a, c, g, or t
  modified_base (293)..(293): a, c, t, g, unknown or other
  misc_feature (293)..(293): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctcgtgggcgagagggccaccatcaactgcaagtccagccagagttgttttanacagctaccaaanaataacaactacttagcttaggtaccagcaacgaaaccaggacacgacccctaaggtcctactattacgngggtcacgtccgtacccggggacgtcccggggtcctggaccgtattacgaggaggcgaggcgggtcgtagggactagtactttcacctctcacctatccaaccaacctgacgaggtcctaggaagtagtcggtaggtacttaggtttattacgtagtacagtactaaactactactaccgttccctcccgtcttaccgtacgggtttaccgggaccgggtaacgggtaacccggttaagggtacgggtaaacgtaaccgtaaaccggtaaaaccggtacggtcgggttacggaccgttaaccgaccgtaacccgtaggttacccttgggttacccctttaccgtaaccttccccgttaccccgtacctaaccgttccgttaccgtaaccttaaccg

SEQ ID NO: 52240 - DNA, 667 bp, Homo sapiens
  misc_feature: GYAE6OF01D9FL5.18.11.A11.1.454.CMB.1.raw
  modified_base (215)..(215): a, c, t, g, unknown or other
  misc_feature (215)..(215): n is a, c, g, or t
  modified_base (305)..(305): a, c, t, g, unknown or other
  misc_feature (305)..(305): n is a, c, g, or t
tcagtacgagtatgcacgaccggtgctcgatttagctacgactgcaggggcagcaagatggtgttgcagacccaggtcttcatttctctgttgctctggatctctggtgccggacggggacatcgtgatgacccagtctccagacctccctggttgtgtctcgtgggcgaggagggcccaccatcaactgacaagtccagccagagttgttttanacagcctaccaaacaaataacaactacttagtcttacggtaccagacaacgaaaccaggaccaccgccccctaaggtcctctatttacgnggcatccgtacccggggtacggtcccggggtcctcggaccgtattcgaggaggcagggcgggtcgtgggacagtacttcactcctccaccactaccaacccaacctcgaccgaggaccgtagaacgtatcggtaggtaccttaagtttaattaccgttagtacgagtactaaattacttaacgttacgttccctaccgttacgtaccgtaccgggtttcgggacgggtaacgggtaaccggagggtacgggaacgtactaaccgaaaccggtacgttcggtacggctacggacccaacgtcgtaccgttcgttcctaccgtacttccccgttaccctccgtattaccgtacgaccttaaccg

SEQ ID NO: 52241 - DNA, 888 bp, Homo sapiens
  misc_feature: GYAE6OF01A3KRI.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtgccggacggggacatcgtgatcgacccagtcctccagacctcccgtggttgtgtctcgtgggcgaggacgggcccaccataccaactgacaacgtccagacccgaaggtagtttagttttaactacgacgtacctaaccaaactaaaactaaacctaaaccttaacttagtaccgtttacggtaacccaagacgaaacgaaaaccgtacggaaccaccggtaaccccccgttaaggttacccttacctaacttttaccggtacgggtacctaccgttacccggtaaccccggggtacgggttaccccggggttcccctaaccgggtaacccgtacgttaccggacggaccgggacgtacgggtccgggtacgtacgggaactacggttactttccgaccgtcctaccgaccctacgtacccaacccgtaacccgtacgaccgtaacggtacgtaacggaaggttagtacggtaacgtacgttttaacgtttacgttaacggttacgttaacgaacgtactaaaacgtttaaccgttaacggttaccctttaccccgttacccttaccgttaccggttaaccggggtttaccggggaacccgggtaaacgggtaacccgggtaaacgggttgggtaaaccttaaccgtaaaccgggtaaagtaaccgttcgggtaacggtcgttacccgaacccttaaaccgtccgttacgttacgttcccttacccgtttaccgttccccgttccccctaactaccgttcccgttacgtaacccgttacg

SEQ ID NO: 52242 - DNA, 783 bp, Homo sapiens
  misc_feature: GYAE6OF01A4HXX.18.11.A11.1.454.CMB.1.raw
  modified_base (419)..(419): a, c, t, g, unknown or other
  misc_feature (419)..(419): n is a, c, g, or t
tcagtacgagtatgcacgaccggtgctcgatttagctacgactgcaggggcagcaagatggtgttgcagacccaggtcttcatttctctgttgctctggatctctggtcgccggacggggacatcgtgactcgacccagtcctccagtacctcccgtggttgtcgtctcggtcgggcgacggacggacccaccatacaacgtcgacaacgtccacgaccgagtagtttattttacacgagtcctaaccaaacaactaaccgtaacttacgttacgtccgttacgaaccacgactaaccgaaccgaaggaccaccgtacccccgttaaggtccttactacgtttacgcgggtactaccgtacccggtaccggggtaccggtcccgggtccctaggaccgtacgttacggacggaaccggntaaccggggtccggttcggaccggtaacgtacgtaccttactacccgtctaccaaccgactaacccgtaaccctacggtacgcggtaaccggtactaggtaagtaccgttggtacgtaaccgtttagtttacgttatacggtacgaactaaccttaaagttacgttacccgttacgttcccttaccgtacttacccgggtaacggtccggggtaaacggaccggtaaaccggtggaaggtaaccgtaacttaaccgaacggtacgttcggcggtacctaccgaccgtttaccgatttacccgttgtcccgtaaaccttcccgttcccgtacccgacttacccgtagtaaaccgtccgttaaccg

SEQ ID NO: 52243 - DNA, 628 bp, Homo sapiens
  misc_feature: GYAE6OF01APSFG.18.11.A11.1.454.CMB.1.raw
  modified_base (230)..(230): a, c, t, g, unknown or other
  misc_feature (230)..(230): n is a, c, g, or t
  modified_base (289)..(289): a, c, t, g, unknown or other
  misc_feature (289)..(289): n is a, c, g, or t
tcagtacgagtatgcacgaccggtgctcgatttagctacgactgcaggggcagcaagatggtgttgcagacccaggtcttcatttctctgttgctctggatctctggtgccgacggggacattcgtgatcgacccaggttccacagacctcctggttcgtgtcctgtaggcgacgaggccacctatcaaccgtgtacaacgtccagccgtagtagttcgtttaaccaagntcctaccaataactactaaaccgtctaggtccttgaactgacaacgaaccaggtaaccncccgtaccgtactccgtaatacgttagacgtctacggtacgtaccggaccggttcccgaccgtggtacctagtccgaagacgacgggttagtcggagtacggtactactattccgtaacgtccgaacctcggaacctacgtaactcgacgtacgtagtcgtaacgtagagttgttaccgtatacggttatcgtacgtacgtactactacgtactactacgtctacgtactacgacgtacgcgtcgtacgacgtcgtacgtacgtacgtacgtacacgtacgtacgtacacgtacgtctactactctacgtacgtacctctacgtatacgtcgtcgtacg

SEQ ID NO: 52244 - DNA, 723 bp, Homo sapiens
  misc_feature: GYAE6OF01A6NSM.18.11.A11.1.454.CMB.1.raw
  modified_base (210)..(210): a, c, t, g, unknown or other
  misc_feature (210)..(210): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagacctccctggttgtgtctcgtgggcgagaggccacatcaactgcaagtccagccagagttgttttaanacacgctaccaaactaactaaacaacttacttagcttaggtaccagacaagaaaccgaggacaccgaccccgtaaggtcctactactttacgtggacactccgtacccgggacggttccccggggtccctacggacccgtattacgaggacggacgacgggtcggggtacgtcggggaactacggttactttccgaccttcctcccaaccaacttacccaacccctaaccgtcgacgtacggcgtagaaacgtagttcggtacggtacgttacgtttattacgtgttacgagtacctaaacttacgtacgtttaaccgttccccttacccgttcttacccggttaccgggttaccgggtacggggtaaccgggtaaccggtaaggggtaccgtaagtaaccgtaaccgaaaccgtacggttaggccgggtacttaccggctaaccgtcgttacgtccgttcttaccgtaacccttttcccgtccgtacccttataccttcgtaacttaaccgg

SEQ ID NO: 52245 - DNA, 826 bp, Homo sapiens
  misc_feature: GYAE6OF01BFIZ6.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctcgtgggcgagagggccaccatcaactgcaagtccacgccagagttgttttaatacacgctaccaaacaataaaccaacttacttacgcttacggtaccagacaacgaaaacccgaggaaccacgtaccccccgtaaggttccctactatttacgtgggactacgtcccgtacccggggacggttcccgggggtccctcggaccgtattacgaggtacggcgagggtccgggtcgtacgggaactaggtaactttcgaaccttcctaccaacctacttacccgaaccctaacccgttacggcggtaacggaccgttaggaaacgtacgttaggtccggtaacgtttaagttttacgtttaaccgttcggttaaccaacgtaaccttaaacgttaacgttaaccgtttaccgttacccctttccttaccgtttaccggtaccgggttttacccgggggaacgggtaaccggggaaccgtaacgggggttaacgggaaacgttaaaccgtaaccgaaaacggtaccggttacgggtaccgggtaccgtttaccggaccctaaaccgttaccgttacccgttttacgttcccgttttaaccctaccggttttaccccccttacccgggtaccccttaaacgtttccgttaaacggtaccctttaaacccgg

SEQ ID NO: 52246 - DNA, 692 bp, Homo sapiens
  misc_feature: GYAE6OF01D4CK1.18.11.A11.1.454.CMB.1.raw
  modified_base (218)..(218): a, c, t, g, unknown or other
  misc_feature (218)..(218): n is a, c, g, or t
  modified_base (441)..(441): a, c, t, g, unknown or other
  misc_feature (441)..(441): n is a, c, g, or t
  modified_base (487)..(487): a, c, t, g, unknown or other
  misc_feature (487)..(487): n is a, c, g, or t
  modified_base (586)..(586): a, c, t, g, unknown or other
  misc_feature (586)..(586): n is a, c, g, or t
tcagtacgagtatgcacgaccggtgctcgatttagctacgactgcaggggcagcaagatggtgttgcagacccaggtcttcatttctctgttgctctggatctctggtgccggacgggacatcgtgatcgaccagtcctccagtacctccgtggttgtcgtctcgtggacgagacggccacatcaactgacaagtccagccaagtagtttagttttanactacgtcctaaccgaaaactaaactaaacctaacttacgttacgtcgttacggtaccagaacaacgaaaaccgacggaaccgaccgtacccccttaaggtccttactacgtttacggcggaccttacgtaccccgggtacccggggtacggttccccggggtccctaggacccgtagttacggagcgggcgaggtccggtacggtaggactagtctttaccncttccacaccgtcaccaaccgtactcgacgcgacgtaaggtaacgngttcggagttacgttaagttttactactgtacacgtaactaacgttattactcccttccttccgtccgtcggtaacgggtccgaacgggcggtaacggnggtaagggataccgaacgtaacgagttgggtacctcgacctacacgttaccttcttacgttcctactcccgtttacccgcctacgttatacgtacgacctttacgg

SEQ ID NO: 52247 - DNA, 875 bp, Homo sapiens
  misc_feature: GYAE6OF01DVNTV.18.11.A11.1.454.CMB.1.raw
  modified_base (124)..(124): a, c, t, g, unknown or other
  misc_feature (124)..(124): n is a, c, g, or t
  modified_base (219)..(219): a, c, t, g, unknown or other
  misc_feature (219)..(219): n is a, c, g, or t
  modified_base (865)..(865): a, c, t, g, unknown or other
  misc_feature (865)..(865): n is a, c, g, or t
tcagtacgagtatgcacgaccggtgctcgatttagctacgactgcaggggcagcaagatggtgttgcagacccaggtcttcatttctctgttgctctggatctctggtgccgacgggacatcgngatcgaccagtctcagccttccgtggttgtgtctcgtgggcgagacggccaccatacaactcgctaacgccagtccgaggtactttgtttttaanacagtccaaccaaacaataaacctaaccgttacttagtcgtttagaaccgagacacgaaacacgaccgaccgaccccttaaggtcctatacgtttacgtacggtacctacgttaccggaaccccggggcggtttcccggggtaccctaggtaccgtactttacgaacgggcggtaaccgggtcgggttccgggtacgggtacgtaacggtaccgtttaccgtaaccgttccgtacgtaacccctacgtttaacctaaaccccggaacccgttaacgtaccgggaccgttaaccgtttagggaaaaccgttagggggttctttaccgggtaaggtttaacccggtttttagttttaacggtttaccgtacgtttaaccggaattaaccgtttaacttaacgtttacggtttaaccccttccgtttaaacgtcccggtttaacggtttacccggggtacgggttaacccgggaacggggttaacccgtaaaggggggtaacctaacgggttaaactaaaccggggtaaaacgtttcccgggttacggacccggttacgtaaaccccggtccgttaaaccgttccgttaccgtttacttacccgttaacttccccgttaaccggtcctaccgttcgtttacgaaccttnttaaacccgg

SEQ ID NO: 52248 - DNA, 888 bp, Homo sapiens
  misc_feature: GYAE6OF01BWCBM.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtgccgacgggacatcgtgatcgacccagtctccagacctcccgtggttgtgtctgtgggcgaggacgggccaccatcaactgacagtccagccagtagttgttttatacagacctaccaaaacaactaaactaactacttagcgttacggtaccagacaacgaaaccaggaccacgaccccgtaggtcctactactttacgtcggactacgtaccggtacccggggtacgggttccccggggtaccctcggtacccgtagttaccggaaggacggcgacgggtccgggttacggacgggtaacgtaacggttactttaccctacgttaccctacccgaacctaacctaaccctaaacccgtaaccgtacggtacccgaagggtaccctaagggtaaacggaacgtttcgggtacgggttaacctttaacgggtttttaacttaccgttacgttaaaccgacggttaaaccgttaaacgttaccgtttaaacgttcccggttacccccgtttaccccgtttacctaacccgggtttaccggggttacccgggggtaacccggggtaacccgggtaaaccggtaaacggggttacggtaaccgggtaaaccttaaacccgggaaaaccgttaccgggttcggtaaccgggttacccgtaacggtaacccctaaccgtttaccggttacttttacccggttaccgtttacccttaacccgttttacccccccgttaccccggaacctttaacggttccccgttaaagtacccccgtttaaacgg

SEQ ID NO: 52249 - DNA, 650 bp, Homo sapiens
  misc_feature: GYAE6OF01BKDK5.18.11.A11.1.454.CMB.1.raw
  modified_base (217)..(217): a, c, t, g, unknown or other
  misc_feature (217)..(217): n is a, c, g, or t
  modified_base (220)..(220): a, c, t, g, unknown or other
  misc_feature (220)..(220): n is a, c, g, or t
  modified_base (294)..(294): a, c, t, g, unknown or other
  misc_feature (294)..(294): n is a, c, g, or t
  modified_base (377)..(377): a, c, t, g, unknown or other
  misc_feature (377)..(377): n is a, c, g, or t
  modified_base (392)..(392): a, c, t, g, unknown or other
  misc_feature (392)..(392): n is a, c, g, or t
  modified_base (424)..(424): a, c, t, g, unknown or other
  misc_feature (424)..(424): n is a, c, g, or t
  modified_base (638)..(638): a, c, t, g, unknown or other
  misc_feature (638)..(638): n is a, c, g, or t
tcagtacgagtatgcacgaccggtgctcgatttagctacgactgcaggggcagcaaggatggtgttgcagacccaggtcttcatttctctgttgctctggatctctggtgccggacgggacagtcgtgatcgacccagtcctccagacctcccgtggttgtcgtctcgtggacgagacgggccaccatcgaactgcaagcacgcagtagtcgtttanacngcctactaaacaataactaactattagcttaggaccagacaacgaaaccaggacaccggacccctaaggtcctnaagtttacgcggtactacgtccgacgggtacgtcccggtaccacgtaccgtatcgagaggacgcgggtacggtccgtaggacncggtaacttcgaacnctacgaactcacaccgacttgccaggtactanaagtgcgtagacgttagttacttacgtgttacgacgaactaactactaacgttccgttaccctcgttacctccgttacgggtaccgggaaccggtaagggtaaccctaagggacggtaagacgtacgtaaaacgcgttaacgtcggacgttccgaccgtacgtacctccgttacgtacctttccaaccgtttccctacccgacttaccttacgngtaaacgttccc

SEQ ID NO: 52250 - DNA, 743 bp, Homo sapiens
  misc_feature: GYAE6OF01CNBA0.18.11.A11.1.454.CMB.1.raw
  modified_base (219)..(219): a, c, t, g, unknown or other
  misc_feature (219)..(219): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatcgacccagtctccagaccttcccgtggttgtgtctcgtgggcgaggacggccacatacaactgacaagtccagccagtagtttgttttaanacagtcctaaccaaactaaataacctaaccttacttacgcgttacggtaccaagaccaacgaaaccacggaccaaccgtacccccgttaaggtcctacgtactttacgcgggtaccacgttccggtaacccggggtacggtcccggggtcctacggaccgtagttcgaggacggcgacggtcggtcgagggactagtactttccgactccacacctactacccgaacctaaccgtcgacgtacggtacgtagaacgtgtcgttacgggtacgtttaacgtttacgttacgtacgtacgaagtacctaatacttacgttacctcccgttccgtaccgttcgaccgggttacgggaccgggtaacgggaaccggtaagggacggtaacgtaacgtaaaccggtaaacggtcgtacgggtacggtccgtacgaccctaccgttacgtttaccttaccggttcccttaccgttaccccgttacccccgtcccgttaccctacttaacccggtctaacccgtttaccgg

SEQ ID NO: 52251 - DNA, 684 bp, Homo sapiens
  misc_feature: GYAE6OF01ATOEE.18.11.A11.1.454.CMB.1.raw
  modified_base (210)..(210): a, c, t, g, unknown or other
  misc_feature (210)..(210): n is a, c, g, or t
tcagtacgagtatgcacgaccggtgctcgatttagctacgactgcaggggcagcaagatggtgttgcagacccaggtcttcatttctctgttgctatggatctctggtgccggacggggacatcgtgatgacccagtctccagactccctggttgtgtctctgggcgagagggccaccatcaactgcaagtccagccagagttgttttanacagcctaccaaacaataaccaacttacttagcttcggaccagacaacgaaaccaggacacgaccccctaaggtcctctatttacgcgggacacgtccgtacccggggacgtcccggggtccctggaccgtattcgaggacggcagggtcgggtcgtagggactaggtactttcaccttccaccacctactccaacccaaccgtgaccgtaggctaggaacgtagttggtcggtacttagtttacttacgttgtacaacgtactaaacgttactaattaccgtcccttaccctacgttacccgtacgggtttccgggacggggtaacggtaaccggtaagggtacggtaagtaacgtaaccgtaaaaccgtacgtacggtcggaccttcggaaccctaccgtacttccgtacgtttccttaccgtaccgtttaccccgttaccccgtacctaacttccgtacgtaccttaaccg

SEQ ID NO: 52252 - DNA, 766 bp, Homo sapiens
  misc_feature: GYAE6OF01D7XWY.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtgccgacggggacatcgtgatcgacccagtcctccagacctccctggttgtgtctcgtgggcgaggacgggccaccatcaactcgacaacgtccacgccaaggtagtttgttttaacacacgcctaccaaacaaataacctaactacttagcttacggtaccagacaacgaaaccgaggaccaccgtaccccctaaggtcctactatttacgcggactacgtccgtacccggggtcggtcccggggtccctacggaccgtacgttacgaacggacggccgagggccggggtcgtgggaacagttactttccgaccttcgtaccacctactaccaacccaaccgtggaccgtacggcctaggtaacgtgttacgggtcgtacttaagttttaacttaccgttaggtccaaggtaactaaacttaccgttacgttaaccgttccccgttccttaccgttaccggttaccggggttaccggggaccggggtaaaccggggtaacccgttaaaggggtacggtaacgtaaccgttaacccggtaaaagtaccggttcggtaccgggccttacggacccctaaacgttccgttcgttaccggttcccttaccggtaccctttccccgttaaccccgcttaccttaccggtcgaactttaacccg

SEQ ID NO: 52253 - DNA, 843 bp, Homo sapiens
  misc_feature: GYAE6OF01ARGM7.18.11.A11.1.454.CMB.1.raw
tcagtacgagtatgcacgaccggtgctcgatttagctacgactgcaggggcagcaagatggtgttgcagacccaggtcttcagtttctctgttgctctggatctctggtgccggacggggacatcgtgatcgacccagtctccagacctcccgtggttgtgtcctcgtcggggcgaggacgggcccaccataccaactggccaagtccgagccgtaggtacgttgtttttaacaccgagtcctaccaaaactaaacgtaaacctaaaccttaccgttacgtaccgtttacgggtaacccacggaccgaaaccggtaaaaacccgacggtaacccgtaacccgtaacccccccggtttaaacgggttcccttaccttacggttttaaccggtcggggacctaaccgttaccccgggtaaccccgggggtaccggttaccccgggggttccctacgggtaacccgttcgttaaccggaacggtacgggtacccggaacgggttccccggggttacggtacggggaaccgtaacggtttacttttacccgaacctttcccgactacccgaaccttaacccaaacccgtaaccgtcgtacccggtaggtaccctaggtaacggacgttggtcggtacgtttaacgtttacgttaacgtcgtaagtacggtacttaactcgttactacgtcccttctccgtagtccgtacgggacgtaacgggacgtaggggtacgtagtactaaccgtaacgtacgttcggcgtaccgtcgacctaccgtacttccgtagtttcccctacgttcccgttcccgttaccgtaccctaagttcccgtataccgttaacg

SEQ ID NO: 52254 - DNA, 842 bp, Homo sapiens
  misc_feature: GYAE6OF01D8DQF.18.11.A11.1.454.CMB.1.raw
  modified_base (217)..(217): a, c, t, g, unknown or other
  misc_feature (217)..(217): n is a, c, g, or t
tcagtacgagtatgcacgaccggtgctcgatttagctacgactgcaggggcagcaagatggtgttgcagacccaggtcttcatttctctgttgctctggatctctggtgccggacggggacatcgtgatcgacccagtctccagtacctccctggttgtgtctcgtgggcgagacgggccaccatcaactgacagtccagccagtagttagttttanacacgacctaccaaactaactaacaacttacttagtcgttacggtaaccacgactaacgaaaaccacggaccaccgtacccccgttaaggtcctactaactttacggtcgggtactacgttaccggtacccgggggtaccggttaccccgggggttaccctacggtacccggtacgtttaccggaacgggtacgggtaccgacgggtccggggtcggtacgggtactaacggttacgtttacctaccgttccctacctaacctaacctacccgaaaccgtaaccgtacggaccgtaacggtacgtaacggtaacgtagtacggttacggacgtttaacggttttacttaaccgttcgtacgtaacttacctaaagtttccgttaattacccgttcccctttacctaccgtaccggttaaccgggttcgggaaacgggtacgggtaaacggaagggtacgggtaaacgtaaccgtaaccggtaaaccgtaggtttacggtacgggaccgtaccggtaccctaaaccgttaccgttcgtttaccggttccctttacccgtacccgtttaccccccgttaccccggacccgtttaacgttccctaaagggtaaacccctttaacccgg

SEQ ID NO: 52255 - DNA, 838 bp, Homo sapiens
  misc_feature: GYAE6OF01EZ3HT.18.11.A11.1.454.CMB.1.raw
  modified_base (123)..(123): a, c, t, g, unknown or other
  misc_feature (123)..(123): n is a, c, g, or t
  modified_base (390)..(390): a, c, t, g, unknown or other
  misc_feature (390)..(390): n is a, c, g, or t
  modified_base (541)..(541): a, c, t, g, unknown or other
  misc_feature (541)..(541): n is a, c, g, or t
  modified_base (566)..(566): a, c, t, g, unknown or other
  misc_feature (566)..(566): n is a, c, g, or t
  modified_base (766)..(766): a, c, t, g, unknown or other
  misc_feature (766)..(766): n is a, c, g, or t
  modified_base (791)..(791): a, c, t, g, unknown or other
  misc_feature (791)..(791): n is a, c, g, or t
tcagtacgagtatgcacgaccggtgctcgatttagctacgactgcaggggcagcaagatggtgttgcagacccaggtcttcatttctctgttgctctggatctcgtggtcgccggacgggganacgtcggtagatcgaccctagtcctccacgtaccttccgtggttgtcgtctcggtgggacgaggacggcccaactactacgaacgtgacgtaacgtccgacgccgtaaggtagttttagtttttaacaacgcttacctaaccaaaactaaattaaccgtaacttacgttacgtccgtttacggtaaccaaggaccaaaaccggaaacccgaggaaccccgtaccccgtaacccccgtttaagttccctaagttaacgtttacccggngggtacctaaccggtttacccgggaccccgggggttaaccgggttccccgggggtaccccttaaggacccgttacgtacggaacggtacgggcgtaacggggtccgttaggacggtacgtaactttcctacgtcctactaccaaccgtacncccgaaaccctggacgcgtaacggntaaaggtacggtacgttagtacggttagtttaactttacgttaccgtacgtacgacgtaacttaaccgttaccgttacttacccgttacccgttaccgttaccgggttacggtaccgggtaccggggaacgggacggtaaaccggtaaggtaccgggtaacaaccggtaaccgtaacgtcgacggtccgaccgttaaacnccgtaaccttcgttacgtacccttntaccgttaccggttcccctacgaccgttacacttacgtaacgttccg

SEQ ID NO: 52256 - DNA, 722 bp, Homo sapiens
  misc_feature: GYAE6OF01CGNQS.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtgccgacggggacatcgtgatcgacccagtcctccagacctcccgtggttgtgtctcgtgggcgaggacgggccaaccatcaactgacaacgtccagccagtagttgttttacacagcctaccaaactaaactaacctaacttacttagccgttacgtaaccagacaacgaaaccaggaccaaccgtacccccgtaaggtcctactactttacgtggaccactaccggtacccgggtacggtcccgggtccctgacccgtatcaggacgcgacggtcgggtcgtagggactagtactttccacttcgaccaccgtactacccgaacctaaccgtcgaccgtacggtacctaaggaatacgttggtacgtacgtttaacgttttactacgttacggtacgaacgtaacttaaacgttaccgtaacgtttaccgtccccttaccgttaccgttccgttaaccgggttccgggaacgggttaccgggaaaccggttagggtaacggtaacggttaacctaaaccggaacgttacgggtacggttcgactaccggactacggttactcgtacgttctcctaaccgttcccgttacccacttactcggtacacgttaccg

SEQ ID NO: 52257 - DNA, 717 bp, Homo sapiens
  misc_feature: GYAE6OF01BHQMX.18.11.A11.1.454.CMB.1.raw
  modified_base (136)..(136): a, c, t, g, unknown or other
  misc_feature (136)..(136): n is a, c, g, or t
  modified_base (212)..(212): a, c, t, g, unknown or other
  misc_feature (212)..(212): n is a, c, g, or t
  modified_base (296)..(296): a, c, t, g, unknown or other
  misc_feature (296)..(296): n is a, c, g, or t
tcagtacgagtatgcacgaccggtgctcgatttagctacgactgcaggggcagcaagatggtgttgcagacccaggtcttcatttctctgttgctctggatctctggtgccggacggggacatcgtgatcgacccngtctccagacctccctggttgtgtctcgtgggcgagaggcccacatcaactgcaagtccagccagtgttgttttanacagcctaccaacaataacaactacttagcttaggacagacaagaaccaggaccacgtaccccgtaaggtcctactatttacgngggctacgtccggtaccgggtacgtcccgggtccctggaccgtagttcgaggtagcgagggcgggtcgtgggacagtacgtttaccaccttactacccaacctactacccgaaccctaaccgtacggaccgtagggaccgttaggaagtacgttacgggtacggttacttaacgttttagtacccgttgtacgtacgtacgttaagttaacttagtacgtacgttacgttccgggtaccggttaccgggaacccggtaacgggtaacccgtaaacgggtcggtaaacgtaacgtaaccgtaaaacgtaacggtcggtacggtacgttaccggacctacccgttagtcgtttcgttaccttcgttaccgttccccgttaccccgaccttacgttacgacccgttaacgtacgttaaccccgg

SEQ ID NO: 52258 - DNA, 791 bp, Homo sapiens
  misc_feature: GYAE6OF01CDUVH.18.11.A11.1.454.CMB.1.raw
tcagtacgagtatgcacgaccggtgctcgatttagctacgactgcagggcagcaagatggtgttgcagacccgagtcttcattctctgttgctctggatctctggtcgccgacgggacatcgtgatgacccagtctccagacctccctggttgtgtctcgtgggacgagacgggcccactactacaactcgacaacgtccagccagtagttgttttacacacgcctaccaaacaactaaccgtaactacttacgtcctttacgggtaccacgaccaacgaaaccgacggaccgtaccgtaccccccgtaaggtcctacgtactttacggtggacctacgtacccggtacccggggtaccgggttcccggggtaccctacggtacccgtaacgtttaccgaagggacggtccgtacgggtccggggtcgttacgggaccgtaagtttactttcccgaaccttccgtaccctaacctacctaccctaacccgtaacctcggacgtacggtccgttaagaacgtagtccgggttagtacctttaacggtttaacttctacggttacacgtacctaaattacctaaacgttacctacccttaccgttccttccggtacggtttaccgggaccgggaacgggtaaccggaagggtacggtacgtaaccgtaaccgtaaacggtacgtacggtccgttacgaaccgaccgttaacggcttaccttacggttacctttcccgtaaaccgtttccccgttaccccgtaccgttacttacccgtacgttaaccggtaccg

SEQ ID NO: 52259 - DNA, 796 bp, Homo sapiens
  misc_feature: GYAE6OF01AVORA.18.11.A11.1.454.CMB.1.raw
  modified_base (215)..(215): a, c, t, g, unknown or other
  misc_feature (215)..(215): n is a, c, g, or t
  modified_base (258)..(258): a, c, t, g, unknown or other
  misc_feature (258)..(258): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatcgacccagtctccagactcctgttcgtgtctcgtgggacgagacgggccaccatcaactgacaacgtccagccagtagttgttttanacagcctacaactaataacaactacgttacacttcggtaccancaacgaaaccgaggacacgtacccctaaggtcctactattacgacgggcacgtccgtaccgggtacggtacccggggtcctacggaccgtataccgtacggacggacgtacggtcgggtagtacgggaactacggtaactttcgaaccttctaccgtaaccaacttacccgaaccgtaacccgttagaacggtaccggtacgttacgggtaaacgtaggtacgggttacgggtaacctttaacgggttttaacctttaaacggttaccgttaacgtaacggaacctttaaacttaacccttaaagttacccgtttacccttaccgttacccgttaccgtaaaccgggtttcccgggaacgggggtaacccggtaaccgggtaacgggttaaccgggtaacggtaacctaacggtaaaacccggttaagttacccggggtacggtacgtaaccgtacgaaacccgtttaacgttcttacgttacccgttacgtaacctttcccgttaccccgaccgttactcccggaattacctaaccg

SEQ ID NO: 52260 - DNA, 658 bp, Homo sapiens
  misc_feature: GYAE6OF01BQN5H.18.11.A11.1.454.CMB.1.raw
  modified_base (215)..(215): a, c, t, g, unknown or other
  misc_feature (215)..(215): n is a, c, g, or t
  modified_base (297)..(297): a, c, t, g, unknown or other
  misc_feature (297)..(297): n is a, c, g, or t
tcagtacgagtatgcacgaccggtgctcgatttagctacgactgcgaggggcagcaagatggtgttgcagacccaggtcttcatttctctgttgctctggatctctggtgccggacgggacatcgtgatgacccagtctccagacctccctggttgtgtctcgtgggcgagagggccaccatcaactgacaagtccagccagtagttagttttanacagctaccaaacaataacaactacttagcttaggaccagcaagaaccaggacacgaccccctaaggtcctactatttacgngggactagtccgtacccgggacggtcccgggtccctggacccgtagtttccgaggacggacgacggtcgggtcgtgggacagttactttccgactccgtacgacctaagtccaacccgtaaccgtcggacgtaggccgtaaggaacgtagtggtacgtacgttaagtttacttacgtcgtacaagactaacttacgtatacgtcccttcctaccgtcgtacggttccgggacggaacggaccgaagggtggaacgataccgaaacgtacgtaggtcggccgttgacccttaccgacttacgttcggttccttaccgtacgttccccgttacccgacctacttaccgtacgaaccttaaccg

SEQ ID NO: 52261 - DNA, 798 bp, Homo sapiens
  misc_feature: GYAE6OF01BM84X.18.11.A11.1.454.CMB.1.raw
  modified_base (233)..(233): a, c, t, g, unknown or other
  misc_feature (233)..(233): n is a, c, g, or t
tcagtacgagtatgcacgaccggtgctcgatttagctacgactgcaggggcagcaagatggtgttgcacgacccaggtcttcatttctctgttgctctggatctctggtgccggacggggacatcgtgatcgaccctagttctccagtaccttcccgttggttgtcgtctcgtgggcgaggacggccaccatacaacgtgacgtaacgtccgagccagtacgtttgttttaanacgacgtacctaccaaactaaactaaccgttaacttacgttacgtcgttacggtaaccacgaccgtaacggaaaccgtacggaaccgtacccgtaccccgttaacggttacctacgttacgtttacgacggtacctaccgttacccgggtaccgggtccggttacccgggtaccgtacggaccgttacgttacggacggtacgggcgtacggggttcccgggtcgtacggggtaaccacggtttacttaccgaccttaccggtaacccaaccgtaaccgtacccaacccgtaacccgtcgtacgtacggtacgtaagttacgtacggttcggtacgttaacctttagttacttacgtacgtaaccgtacgtaactaattaccttaacgttccgtacccgtacgtacgtacgggtaccgtccggggacgtaaccgggaatacgggtagtacgtaactaaccgtaagtacttgggacttcgtaccgaaccgtacgtcgttcttacccgttcgtaccttcccggttaccctacccggacgtttaccaccggttccgttaacgtcccgg

SEQ ID NO: 52262 - DNA, 740 bp, Homo sapiens
  misc_feature: GYAE6OF01BZI0V.18.11.A11.1.454.CMB.1.raw
  modified_base (218)..(218): a, c, t, g, unknown or other
  misc_feature (218)..(218): n is a, c, g, or t
  modified_base (630)..(630): a, c, t, g, unknown or other
  misc_feature (630)..(630): n is a, c, g, or t
tcagtacgagtatgcacgaccggtgctcgatttagctacgactgcaggggcagcaagatggtgttgcagacccaggtcttcatttctctgttgctctggatctctggtcgccggacggggacatcgtgatcgacccagtcctccagacctccgtggttgtgtctcgtgggcgagacgggccacatcaactgacaacgtccagccagtagtttgtttanacagtcctaccaaacaaataaccaacttacgttagtacgttacggtaccagacaacgaaaccgaggacctacccgaaccccgttaacgtccttactacgtttcggcgggacctacgtcccggtaccggggtcgggttacccgggtcccgtacggaccgtactacggacgacggacggacgggtccgggttacggtacgggactagttactttccgacttcctacccgacctactacccaaccgtaaccgtcgacgtacggtactaaggacgttaaggttcggtacgggttacctttaagttttacgtaacgttcgaaccgtaacgtaacttaaacgtttactaccgtttaccgttccctacccgttacgtcgttaaccgggtcgggacgggcgtaacgaggtagaacgtaanaacccggtaacgtacgttcggcgtactaccgagttaacccgttcgttacttcggttcccttactcccggtttaaccctccccgaacttcgtaccttataaccgttaaccg

SEQ ID NO: 52263 - DNA, 619 bp, Homo sapiens
  misc_feature: GYAE6OF01EBPLL.18.11.A11.1.454.CMB.1.raw
  modified_base (230)..(230): a, c, t, g, unknown or other
  misc_feature (230)..(230): n is a, c, g, or t
  modified_base (439)..(439): a, c, t, g, unknown or other
  misc_feature (439)..(439): n is a, c, g, or t
  modified_base (535)..(535): a, c, t, g, unknown or other
  misc_feature (535)..(535): n is a, c, g, or t
  modified_base (568)..(568): a, c, t, g, unknown or other
  misc_feature (568)..(568): n is a, c, g, or t
  modified_base (578)..(578): a, c, t, g, unknown or other
  misc_feature (578)..(578): n is a, c, g, or t
  modified_base (613)..(613): a, c, t, g, unknown or other
  misc_feature (613)..(613): n is a, c, g, or t
tcagtacgagtatgcacgaccggtgctcgatttagctacgactgcaggggcagcaagatggtgttgcagacccaggtcttcatttctctgttgctctggatctctggtgccggacgggacatcgtgatcgaccctagtcctccagacctcccgttggttgtgtcctcgtggggacgaaggacggcccaccatacaactcgacacgtccagcctagtagtttagttttaanacgacgtcctaccaaaacaaataaaccaacttacttacgtcgttacggtaccaagaccaaacgaaacccgaggaacccaccgtaacccccgttaacgtccttataacgtttcgtcggacctacgtccgtaccggggcgtcccgggtcctgacctatcgaggcgcgacggcggtgtacggactagtcttcactcacacactaccactacngacagctagatagtcgagtattagtttatacgtgacacactaagtctagttccttcctctcctcggtacggtacgggacgggtaacgacgtacggngtaactacgtaaccgaacgtacgtggacgtacncgactacctnttcgtcttcacctacttccctaccgctagtcctanataccg

SEQ ID NO: 52264 - DNA, 766 bp, Homo sapiens
  misc_feature: GYAE6OF01BCKXA.18.11.A11.1.454.CMB.1.raw
  modified_base (216)..(216): a, c, t, g, unknown or other
  misc_feature (216)..(216): n is a, c, g, or t
  modified_base (315)..(315): a, c, t, g, unknown or other
  misc_feature (315)..(315): n is a, c, g, or t
tcagtacgagtatgcacgaccggtgctcgatttagctacgactgcaggggcagcaagatggtgttgcagacccaggtcttcatttctctgttgctctggatctctggtgccggacggggacatcgtgatgacccagtctccagactccctggttgtgtctctgggcgaggacgggccaccataccaactgcaacgtccagccagagttgttttaanacacgcctaccaaacaaactaaacctaactacttagtcttaggtaaccagacaacgaaaccgaggaaccaccgaccccctaaggtcctactatttacgngggtaccacgtaccggtacccggggtacgtccccggggtacctacggaccgtacttcggagtacggcgacggtcgggtacgtagggactagtactttacgaaccttctacctaaccgactacccaacccaacccgttggaccgacggtactaaggaaacggtgttacggtacggtaacttaaggttttaacgtttacttaggttaccgtaagtaacctaaacgttaacgttactttaacccggttcccttacccttaccctaccgggtttacccggtcggggtaaccggggtaaccgggaaccggtaacggggttacgggtaacgtacggttaaacccggaaacgtaacggttcgtacgggaccgttccaccgtaaccttaccgtccttacggttccctttaccgtaccctttcccttaccccggtacttacgtcctaggtaccctaaccg

SEQ ID NO: 52265 - DNA, 734 bp, Homo sapiens
  misc_feature: GYAE6OF01BGDVD.18.11.A11.1.454.CMB.1.raw
  modified_base (218)..(218): a, c, t, g, unknown or other
  misc_feature (218)..(218): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatcgacccagtctccagactcccgtggttgtgtctcgtgggcgagacggccaccatacaactgacaacgtccagacctagagttagttttanacagtactaccaaacaaataaccaactactagcgtttacggaaccagacaacgaaaccaggacctaccgaccccttaaggtcctacgtactttacgcggtactacgtaccggtaacccggggtacggttcccgggtaccctaggacccgttatacggaacggtacgggaccgtacggggtcgggttaccggtacgggaactaacgtttactttaccgaaccttcccgtaacactaacccgtaccaacccgtacccgtaggaccgaacggagttaggaagtcgtacggtaggttaccttagttttataccgtgtaacgacgtaataaccgttactacgttccgtccctacctcgttacccggtacggtttacgggacgggtaacgggaacggtaaggtaccgggataaccgtaaccgaaacggttacggtacgggtagaccgtcgtaaccgacccttagttcgtacgttcctacgttcccgtcccgtttacccgactacttcgtacgtacgttaccg

SEQ ID NO: 52266 - DNA, 678 bp, Homo sapiens
  misc_feature: GYAE6OF01DH3JN.18.11.A11.1.454.CMB.1.raw
  modified_base (156)..(156): a, c, t, g, unknown or other
  misc_feature (156)..(156): n is a, c, g, or t
  modified_base (165)..(165): a, c, t, g, unknown or other
  misc_feature (165)..(165): n is a, c, g, or t
  modified_base (207)..(207): a, c, t, g, unknown or other
  misc_feature (207)..(207): n is a, c, g, or t
  modified_base (217)..(217): a, c, t, g, unknown or other
  misc_feature (217)..(217): n is a, c, g, or t
  modified_base (383)..(383): a, c, t, g, unknown or other
  misc_feature (383)..(383): n is a, c, g, or t
  modified_base (415)..(415): a, c, t, g, unknown or other
  misc_feature (415)..(415): n is a, c, g, or t
  modified_base (616)..(616): a, c, t, g, unknown or other
  misc_feature (616)..(616): n is a, c, g, or t
tcagtacgagtatgcacgaccggtgctcgatttagctacgactgcaggggcagcaagatggtgttgcagacccaggtcttcatttctctgttgctctggatctctggtgccggacggggacatcggtgatcgacccagtcctcagtactcctggtntcgtctagnggcgagtcggccacatcaactcgacagtcaagcagtaggttntttacagacncctacaaataaactaacaacgttactagtaccttaggtacagacaagaaaccgaggaacacgtaccctaacggcctactagtttacgacggctacgtaccgtaaccggggcgtcccggggtaccctaggacccgtattaccggacgaggaccgtaagggcccggtntagggacaaggttctttacggaccttccctanaaccctaacgtccaaaccctaagtcgacgtacggtacaggtaacgaagtcggtacgtaatacgttttagtacgtacgtacgacaactaagttactaagttacctcccttactacgtacggtacgtacgggaaccgggttagaacccgtaggggtacgtaataaagtacctaacgaacttggaacgtacgtacacgaacctntacctggtttaccctccgtacccgttactaccccggaacttagttaccctgaaaacttcccg

SEQ ID NO: 52267 - DNA, 839 bp, Homo sapiens
  misc_feature: GYAE6OF01DLRKJ.18.11.A11.1.454.CMB.1.raw
  modified_base (388)..(388): a, c, t, g, unknown or other
  misc_feature (388)..(388): n is a, c, g, or t
  modified_base (781)..(781): a, c, t, g, unknown or other
  misc_feature (781)..(781): n is a, c, g, or t
  modified_base (794)..(794): a, c, t, g, unknown or other
  misc_feature (794)..(794): n is a, c, g, or t
tcagtacgagtatgcacgaccggtgctcgatttagctacgactgcaggggcagcaagatggtgttgcagacccaggtcttcatttctctgttgctctggatctctggtgccggacgggacatcgtgactcgaccctagtcctccgagtaccttcccgtgggttcgtgtcctcggtggggacgaggaccgggccaaccattaccaaacgttcggaccaaacggttcccaacggtaccgtaaggtaacgttttacggtttttaacaaccgtacgtacccttaaccaaactaaacgtaacctaaccttacgttacgtcgttacggtaaccgagacaaacggaaaccacggaaccaccgtacccccgttaaggtcctacgtactttaccggngggtacctacggttaccgggtaccccgggggtaacgggttcccccgggggttccctacgggtaacccggtacgtttaccggaacggaccgggtcccggtaaggggtcccggggttacgttaacgggggaacctaggtttaacctttacccgtaacttacccgtaaccccaacgtaacccttacccgtaaaccccgtaaccggtcgacggtacgggtacctaagtaacgggtattacgggtccgtaaagttacgtttattacggttacgacgtactaagttaaaccttcgtactttaccgtccttacgtacctcggttaacgggtccggaacggtaaaggaccggtaagtacgaagttacgaaccgtaaggtaccgtgtacgtcgtccgtaacnccgtacttccgtnttaccgtacctacgttccccgtccgaatctcgacgtcgtaaccgg

SEQ ID NO: 52268 - DNA, 889 bp, Homo sapiens
  misc_feature: GYAE6OF01EW08B.18.11.A11.1.454.CMB.1.raw
  modified_base (349)..(349): a, c, t, g, unknown or other
  misc_feature (349)..(349): n is a, c, g, or t
tcagtacgagtatgcacgaccggtgctcgatttagctacgactgcaggggcagcaagatggtgttgcagacccaggtcttcatttctctgttgctctggatctctggtcgccggacgggacagtcgtgatcgaccagtcctaccagaccttccgtggttgtcgtctcgtgggcgaggacgggccaaccataccaactcgacaacgtccgacgtaccgaagtagtttagttttaacacacgtacctaaccaaaactaactaaacctaacttacttagcgttacggtaaccagacaaacgaaaccgacgaaccgaacccgtaccccgtaaggtccttagtaacgtttacgnggtactaccgtaccggtacccggggtacggtcccgggtaccaggtaccgtagtaccgaggagcgtacgggtcggtcggtacggaactacggtacttcgacgtccgtacctaaccgtactaacccgtaaccgtaacgtggtaacccgtaagggtacgttaggaacggttacgttacgggtaccggtttaacgtttaacggttttacgttaccgttagtaaacgtaaccgtaacgttaaaaccgttacgtttaaaccgttcccgtttaccccgtttacccgtacggtttaccccgggtttaaccggggttacccgggggtaacgggaaacccggggttaacccggtaagggtttaaccgggtaaacgttaaaccgttaaccccgggtaaaaggttaccgttacggtaaccgggtttaccgtacccgtaaacccgttaaccggttacggttttacttacccggtttaccttaacccgttaccccgttttacccgtttaaccgtacttacccgtttacgttaaccgtaaccggttttaacccgg

SEQ ID NO: 52269 - DNA, 812 bp, Homo sapiens
  misc_feature: GYAE6OF01EV0QU.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctcgtgggcgagacgggccaccatcaactgcaacgtccagccagagttgttttatacgagcctaccaactaataacaacttacttagctttcggtaccagacaacgaaacccgaaggaaccaccggtaccccctaaggtcctactatttaccgtgggcctaagttcccgtacccgggggtacggttcccgggggttacccctacggtaacccgtacgtttaccgaacgggtacggccggtacgggtccggggttaccgtacggggaactacggttaacttttccccgaaccttccgtacccaaacctaacgttaccccgaaacccgtaaacccttcggaccgtacgggacttacggaaagtaacgtttcggagggttactttaacgttttaactttacggttcgtaaccacggtaactaaaacttacgttaaccgtttaacttccccttccgttaaccgttaccgtaacccgggttacgggaccgggaaaccggggtaacccggtaaggggttacggaacgtaacttaaccggaaacgttaacggttcggtacggacccttaggacccctaacccgtacgttccgtttacggttacccttacgttaacccgttccccttacccccgattaacccttcggtacaaccgttaacccg

SEQ ID NO: 52270 - DNA, 624 bp, Homo sapiens
  misc_feature: GYAE6OF01EIBNE.18.11.A11.1.454.CMB.1.raw
  modified_base (214)..(214): a, c, t, g, unknown or other
  misc_feature (214)..(214): n is a, c, g, or t
  modified_base (286)..(286): a, c, t, g, unknown or other
  misc_feature (286)..(286): n is a, c, g, or t
  modified_base (295)..(295): a, c, t, g, unknown or other
  misc_feature (295)..(295): n is a, c, g, or t
  modified_base (415)..(415): a, c, t, g, unknown or other
  misc_feature (415)..(415): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtcctccagactcccttgttgtgtctcgtgggcgagagggccaccatcaactgcaagtccagccagtagttgtttttaanaccagtctaccaaacaactaaacaactacttagcttgaccagcaagaaccaggacacgacccctaagtcctntaatttacngggtactactccgtaaccccggggtcgtcccggggtaccctggaccgtattccgaggacgcgtaggcggtcgtgggacagtacttcactctcacataccacaacctgcgtaggctagaangtgtggacttagtttattacgtcgtacgagtactaacttacgtagtaccgttacctacctacctacggtacccgttcgggacggtacggaacggtaacgtgggaccgttaagaccgaaacggtacgttacggtcgggaactcggtacctaccggtattcgtacgttcctactaccttcccttcccgtactacctcttacgcgttaaacc

SEQ ID NO: 52271 - DNA, 705 bp, Homo sapiens
  misc_feature: GYAE6OF01AETJY.18.11.A11.1.454.CMB.1.raw
tcagtacgagtatgcacgaccggtgctcgatttagctacgactgcaggggcagcaagatggtgttgcagacccaggtcttcatttctctgttgctctggatctcgtggtgccgacggggacatcgtgatcgaccctagtctccagcttccgtggttgtgtctcgtgggacgaggacgggccaccgatcaactgacagtccagccagtaggttgttttaacacgacgctaccaaactaactaaccaactacttagcttcggtaaccagacaacgaaaccgaggaccaccgtacccctaaggtcctactacgtttacgtcgggacctacgtccggtacccggggcggtcccggggtacctacggaccgtagttcgaggacggcgtacggtcggtcgtgggacgtagtactttcaccttactaccaacctactaccaacctaaccgtcgacgaacggtctaacggacgtacgtggtacgtacttaagtttactacgttacgtacgacgtaacctaagtaccttagttaccttcccgtacctcgttaccgtacggtccggacgggtaccggaacgtaacgggtagtacgtaaccgtacgtaaacggtacgttacggtacgtacgtaccggactaaccggtcttacccggttacttccgttacctacccgttccgtacccctacgtaacgtccgtacgtaccttaaccgg

SEQ ID NO: 52272 - DNA, 841 bp, Homo sapiens
  misc_feature: GYAE6OF01DF8A0.18.11.A11.1.454.CMB.1.raw
  modified_base (141)..(141): a, c, t, g, unknown or other
  misc_feature (141)..(141): n is a, c, g, or t
tcagtacgagtatgcacgaccggtgctcgatttagctacgactgcaggggcagcaagatggtgttgcagacccaggtcttcatttctctgttgctctggatctctggtgccggacggggacatcgtgatcgacccagtccnccagtacctccgtggttgtcgtctcgtgggcgagcggccacatacactgacaacgtccacgaccaggtagttacgttttacaaccagtacctaccaaaactaaactaaacctaaaccttattacgtacgttacggtaccaacgacgaacgtaaaaccgacgggactacccggtaccccgtaacggttacctacttactttacggcggtccgtaacgttaccggttaaccccgggtcgggtcccggggttacctaccgggacctacgttcgaacgggaaccggtcgacggtccgggtacgtacgggtactacgttacctttcgaacccttctaacctacctaacttaccgaaccccgtaaacgtcgaaccgtaaggtacctaggaaacgtgttacgtaggtacctttaaggtttacttacgtcgttaacgaacgttaactaacgtttaccgttaacgttacccgttccctttaacccggtcgtttaacccggaaccggggtttaccgggtaaccggggtaaccgggtaacggtaacgggttacgggaaccgtaaccggtaaaccgtaaacgggttaaccgtcgggttacccgaggttacccggaaccgtaccgttacgtaccttttcccgggtttaactacccctttaccgttaccccttacccggtaacttacccttaacgtgttaaccctaaacccggg

SEQ ID NO: 52273 - DNA, 700 bp, Homo sapiens
  misc_feature: GYAE6OF01D3N6M.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtggccgacggggacatcgtagatcgaccagtctccagacctcctggttgtgtctcgtgggcgaggacggcaccatacaacgtcgacaacgtccgacgtacccaggtacgtttagtttttaacactacgtacctaaccaaaactaactaaacctaaacttactttaacgtaccgttacggtaaccaggacgaaacgtaaaaccgaaggaccaccgtaccccgttaaggtacctactaagtttacgtcgggactacgtccggtaaccgggtcgttacccggggtcctacggtccgtaatcgaaggcggacgacggtacgggtccggtagggactacgttacttcgactacctcgaacctacgacaacccaactgacgagtactagaaacgtgtacggtagtacttaaggtttcttaagttcacgtacgaactaacgtacttaactactctcccgtactcgtacggtcggacggaacgtacggacggtacgactaacgaacgtaacgtcgtaagtcgtcgacctacgtaattcgtaacgttctaccgttacgtacccttacccgtaccctacttacgtactacggtaactaaccgg

SEQ ID NO: 52274 - DNA, 653 bp, Homo sapiens
  misc_feature: GYAE6OF01D6JKE.18.11.A11.1.454.CMB.1.raw
  modified_base (208)..(208): a, c, t, g, unknown or other
  misc_feature (208)..(208): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttanacagctacaacaataacaactacttagcttaggtaccagcaagaaaccaggacacgccccctaaggtcctactagtttactgggactactccgtacccggggagttcccggggtccctggaccgtattccgagaggcaggtcgggtcgtagggacagtactttccgactcctacgaccataccaccaacgtcgacaggtactagaagtacgtgtacggtacctaagttttacttacgtgtacaacgtactaaattacttacttacggtacccctttcgtacctcggttaccgggttccgggacgggtaacgggaacccgtaagggtacggaagtaaccgtaccgaaaaccgtcgtacggtacggtacctacggacctaccgtacttcgtcgttccttaccgtacttccccgttaccccgacttacttccgtgtaaccgttaaccg

SEQ ID NO: 52275 - DNA, 814 bp, Homo sapiens
  misc_feature: GYAE6OF01AE6VD.18.11.A11.1.454.CMB.1.raw
  modified_base (186)..(186): a, c, t, g, unknown or other
  misc_feature (186)..(186): n is a, c, g, or t
  modified_base (209)..(209): a, c, t, g, unknown or other
  misc_feature (209)..(209): n is a, c, g, or t
  modified_base (279)..(279): a, c, t, g, unknown or other
  misc_feature (279)..(279): n is a, c, g, or t
  modified_base (325)..(325): a, c, t, g, unknown or other
  misc_feature (325)..(325): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctcgtgggcgagagggccaccatcaactncaagtccagcagagttgttttanacagctaccaaacaataacaacttacttagcttgtacagcaagaaccaggaccacgcccctaagtcctanatttacgtcggactactccggtacccggggtacgtcccggggtccncggtaccgtattacgaggcggacgacggtccgggttacggtcgggaacctaggttaactttccgactcctaccctaaccctactacccaacccgtaaccgtcgacccggtaacggacgtaacgtaacgggtacttagggggttcccgaagttttaacgtttttaacggttacccgttaaggtaacccgtaacggttaaacttaaaccctttaacgtttaacgtacccggttttaccccctccgtttaaccgttcccggtaaccgggggtttcggggggaacccggtaaccgggggtaaaccgttaacgggggtaagtaacggtaacccggttaaaccgtaaaacgggtaccggtttcgggcggtttacccgaccgtaacccggttaccccctaaggtttccctttaccggtttcccctttacccgtacccggtttacccccccgttcccgacttaaccccggtcttaaaccggttaacccttaacccgg

SEQ ID NO: 52276 - DNA, 674 bp, Homo sapiens
  misc_feature: GYAE6OF01A7CKT.18.11.A11.1.454.CMB.1.raw
  modified_base (221)..(221): a, c, t, g, unknown or other
  misc_feature (221)..(221): n is a, c, g, or t
  modified_base (325)..(325): a, c, t, g, unknown or other
  misc_feature (325)..(325): n is a, c, g, or t
  modified_base (375)..(375): a, c, t, g, unknown or other
  misc_feature (375)..(375): n is a, c, g, or t
tcagtacgagtatgcacgaccggtgctcgatttagctacgactgcaggggcagcaagatggtgttgcagacccaggtcttcatttctctgttgctctggatctctggtgccggacggggacatcgtgatcgacccagtcctccagacctccctggttgtgtctcgtgggcgaggacgggccaccatcaactgacaagtccagccgagtagtttgtttttanacagcctaccaaactaaactaaaccaacttacttagtcgttacggtaccagaccaacggaaacccaggaaccaccgacccccgtaaggtccttactactttcgngggactacgtccggtacccggggtacggtcccggggtcctacggaccgtnttcgaggcggcgcgggtcggtcgtaggactagtacttcgacttcctaccaccactaccgaccgtaactcgacgacggtactagtaagtacgtggtacgtacttacgtttactacttacgtacacgttaactaacgttactacgttaccgtcctccgtactcggtaccggtcgggaacggacggaaccgtagggtacgagtaacgacgtaacgtacgtggtcgacctccgacctaccggtacttcggttactccttccgtcccttacccgtccccagttacctcctacgtaccgttaccg

SEQ ID NO: 52277 - DNA, 736 bp, Homo sapiens
  misc_feature: GYAE6OF01BP2WE.18.11.A11.1.454.CMB.1.raw
  modified_base (221)..(221): a, c, t, g, unknown or other
  misc_feature (221)..(221): n is a, c, g, or t
  modified_base (713)..(713): a, c, t, g, unknown or other
  misc_feature (713)..(713): n is a, c, g, or t
tcagtacgagtatgcacgaccggtgctcgatttagctacgactgcagggcagcaagatggtgttgcagacccaggtcttcatttctctgttgctctggatctctggtgccggacggggacatcgtgatgacccagtcctccagacctccctggttgtgtctcgtgggcgagagggcccaccatccaactgctaagtcccagccagtcgttgttttaatacncgtactaccaaacgaataacctaacttacgttacgtcgttacgtaaccagacaacggaaacccgtaggaccaaccgcccccgtaacggttccctacgtaactttacgtcgggctaacgtccggtacccgggaccggttcccgggtccctacgaccgtattaccgaggacggcgacgggttcgggccgtacgggactacggttaacctttaccgcccgttactacccgtaactaccctacctaaccccgtaactaacggtccgtaacgggtcttaaaggacggtaagtcggtccggtaactttagtttacttaccggattaacgaccggtaactaaacttaaccgtacgtaccttcccttacccgtcgtaccgttaccgggtccgggacgggtaagacccgtagggtaccgtagaacctaacgaaacggttcgacgttgtcctaggccctaaacgtcttacgtacgtttccaaccttcggtcccctacccgtntaaccgtcaccggttctaacccg

SEQ ID NO: 52278 - DNA, 657 bp, Homo sapiens
  misc_feature: GYAE6OF01DCHS7.18.11.A11.1.454.CMB.1.raw
  modified_base (224)..(224): a, c, t, g, unknown or other
  misc_feature (224)..(224): n is a, c, g, or t
tcagtacgagtatgcacgaccggtgctcgatttagctacgactgcaggggcagcaagatggtgttgcagacccaggtcttcatttctctgttgctctggatctctggtcgccggacggggacatcgtgatcgacccagtcctaccagaccttccgtggttgtgtctcgtgggcgaggacggccacatacaactgacaacgtccacgcagtagtttatttacacnacctacaaactaataacaacttactagcttcggaccagacaaagaaccgaggaccaccgtacccctaagtcctactacttacgtggacctacggtaccggtaccgggtacgggtcccgggtaccctacggaccgtacttcggaggacggcgacgggtcggtacgacggactgtacttccactctaccacctactccaaccacgtacgacgacgacgtaagagtacgtagtacgtacgtttacgtttatacgtgtacaagtaactaacttactactacccgttcctaccgttaccgtacggtaccggttacgggaacgggtaacgggaacgtaagggtagaacgtaagaaccgaagtacgtacggtacgactcgaacctcgtcttacgtcttcttctacccgttccgtacccgtactacttacgacgttctacg

SEQ ID NO: 52279 - DNA, 855 bp, Homo sapiens
  misc_feature: GYAE6OF01B2ZYA.18.11.A11.1.454.CMB.1.raw
  modified_base (538)..(538): a, c, t, g, unknown or other
  misc_feature (538)..(538): n is a, c, g, or t
  modified_base (844)..(844): a, c, t, g, unknown or other
  misc_feature (844)..(844): n is a, c, g, or t
tcagtacgagtatgcacgaccggtgctcgatttagctacgactgcaggggcagcaagatggtgttgcagacccaggtcttctatttctctgttgctctggatctctggtgccggacgggacatcggtgatcgaccctagtcctccaagccttccgtggttgtcgtcgtgacgggagacggacggccaccagtaccatcgacaacgtccacgtcgtaagtgtttacgttttaacacatacctaaccaaacaaacctaaacggtaaccttacgttacgtacgttacggtaacccagaaccgaaacgaaaaccgacggtaaccgtaaccgacccccgtttaaggtcccttaacttacggtttacggcgggaaccttacggtacccgggtacccggggttacccggtaccccggggttaccctaccggtaaccgtaagttccgaaggggttaccggcggtaccgggtacgggtacgtacggggtaactaaccgtttacgtttaccgaaccttccgtaccgaactacgacccgtaactacggngacgtacggtactaagtaaacgcgttacggtacggtaactttaaggttacgtttaacggtacctaagtaacccggtaatttaaaccctaacgttaaccgtttaacccggaccccgtttaaccgtcccgttaaaggggttacccgggttaccggggaaccgggggtaaaaccgggttaccgaaaggggtaacgtaaccgtaaacgtaaacgaaccggttagacgggtacgtacgtaccaccgtaacgtcgttacttaccgttccttaaccgtccttaccccgtaccgtattaaccgtctaaacggtnttaaacccggg

SEQ ID NO: 52280 - DNA, 678 bp, Homo sapiens
  misc_feature: GYAE6OF01EJZ1G.18.11.A11.1.454.CMB.1.raw
  modified_base (210)..(210): a, c, t, g, unknown or other
  misc_feature (210)..(210): n is a, c, g, or t
  modified_base (238)..(238): a, c, t, g, unknown or other
  misc_feature (238)..(238): n is a, c, g, or t
  modified_base (412)..(412): a, c, t, g, unknown or other
  misc_feature (412)..(412): n is a, c, g, or t
tcagtacgagtatgcacgaccggtgctcgatttagctacgactgcaggggcagcaagatggtgttgcagacccaggtcttcatttctctgttgctctggatctctggtgccgacgggacatcgtgatcgaccagtctccagactccgtggttgtcgtctcgtgggcgagacgggccaccatacaactcgacaagtcagcctaagtagttnttttacgtacacgtactaccaactaaanacctaaactacttagccttaggaccagacaagaaaccaggaccacgacccccgttaacggtacctactaactttaccgtcgggtacctaacgttccgtaaccccgggggtaccggttcccgggggtcccgttaccggaccgtcgtacggtaacggacgacgtcgggtaccgggntacgggacgtacgtagttactactactccaccactacaaccaacctacgacgtacggtcgtagagtatagtcggtacgtacgttaacgttacttcgtacgtacgactaaactaactactacgtacctccttaccgtcgtaccggtacgggacggaacggtaccgacggtacggtagacgtacgaacgaacgtacgtgtactacgtacgacctacgtacgttcgtcttcgtacttcccgtacccgtccacgttacctcgtacgtacg

SEQ ID NO: 52281 - DNA, 745 bp, Homo sapiens
  misc_feature: GYAE6OF01DGEG2.18.11.A11.1.454.CMB.1.raw
  modified_base (323)..(323): a, c, t, g, unknown or other
  misc_feature (323)..(323): n is a, c, g, or t
  modified_base (344)..(344): a, c, t, g, unknown or other
  misc_feature (344)..(344): n is a, c, g, or t
  modified_base (390)..(390): a, c, t, g, unknown or other
  misc_feature (390)..(390): n is a, c, g, or t
  modified_base (629)..(629): a, c, t, g, unknown or other
  misc_feature (629)..(629): n is a, c, g, or t
tcagtacgagtatgcacgaccggtgctcgatttagctacgactgcaggggcagcaagatggtgttgcagacccaggtcttcatttctctgttgctctggatctctggtcgccggacgggacatcggtgatcgacccagtcctccagaccttccgtggttgtcgtctcgtgggcgaggcggccacatcaactgcaacgtccagccgaagtgttagtttacacacgtcctaaccaaactaactaacctaacttacttacgacttacggaccagacaacgaaaccgacggaacaccgtaccccttaaggtcctactacgtttacgnggctacgtccggtaaccgggnggtcccgggtcctagaccgtatacgagacggcacgggtcggtacgnggactagtacttcacgttctaccaactactccaacccgtactcggacgacggtacgaggtaacgtgttcgggtaaccgtactttaagttttactacgtcgactaaaccgtaactaaccttaacttacgttacccgttaccccgttccttaccgtaccggttacggggttcccgggaaggggtaaacccgggtaacggtaacgggttaggaacttaaccggtaaacgtaacgggttaccncgggttaccgggacctaccggttaaccaccgtttaccgttcttaccggttaccctttaccggtaacctttcccccgggtacccttaacctacgttacgttaaaccgtgtaaacccg

SEQ ID NO: 52282 - DNA, 607 bp, Homo sapiens
  misc_feature: GYAE6OF01BGELQ.18.11.A11.1.454.CMB.1.raw
  modified_base (210)..(210): a, c, t, g, unknown or other
  misc_feature (210)..(210): n is a, c, g, or t
  modified_base (299)..(299): a, c, t, g, unknown or other
  misc_feature (299)..(299): n is a, c, g, or t
  modified_base (565)..(565): a, c, t, g, unknown or other
  misc_feature (565)..(565): n is a, c, g, or t
  modified_base (593)..(593): a, c, t, g, unknown or other
  misc_feature (593)..(593): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagacctccctggttgtgtctctgggcgagagggccaccatcaactgcaagtccagccagagttgttttanacagcctaccaacaataacaactacttagcttggtaccagacaacgaaaccaggaccacgtaccccctaaggtcctacgtactttacgngggccacgtccgtaccccggggcggttcccggggtcccctaggacccgtagttccgaggacggccgacggccggggttacgtcgggacctagtactttaccacgttctccgacctactacccaacccaacctggacacggctagaagtacgtggtcggtacttagttttaatactgtacacgactaactctatcgtcctctctcgacgttcggacggtacggacgaggtgaatactaccgaagtacgtggtcgactcgacctacgnttcgtacgtctacctcttcccgtacccnctactctcgctacg

SEQ ID NO: 52283 - DNA, 827 bp, Homo sapiens
  misc_feature: GYAE6OF01EURGF.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtgccggacggggacatcgtgatcgacccagtcctccagtacctcccgttggttgtgtctcgtgggcgaggacggcccacctatcaactgacaacgtccacgccagtacgtttagttttactacgacgtcctaaccaaaactaaacttaaacctaaacttacgttacgtccgtttacggaccacgacaaacgtaaacccgacggaacccaccggtacccccgttaaggtcccttacgttaactttccgcgggacctaacgtccccggtaaccccgggggtacggttcccccgggggtacccctacgggtaacccgttacgttaccggaacggacgggaccggtacgggtaccgggggttaccggtacggggtaaacctaacggtttacctttaccctacccttaccctacccgaaccctactaacccaacccgtaaccgttccggaccgtacggggtacctaagggaacgtacgttacggtacggttacctttaagttttaaccttacggttacgtacaacggttaactaacgttacttaacgttacccgtcccttacgtccgttacggttaccgggtccgggacggggtaaccggtaacggtaacggggtaggtaacgttacctaaacggaaacggtacggtggtaaccggctccgaaccgtcgtacttggttcctaccgtttcaccctttccgtaccctctatccgtaacgtctaaccg

SEQ ID NO: 52284 - DNA, 734 bp, Homo sapiens
  misc_feature: GYAE6OF01A54WW.18.11.A11.1.454.CMB.1.raw
  modified_base (218)..(218): a, c, t, g, unknown or other
  misc_feature (218)..(218): n is a, c, g, or t
  modified_base (225)..(225): a, c, t, g, unknown or other
  misc_feature (225)..(225): n is a, c, g, or t
  modified_base (670)..(670): a, c, t, g, unknown or other
  misc_feature (670)..(670): n is a, c, g, or t
tcagtacgagtatgcacgaccggtgctcgatttagctacgactgcaggggcagcaagatggtgttgcagacccaggtcttcatttcctcttgttgctctggatctctggtgccggacggggacatcgtgatcgacccagtcctaccacgacctccgtggttgtgtctcgtgggcgaggacgggccaccatacaactgacaacgtccagccagtagttnttttaanacagctaccaaacaaactaaccaacttacttagtaccgttacggtaaccgagacaacgaaaccgacggaaccaccggacccccgttaacggtccctacttacgtttaccggcgggtacctaccggttacccggtaccccgggggtaccggggttccccggggttaccctacggacccgttaattccggaacggtacgggcgagggcccgggttcgtacggggactaaggttactttccgaccttcgaccctaactacgtacccaacctaccgcggtcgacggaccgtaggaacgtcgtaggtcgtacgtttagtttacgttacgtcgtacacgtactaacgttactaacttccgtaccttacctcgtacgtacggtcggacgggtacggacgtagggtaggactacgtaaccgaagtacgtacggtcgactaccgactacccgtnttacgttccgttccttacctccgttacccgttaccccgacttagtcccttaacgtacttaaccg

SEQ ID NO: 52285 - DNA, 781 bp, Homo sapiens
  misc_feature: GYAE6OF01C7SVZ.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtcgccggacggggacatcgtgatcgacccagtcctccacgtacctccgtggttgtgtctgtggcgaggacggccaccatccaactcgacaacgtccacgccagtagttattttacaccactcctaaccaaactaaactaacctaacttacttacgtcgttacgtaccagaccgaaacgaaaccgacgaacctacccgtacccccgttaacgtacctacttaacgtttacggtcgggacctaaccgtacccggttaaccccggggacgggttccccgggtacctaccggaacccgtagtcgaggacggacgtacgggtccgggtacggtacggaactacgttacttaccaccgttaccaccaaccgtactacccaaccctaccgtacgacgacgtacgtacgaagtgttacggtacgttactttaagtttactacgtacgtacgaacgtaacttaacttacgttacttacccgtcctttacccgtcgttaccggtacccgggttacgggaacgggtaacgggtaacccggtaaggggtacgtaaccgttaacggaaacccgtaaacgttggtacgggtacgtcctaccgacccttacctacgtttccgttaccttcccgttaacgtacccgttcccttaaccccggattactcccgtaacgtaccgttaacccgg

SEQ ID NO: 52286 - DNA, 928 bp, Homo sapiens
  misc_feature: GYAE6OF01ALONV.18.11.A11.1.454.CMB.1.raw
tcagtacgagtatgcacgaccggtgctcgatttagctacgactgcgaggggcagcaagatggtgttgcagaccaggtcttcatttctctgttgctctcggatctactggtcgccggacggggaccagtcgtgactcgaccctagtcctccagtaccttcccgtgggttcgtcgtccgtcgtggggccgaggaccgggtccaacctagtccaacgtcggtaccgaacggtccaacggcccgtagtacgtttacgtttttaacaccacgtccttaacccaaacaaacgtaaaccctaacgttaccttaaggtaccgtttacgggtaccaacggaccaaaccggaaaccgacgggtaaccctaaccggtaccccccggttaaaggttccctacgttaacgttttaccggtcggggttacctaccggtttaacccgggttaacccccgggggtccggttccccggggggttaccccttaggggtaaccccgttaacggttaccgaacggggtaaccgggtcggaaccgggttaccggggttaccggtacggggtaacctaggttaaccttttaccgacccgttacctacccgtaaccctaactacccgaacctaacccgttcgacccggtaggtactacggtaaggtacgtttacggcgttaacgtttaccgttacggtttaccggtaacgtaccgttaacgaacgttaaaccgtacgttaccgttaaccgttacccttccggtacctaccggaccggtcgtacccggggacgggaccggtaaccgggtaggggtaaggacttacggaaaccggtaacggtaacttggggtaccggtacctaccggtccgtaaccggtccctttcggtcgtttccctacggttacccgttacccggttccccgtaaacccgttaccgttgtacccgtaaacg

SEQ ID NO: 52287 - DNA, 737 bp, Homo sapiens
  misc_feature: GYAE6OF01ET9TJ.18.11.A11.1.454.CMB.1.raw
  modified_base (88)..(88): a, c, t, g, unknown or other
  misc_feature (88)..(88): n is a, c, g, or t
  modified_base (225)..(225): a, c, t, g, unknown or other
  misc_feature (225)..(225): n is a, c, g, or t
  modified_base (246)..(246): a, c, t, g, unknown or other
  misc_feature (246)..(246): n is a, c, g, or t
  modified_base (326)..(326): a, c, t, g, unknown or other
  misc_feature (326)..(326): n is a, c, g, or t
  modified_base (328)..(328): a, c, t, g, unknown or other
  misc_feature (328)..(328): n is a, c, g, or t
  modified_base (384)..(384): a, c, t, g, unknown or other
  misc_feature (384)..(384): n is a, c, g, or t
  modified_base (407)..(407): a, c, t, g, unknown or other
  misc_feature (407)..(407): n is a, c, g, or t
  modified_base (571)..(571): a, c, t, g, unknown or other
  misc_feature (571)..(571): n is a, c, g, or t
tcagtacgagtatgcacgaccggtgctcgatttagctacgactgcaggggcagcaagatggtgttgcagacccaggtctcatttctcngttgctctggatctctggtgccgacggggacatcgtgatcgacccagtcctccagtacctcccgtggttgtgtcgtcgtggggcgaggacgggcccaccatcaactgacaacgtccaggccagtagtttgttttaanactacgacctacaaactaaanaccctaaactaccttagccttaggtacccaagaaccaagacccaggacccacgccccctaagtacctctacgtttaccgntnttaacccggacgtaccggtaccccctttggcccgttacgggttccccgagttaccngggaccgtagtacgggaccgganccgtaggacgtacgacgttcgactacgttaccaaccgtactaccaacccgtaaccctcgtaacccctagggaacccgttaactaccgtacggttaacggttacgttaacggtttacgacgttacgttaacgtaccgtaaacgttaccgtaccgttaaccttaanccgttaccgtaccgttaccgttacccgtaccggtaccgtaccggtacggtaccggtaccgtaacggtaacggtaggtacggtacgtacgtacgtaacgtacgtcgtacgtacctaccgtaccttaccgtacgtaccgttaccaccgtaccctaccgttccgtaccg

SEQ ID NO: 52288 - DNA, 726 bp, Homo sapiens
  misc_feature: GYAE6OF01ECYC8.18.11.A11.1.454.CMB.1.raw
  modified_base (166)..(166): a, c, t, g, unknown or other
  misc_feature (166)..(166): n is a, c, g, or t
  modified_base (655)..(655): a, c, t, g, unknown or other
  misc_feature (655)..(655): n is a, c, g, or t
  modified_base (670)..(670): a, c, t, g, unknown or other
  misc_feature (670)..(670): n is a, c, g, or t
  modified_base (718)..(718): a, c, t, g, unknown or other
  misc_feature (718)..(718): n is a, c, g, or t
tcagtacgagtatgcacgaccggtgctcgatttagctacgactgcaggggcagcaagatggtgttgcagacccaggtcttcatttctctgttgctctggatctctggtcgccggacggggacatcgtgatcgacccagtctccagacctccgtggttgtgtctcgngggcagcggccacatcaactgacagtccagccagtagttgttttaacacgacgtcctaccaaactaaactaaacctaacttacgttacgtacgtttacggtaaccagacaaacgaaaccgtaacggaacccgtacccgtacccccgtaacggttccctactaactttacggcgggtacctaacgtacccggtaccggggaccggttcccggggtccctacggaccgtatacgaggacggcgacgggtcggtacggtacggacgtacgtctttaccgactccgtaccacctactacccaaccgtaacgtgaccgacgtccgagtaaccggtagtcggtacggtacttaacgttttacttacggtactacgaacgtaactaaacttactacgttaccttcccttacctccgtacggttacccggttacgggacgggtaacggtaacggacggtaggaacgtaacaaccgtaaagtccgtggtacgccgtancccgtacgtacgttnttaccgtcgttacgttccccgtcgtacccgtaccctagttcctaccgngttaaccc

SEQ ID NO: 52289 - DNA, 845 bp, Homo sapiens
  misc_feature: GYAE6OF01BWX1H.18.11.A11.1.454.CMB.1.raw
  modified_base (809)..(809): a, c, t, g, unknown or other
  misc_feature (809)..(809): n is a, c, g, or t
tcagtacgagtatgcacgaccggtgctcgatttagctacgactgcaggggcagcaagatggtgttgcagacccaggtcttcatttctctgttgctctggatctctggtgaccggacgggacatcgtgatcgaccagtcctaccagtacctccgtggttgtgtctcgtgggcgaggacggccacatcaactgacagtccagccgagtagttatttacacacgtacctaaccgaaaacaactaaaccaacgtttaccttaggtaccgtttacggaaccgagaaccgaacgtaaaccgacggaccacccggtacccgttaacggtccttacgtaacgtttaccggcggacctacgtacccggtaacccggggtcggtccccggtccacgtaccgtagttacgacggtaacggccggacggtaccgggtcgacggtactacggttacttaccacgtaccctacgaacctacacccaccgtaacgcgaaccggtaggtaccaaggtaccggtagtacgggttaggttaaccgtttaagttttaccgttacgtacgtacggaacttaaaccgtaaacgttttaccgtaatttaccccgttaccccgttactaacccgggtttacgtacccggggtttaacgggggaaccgggttaaaccgggtaaaccgggtaggggtaaccgttaaacggtaaacctaaaccgggtaaacggtacggttacgggtcctaaaccggtccggaacccttaaaccgttcgttacccgtttaccgttccttaacccgtaccccgttttaccccgtaaccccggttaanaccccggttacttaaaccgggtaaccccttaaacgg

SEQ ID NO: 52290 - DNA, 643 bp, Homo sapiens
  misc_feature: GYAE6OF01CM76D.18.11.A11.1.454.CMB.1.raw
  modified_base (180)..(180): a, c, t, g, unknown or other
  misc_feature (180)..(180): n is a, c, g, or t
  modified_base (235)..(235): a, c, t, g, unknown or other
  misc_feature (235)..(235): n is a, c, g, or t
  modified_base (240)..(240): a, c, t, g, unknown or other
  misc_feature (240)..(240): n is a, c, g, or t
  modified_base (334)..(334): a, c, t, g, unknown or other
  misc_feature (334)..(334): n is a, c, g, or t
  modified_base (398)..(398): a, c, t, g, unknown or other
  misc_feature (398)..(398): n is a, c, g, or t
  modified_base (413)..(413): a, c, t, g, unknown or other
  misc_feature (413)..(413): n is a, c, g, or t
  modified_base (443)..(443): a, c, t, g, unknown or other
  misc_feature (443)..(443): n is a, c, g, or t
  modified_base (601)..(601): a, c, t, g, unknown or other
  misc_feature (601)..(601): n is a, c, g, or t
tcagtacgagtatgcacgaccggtgctcgatttagctacgactgcaggggcagacaagatggtgttgcagacccaggtcttcatttctctgttgctctggatctctggtcggccggacggggacatcggtagatccgaccagttccaccgaacgtcctcccgttggttgtcgtcttcggngggcgaggacggcccactatacactcgacaagccagccgagtagtttactttaanaccancctaaccaaataactaactaacgttaactcgtcgttacgaccataacaacgaaaccgacggtaccaccgacccgtagtacctacgtaacttcgnggacctacggttcccggtaaccgggcggtcccgggtaacctcggaacctcgtagacgtcgacgngggtcgacgcggtancgtacttccatccacactcaaccggctacncgaagtcgaactagagttagtagtcgtacgttacttaatcgtacgtacacgtaaaccagttactaacgtcttaccgtctaccgtcgtaccggtcggcgtaacggaccgtaggtatacgaacgtttacggaactgtacgtggtccctagatcgtacgtnttaccgcctaacgttccactcccacttcgactagtcccttag

SEQ ID NO: 52291 - DNA, 797 bp, Homo sapiens
  misc_feature: GYAE6OF01B7VP0.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtgccggacggggacatcgtgatcgacccagtcctccagaccttcccgtggttgtgtctcgtgggacgaggacggcccaccatacaactgacaagtccagccagtacgttgttttaactacgagtacctaccaaaactaaactaaacctaaccttaaccgttagtaccgtttacggtaacccagaccgaaacgaaacccgaacggaaccacccgtaccccccgtaaggtccctactaatttacgcggtacctacgtacccggtaccccggggtacggtccccggggtaccctcggaccgtacgttacggaggacggacgacgggtcgggttagagggtactacgtacttccgaaccttctaccgactaactacccaacctaccgtcgaccgagtacgtaagaacgttgtacgggtacgttacgttaagttttaacttacggttatacaacggtactaaacttacgttaccgttaccttaccccttcctaccgttacggttacccgggtcggggtaaccggaacggggtaaccgtaacgggtaggaaaccggttaccgtaaacggtaaccggtaacggttcggtacgggtaccctaggcccctaaacggttctaacccggtttccgtttacccgttcctaacccctttccggtaaccccctacttaacgtcccttaaaggaaccgttaaccg

SEQ ID NO: 52292 - DNA, 737 bp, Homo sapiens
  misc_feature: GYAE6OF01EFD5V.18.11.A11.1.454.CMB.1.raw
  modified_base (473)..(473): a, c, t, g, unknown or other
  misc_feature (473)..(473): n is a, c, g, or t
tcagtacgagtatgcacgaccggtgctcgatttagctacgactgcaggggcagcaagatggtgttgcagacccaggtcttcatttctctgttgctctggatctctggtgccggacgggacatcgtgatcgacccagtcctccacgaccttcccgttggttgtcgttcctcgtgggcgaggacggcccacatacaactcgacaacgtccagaccgagtagtttgttttaacacacgtacctaccaaaacaaactaaacctaacttacgttacgtcgtttacggaaccgagacaacgaaaccgacggaaccaccgtacccccgttaaggtcctactactttacgtcgggacctacgtacccggtaccggggtcggttacccgggtccacgaaccgtatacgaggacgacgacggtccggtacgtacggactagttacttccgaccttactacccacctacacccgaacctaacgngtacgacggtactaagagtcgttggtacgtactttacgtttataaccgttgaaccgataacgttaactacttagttcccgtacccttccgtacgttaccggttacgggtaacccgggacgggtaaacggaaccggttaagggtacggtaacgaacgttaaccggaaacgtgttcggtacggaccttacgaccctaacgtcctttaggtcctttaccgtaccttacccttcccgttaccctataccgttcgtaagtccctaacgg

SEQ ID NO: 52293 - DNA, 793 bp, Homo sapiens
  misc_feature: GYAE6OF01EO01Q.18.11.A11.1.454.CMB.1.raw
  modified_base (698)..(698): a, c, t, g, unknown or other
  misc_feature (698)..(698): n is a, c, g, or t
tcagtacgagtatgcacgaccggtgctcgatttagctacgactgcaggggcagcaagatggtgttgcagacccaggtcttcatttctctgttgctctggatctctggtgccggacgggacatcggtgatcgaccctagtcctccacgtacctcccgttgggttgttcgttcttcggtggggacgaggacgggacccacctatacaactcgacaacgtccacgaccgagtagtttagtttttaactaacacgtacctaaccaaaactaaacttaaaacctaaacctttaacgtttacgtaccgtttaccggtaaccaagaaccaaacgaaaaccggaacggtaacccaacccggtacccccgttaaacggttcccttacttaacgtttacggcggtactacgtacccgggtacccggggtcggtcccggggtcccgacggtaccgtacgtccggaggacggcgtacgggtcggtcggtagggacctagttacttaccactctacctaccaactacccgaccctaacgtcgacgtagacgtagagtgtaggtacgtacttagttttactacgtgacaacgttactaaatttcgactttaccttcctttccgaccgttaccgggttacgggtccgggaacgggtaaccggacggaagggtaccgtaagtaccgtaaccgtaaaggtccggtgtcccggtanaccgtacccgtaaccgttacgttccgttacgtttccctaccgttaacccttcccggttaaccccacgttacgtacccttaactaacggttaaccc

SEQ ID NO: 52294 - DNA, 791 bp, Homo sapiens
  misc_feature: GYAE6OF01CK9TN.18.11.A11.1.454.CMB.1.raw
tcagtacgagtatgcacgaccggtgctcgatttagctacgactgcagggggcagcaagatggtgttgcagacccaggtcttcatttctctgttgctctggatctctggtcgccggacggggacatcggtgatcgacccagttcctaccagtaccttcccgttgggttcgtgtcctcgtcggggacgaggacgggcccaaccataccaacgtcggacaacggtcccacgaccgaaggtagttttacgttttaacaccgacgtacctaaccaaaactaaactaaacctaactttaacgttagtccgttacggaccaagaccgaaacgaaaccgacggaccaacccgtaccccgttaaggtcctacgtactttacggcgggactacgttcccggtaaccgggtcggttcccgggtacctcgaccgtatcggaaggacgcgtacgggtcggtacgtagggactacgtacttaccgactccgacctacctacaccgtaacctaacgtcgacgtacggtctaaggaacgtgtacggtcgtacgttaacgtttactacgttacgtacgtagtaaactaataccgttaactaccgttaccctaccgttaccgtacccggtacgggttaccgggacgggtaaccggtaacgggtaagggtacggtaacgtaacgtaaacggtaaccgtaacggtcggtacggtaccgtacgtacccgtaacgttccgttcgttacgttcccgttaacccttccgtttacccgttaccccgtattaccttacgtacgtaccctttaaccgg

SEQ ID NO: 52295 - DNA, 769 bp, Homo sapiens
  misc_feature: GYAE6OF01DVWXI.18.11.A11.1.454.CMB.1.raw
  modified_base (193)..(193): a, c, t, g, unknown or other
  misc_feature (193)..(193): n is a, c, g, or t
  modified_base (224)..(224): a, c, t, g, unknown or other
  misc_feature (224)..(224): n is a, c, g, or t
tcagtacgagtatgcacgaccggtgctcgatttagctacgactgcaggggcagcaagatggtgttgtcagacccaggtcttcatttctctgttgctctggatctctggtgccggacgggacatcgtgatcgacccagtcctccagaccttcccgtggttgtcgtctcgtgggcgagacggccacatacaacgngcaacgtccagccgaagtagtttgttttaanaacacgtcctaaccaaacaaacttaaacctaaccttacgtttacgtccgtttacggaaccgaagacgaaacgaaaaccgacggacctacccggacccccgttaaaggtccttacgttaacgtttacggtcggtactacgttacccggtacccgggtacggtcccgggtcctacgaccgtatcgaggacgcgaggtcggtcgtaggactagtacttccgactcgtaccaccgaactccaaccgtaacgtgaacgaggtacgtaagaagtagttcgtaggtactttaacgtttataaccgttgaacgaacgtaacctaacgttacttacgttaccgttcccttaccgttccgtacccggttaacggggttaccggaacggggtaacggaaccggtaggaacggtaacgttaaacgaacccggtaaacgggttacgtacggtaaccgtacgtaccgacccttaacgtaccggttacttacccgttacgttacccttcccgtttaacccgtccgtaaccttagttacccgtaaaccgttgttaacccgg

SEQ ID NO: 52296 - DNA, 857 bp, Homo sapiens
  misc_feature: GYAE6OF01EGZH0.18.11.A11.1.454.CMB.1.raw
tcagtacgagtatgcacgaccggtgctcgatttagctacgactgcaggggcagcaagatggtgttgcagacccaggtcttcatttctctcgttgctctggatctctggtcgccggacgggacatcgtgatcgacccagtctccagacctccttggttgtgtctcgtgggcgaggacggacccacatacaactagacaacgtccacgacctagtagtttgtttttaacaacacggtacctaaccaaaacaaaacttaaacctaaacttaactttacggtaccgtttacgggtaaacccacggacaaaaccggaaaacccgaacgggaaaccgaacccggtaccccccgttaaaaggttcccgtttactaagttttaccgacggggtacctacgttaccggtaaccccgggggcggtttacccggggtccctacggtaccgtactgaacgaggacacgggtcggtcgtaggacagtacttcgacctcacctaaccgactaccgaacccaccgtagacgtacggacctaagtaaacgttacgtcggtacgggttaacttaggtttttaacttaaccgttagtaaaccgtaagggttaaccttaaaagtttaccgtttaacgttaccttaccccgtttacctaccggttaccgtaccggggtttaccgggaacgggttaaaccgggaaccggtaaggggtacggtaaggttaaccaaccggtaaacggtaacgttcggtaacggttacggaccgttaaccaaacgggttccttagttaccggtttcccttaaccgttaccccggtttacccctttacccggaacccttacgttacccgtttaaggaaaccctttaacccgg

SEQ ID NO: 52297 - DNA, 801 bp, Homo sapiens
  misc_feature: GYAE6OF01AM2G9.18.11.A11.1.454.CMB.1.raw
  modified_base (211)..(211): a, c, t, g, unknown or other
  misc_feature (211)..(211): n is a, c, g, or t
tcagtacgagtatgcacgaccggtgctcgatttagctacgactgcaggggcagcaagatggtgttgccagacccaggtcttcatttctctgttgctctggatctctggtgccggacgggacatcgtgatcgacccagtcctccagcctcctggttgtgtctcgtgggcgagacggccaaccatcaactgacacgtccgagccgagtagttnttttacgactacgtacctaccaaacgtaactaaacctaacctacttagccgttaggtaccagacgaaacgaaccgaaggaccaccgtaccccgtaagtcctacgtacgtttaccgaggtaccacgtaccggtaccgggtaccggttccccggggtccctacggtacccgtacgtttacgacggtaacggcgaacggggtccggttacgggtcgggtaacgtaggttacctttaccgaccttccgtaaccctaacccgaacctacccgtaaacccgtaacccgtcgtaccgggtaacggtcccgttaaaggaaaggttcggttacggtaccggttaacgtttaacgtttttacctaccggttacgttaccgtaacgtacgttaacttaacgttacctttaaccgtccctttccgtaccgttaccggtaccgggttaccggaacgggtaccgggtaaccggtaagggtacggtaacctaaacgtaaccgaacgttacgccggttacgaccgttgaccctacgttcctcgttacttcccgttacttacccgttccctacccccgtagttaccgctttaacccgcggttaaccg

SEQ ID NO: 52298 - DNA, 794 bp, Homo sapiens
  misc_feature: GYAE6OF01CF7VH.18.11.A11.1.454.CMB.1.raw
  modified_base (781)..(781): a, c, t, g, unknown or other
  misc_feature (781)..(781): n is a, c, g, or t
tcagtacgagtatgcacgaccggtgctcgatttagctacgactgcaggggcagcaagatggtgttgcagacccaggtcttcatttctctgttgctctggatctctggtgccggacggggacatcgtgatgacccagtctccagactccctggttgtgtctcgtgggcgagacgggccaccatacaactgacaacgtccaacgccaaggtagtttagtttttaacacacgtcctaccaaactaaaactaacaaccttaacttagacgtttcggtaaccagaccaacgaaaaccaacggaccaccggtaccccccttaaggttccctacgttaactttaccggtgggtaacctacgttaccccggtaaccccggggaccgggttccccggggtccctaccggtaaccgtcttacgaggaggccgtacgggtccgggtcgtacggggactaacggttactttaccgtacttccgtacccaacctaaccgttcccaaacccaccgtaccgaccgtacggtaccgtaagaacgggtacgttaggtcggtaactttacgttttaacgtcgtaagtacgaactacgtaaacttaacttagttaacccgttccctcgttacctacgtttccgggttccgggaacggaccgggtaacgtaagggtacggtaactaaacggttaaccgaacgtacggttcggacgtacgaccggtaccctaccgttaagttccgtacgtttacccttaccgttacgtttccccccttacccgacgttaccttcccggttanaacccgtttaacg

SEQ ID NO: 52299 - DNA, 868 bp, Homo sapiens
  misc_feature: GYAE6OF01B3YC8.18.11.A11.1.454.CMB.1.raw
  modified_base (421)..(421): a, c, t, g, unknown or other
  misc_feature (421)..(421): n is a, c, g, or t
  modified_base (537)..(537): a, c, t, g, unknown or other
  misc_feature (537)..(537): n is a, c, g, or t
tcagtacgagtatgcacgaccggtgctcgatttagctacgactgcagggggcagcaagatgggtgttgcagacccaggtctcatttctctgttgctctggatctctggtgccggacgggacatcggtgatcgaccctagtcctaccgagacctccgtggttgtcgtcttcggtgggacggacggaacgggcccaaccgtataccaacgtcggaccaaacgtccgaacggaccgagtaacgtttagttttaacaacgacgaccttaaccaaactaaataaacctaacgttacttaacgtcgttacggaaccaggacaaacggaaaccgacggacctaaccgaccccgtaacggtcctaactacgttacggtcggaactacgttccggtaacccgggtcggttcccggaccgtacgaaccgtnttacggaaccggcgggtaccgacggtccgggttacggaacgggtactaaccggttaattcccgtaaacctcccttacccgaaaaccggacgtaacccaaacccgttaaccccgggnggaaccggtaccggtacggtaaacgtaacgggtacggttacggtacggttaacggtttacgttttaacgttacggtaacgtaacgtaacgttaaacgtaaacgttaaccgttaacgttacccgttaccttcccgtaacgttaccgggttaaccggtacccgggggtaacgggtaaccggggtaaaccggtaacggggtaacgtaaaccgttaaccggtaaaacgtaaccgggttacggtcggtaccggtacgaaccgtaccgtacgtccgttacgttactacgtaccgtaccgttacccctaccgaccttaaccgtctaacgttaccgtac

SEQ ID NO: 52300 - DNA, 681 bp, Homo sapiens
  misc_feature: GYAE6OF01BUHG5.18.11.A11.1.454.CMB.1.raw
  modified_base (186)..(186): a, c, t, g, unknown or other
  misc_feature (186)..(186): n is a, c, g, or t
  modified_base (469)..(469): a, c, t, g, unknown or other
  misc_feature (469)..(469): n is a, c, g, or t
tcagtacgagtatgcacgaccggtgctcgatttagctacgactgcaggggcagcaagatggtgttgcagacccaggtcttcatttctctgttgctctggatctctggtcgacccggacggggacatcggtagatcgaccccagttcctaccaacgtaccttcccgttgggttcgtgtccgttacgnggggacgaacggacgggtcccaaccgtatacaacgtcggactaacgtccgagacctaggtagtttcgttttaacaccgaactcctaaccaaaactaaacgtaaaacctaaccgttaacttaggacgtttacggaaccagacaaacgaaaccggagtaaccgaccgtaaccccgttaaagtcctataacgttacgcgactacgtccgtacggacgtccggtcacgactaacgtgaggacgacgagtccggtacgaggtactaacgtacttacactctacgaacncgtaacctaacgaacctgacgacgtatcgaagtgttacgacgtacgtattacgtctgacgtacgtatactaactagtacgtcctacgtactacggtacgtacgacggaacggataggactagaactaacaacgtactacgtacgacgttacgaccgtacgtactgttacttcctacttacgtcccgtaccgtactaagccgtgtactaaccg

SEQ ID NO: 52301 - DNA, 748 bp, Homo sapiens
  misc_feature: GYAE6OF01AVUFH.18.11.A11.1.454.CMB.1.raw
tcagtacgagtatgcacgaccggtgctcgatttagctacgactgcaggggcagcaagatggtgttgcagacccaggtcttcgatttctctgttgctctggatctctggtgccggacggggacactcgtgatgacccagtctccagacctccctggttgtgtctcgtgggcgaggagggcccacatcaactcgacaacgtccagccgagtagttgttttaacacagtcctaccaacaaactaacgtaactacttagcgttaggaccagactaacgaaaccgacggaccaccgtaccccgtaagtcctatactttacgtcggactacgtaccgtaccggggtacgtcccggggtccctcgaccgtattacgaggacggccgacggtccgggtcgtacggggactacggtactttaccgaacttccaccacctactaccgaaccaaccgtcgtacgacggtacgtaaggaactcggtggttacggtacgttaacgttttaacgttacgttacggtaactacgaacgttaaacgttaacttaaccgtccggttaacctttccgtacccggttaccgtaccgggttaccgggaacggggtaaccgggtaaccggttaacgggtacgggaacgttaaccgtaaacggtaaacccggtacgttcggtacggtaccgtaccgaccgtaccgtaccgtcgttacggtcccttactacccgttaccgtcccgtactaccgttctacggtacctaacgg

SEQ ID NO: 52302 - DNA, 914 bp, Homo sapiens
  misc_feature: GYAE6OF01C6WZP.18.11.A11.1.454.CMB.1.raw
  modified_base (135)..(135): a, c, t, g, unknown or other
  misc_feature (135)..(135): n is a, c, g, or t
  modified_base (221)..(221): a, c, t, g, unknown or other
  misc_feature (221)..(221): n is a, c, g, or t
  modified_base (309)..(309): a, c, t, g, unknown or other
  misc_feature (309)..(309): n is a, c, g, or t
tcagtacgagtatgcacgaccggtgctcgatttagctacgactgcaggggcagcaagatggtgttgcagacccaggtcttcatttctctgttgctctggatctctggtgccggacgggacatcgtgatcgacccngtctccagtacctcctggttgtgtctcgtgggcgaggcgggaccacatacacgtcgacaacgtcacgccgagtagttgtttacacngacctaccaataaactaactactacttgacgttaggaccagacaacgaactacggacacccgtacccctaagtcctacgtattacggnggactactccgggtacccggggtacgggtccccgggttaccgacggtaacccgtagttacggaaggtaccgcgggtacgggtccgggtcggtacgggacgtaacgttcgtttccaaaccgttccaacctaacctacgtacccaaccctaaccggttcgaggtaaccgtccgtaaggaagttacgttggtacggttaacgttaagtttttacgtacggttaacgtaacggtaactaaccgttaaacttacccggtttaaacgttacccctttaaccccgtttcccgttaacccgggtttacccgtacccgggggttttaaccggggaacccggggggtaaacccggggttaaacccggggtaaacgggttaagggttaaaccccgggttaaggtttaaaaccccggtaaaaacggggttacccgggttaaccgggggttaccccgtacccgggtaaacgttaccccgtaaaacccgggtttcttaacccccgttttaacgggttcccctttacccggtttaacccccgttccccccggttttaaaccccccgtaacggtaacccctttacccgttaacccgggtaaaaccctttttaacccccggg

SEQ ID NO: 52303 - DNA, 1066 bp, Homo sapiens
  misc_feature: GYAE6OF01A3A6S.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtcgccggacgggacatcgtgatcgacccagtcctccagtacctccctggttgtcgtctcgtgggcgaggacggacccaccataccaacttgaccgaacgtacccgacgccgtaaggttagttttagtttttaacaccgaacggtaccctaacccaaaacaaaacttaaaccctaaaaccgtttaaccttacggtaccgttttacggtaaacccgaacgaaccgaaaaccggaaaacccggacggaacccgtaacccggtaacccccccgttaaacggttacccttaaccgttaaccgttttaccggtacgggtacctaaaccggttaccccggttaacccccggggggtaaccgggttcccccgggggttacccgtaccgggtaacccgtacggttaccgaacggacgggtaccgtaacggggtccggggttaccgtacgggtaaccggtaacggtttacctttacccgtaaccgttcccctaacccgtaacccctaccgtaaccccgaaacccgtaacccggtaccgtacccgaaccgggtaccgttaacggaacggttaacgttacgggtccggtttaaaccgttaaagttttttccccgtaacgtttacggacgttaaacccgtaaccgtttaaaaccgtttaactttaaacccgttcccggttaccccctttaccgggtttacccctaacgggtttaaccccgggggggttaacccgggtacggggtaaaccgggaaaccgggttagggttacccgggaaagtacccttaaaacgggaaaccccgttacgggtttcggtaaaccggggtccctaaacgtacctaaaccccgtttcgtttaaccccgggtttcttaaaccccggttttaccccccaccggttttttaccccccccgtaccccgggttaaaacttaccccggggtttaactaaccccgttaacgttttaaaaccccg

SEQ ID NO: 52304 - DNA, 841 bp, Homo sapiens
  misc_feature: GYAE6OF01BET33.18.11.A11.1.454.CMB.1.raw
  modified_base (223)..(223): a, c, t, g, unknown or other
  misc_feature (223)..(223): n is a, c, g, or t
tcagtacgagtatgcacgaccggtgctcgatttagctacgactgcgagggggcagcaagatggtgttgcagtacccaggtcttcatttctctgttgctctggatctctggtcgccggacggggacatcgtgatcgacccagtcctccagtacctcccgtggttgtcgtctcgtgggcgaggacgggccaccatcactgacacgtccagccagtagttgtttanacgacgtcctaccaaacgggggaactaaacctaacttacttacgtcgttacggtaccagccaacggaaaaccctagggaacccaccggcccccccgttaaaggtccctactaacttttaccggtggggacctaacgttccccggtaaccccggggggtacgggttcccccggggggttacccctacgggaacccggtactttaccggaacgggaacggggtccgaacggggtccggggttacgtagggggaacctaggttactttccgaaccgttcctacccaaccgtacctacccaacccgtaacccttcgggaccctaagggtccttaaggaacggtatcgggtacggtaccttaagttttacttacgtgtactaacgtactaaattactagttccgtccccttaccgtccgtacgttaccgggttccgggacgggtaaccggggtaccgtaaggggtacgggaacgtaaccgttaaccggaaacccggttacggtcgggtaccgtccgttacggaccctaacccgtcgttcgttaccggttcccttaccggtaccccttttaccccggttccccccgtacttaccccgttaccgtaccgttacccgtttaacccg

SEQ ID NO: 52305 - DNA, 777 bp, Homo sapiens
  misc_feature: GYAE6OF01C6M9U.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtgccgacggggacatcgtgatcgacccagtctccagacctcctggttgtgtctcgtgggcgaggaggccaccatcaactgacaacgtccacgccagtagttagttttaactacacgtcctaccaaactaaactaaacctaacttaaccgtttaggtccgtttacggtacccagaacaacgaaaaccgacggaaccacccggacccccctaaggtacccttactaacgtttaacgtcgggacctacgttacccggtacccggggtacggtcccgggtccgtacgaccgtagttacgacggaacggcgacggccgggttacgtacgggactacgttacgtttaccacttacctaccacctaactaccaaccgtaaccgtcgacgtaacggtctaagggaagtacgtacggtcggtaactttaacggttttactacgttacgtacaacggtaactaacgtaacttaacgttaccgttaccctcccgttaccgtaccggtaccggttaccgggaccgggtaaacgggaccgtaaggggtacgtaacggtacgtaacgtaaacggtacgtacggtcggtactaccggtaccgtaaccctagttaccctttcgttaccgttaccctacgtttaccccgtccccgtaacttaccgtacgtccgtaaacgttaacccg

SEQ ID NO: 52306 - DNA, 751 bp, Homo sapiens
  misc_feature: GYAE6OF01DG3QG.18.11.A11.1.454.CMB.1.raw
  modified_base (217)..(217): a, c, t, g, unknown or other
  misc_feature (217)..(217): n is a, c, g, or t
  modified_base (290)..(290): a, c, t, g, unknown or other
  misc_feature (290)..(290): n is a, c, g, or t
  modified_base (550)..(550): a, c, t, g, unknown or other
  misc_feature (550)..(550): n is a, c, g, or t
tcagtacgagtatgcacgaccggtgctcgatttagctacgactgcaggggcagcaagatggtgttgcagacccaggtcttcatttctctgttgctctggatctctggtgccggacgggacatcgtgatcgaccagtcctcagacctcctggttcgtgtctcgtggcgagacggaccacatacaacgtgacaacgtccagccgagtgttagttttaanacgacgtacctaaccaaacaaactaaacctaacttacgtagtacgttacggtaccaagaacaacgaaaaccgnggaaccaccggtaccccgttaagcctaattacgttacgcggtctaaccgtccggtaacccgggacggtccgggtaccctacggacctacgttacgaggacgtcgacgggtcgggtacgacgggtactaacggtctttacccacgttacctccgtaactactacccaaacccgtactacgcggtaacgtagtacgtaagtacgttcggtacgtacgtttaagtttactacgtagtaccgtaacgtaacttactaaccgttnttaacccgttccttacccgttacgtaccgtttaccgggtcggggaaccggtaaacgggtaaccgtaacgggtagaccgtaaccgtaaacgtaaccggtcgttacggacgttctaaccggactacgttaacgtgtttaccggtcctttaccctacccgttacccgtccccttaacgccgttaacgtacgtaacccttacggg

SEQ ID NO: 52307 - DNA, 701 bp, Homo sapiens
  misc_feature: GYAE6OF01EHSGP.18.11.A11.1.454.CMB.1.raw
  modified_base (455)..(455): a, c, t, g, unknown or other
  misc_feature (455)..(455): n is a, c, g, or t
  modified_base (526)..(526): a, c, t, g, unknown or other
  misc_feature (526)..(526): n is a, c, g, or t
tcagtacgagtatgcacgaccggtgctcgatttagctacgactgcaggggcagcaagatggtgttgcacgacccaggtcttcatttctctgttgctctggatctcgtggtcgccggacgggacatcgtgactcgacccagtctccagtacctccgttggttgtgtctcgtgggacgaacggacgggaccaaccataccaactgacaacgtccacgaccagtagttagttttaacacacgacctaccaaaacaaactaaacctaacttacgttaacgtcgttacggtaccagacaaacgaaaccgacggaaccaccgtaccccgtaacgtcctactaacgtttacgcggacctacgtaccggtacccggggacggttcccggggtcctacgaccgtatcgagacggacgacggtcgggtacgtggacagtacttacactcacactactacaccacngacagctagagtctggcgtacttaagtttactactagacaagtactaaattacgtactaccgtcccttacnccgttacgtaaccggttcgggaacggaaccgggaacgtaaggtcgggaactaaccgtaacgaaacggtacgtcggacgtacgtccgaacccgttaactagtttacccttacggttcccttacgttacccgtttcccccgtaacccgtaccctaagttcgtaaacctaacgtaacc

SEQ ID NO: 52308 - DNA, 695 bp, Homo sapiens
  misc_feature: GYAE6OF01BF4GI.18.11.A11.1.454.CMB.1.raw
  modified_base (229)..(229): a, c, t, g, unknown or other
  misc_feature (229)..(229): n is a, c, g, or t
  modified_base (647)..(647): a, c, t, g, unknown or other
  misc_feature (647)..(647): n is a, c, g, or t
tcagtacgagtatgcacgaccggtgctcgatttagctacgactgcaggggcagcaagatggtgttgcagacccaggtcttcatttctctgttgctctggatctctggtgccggacgggggacatcggtgatcgacccagtctccacgacctcccgtggttgtgtctcgtgggcgaggacgggccaccatacaactgacacgtccagccagtagttagttttactacacnctaccaaacaaactaaaccaacttacttacgtcgttacggtaccagacaacgaaaccgaggaccgaccgtacccccgttaacggtacctactactttacgtcgggacctacgtacccggtaccccggggtacgggttccccggggttcccctacggtacccgtacgtacgacggtacggcgtacgggtcgggtcggtacgggactagttacttaccgacttcctaccaccactaccaacccaccgtacgacgtacgtagagacgtgtgggtacgtattagtttactacgtgtacagtaactaatacctacttaccgtcccttaccgtcccttacggtaccggtcgggtaacggggacgggtaaccaaggggtacgaacgtacgtaacgaaccgtagtcggacgtcgaccgctaccgtnttactcgttcctccttacgtcccgtacctctactcacgtaccttaacg

SEQ ID NO: 52309 - DNA, 726 bp, Homo sapiens
  misc_feature: GYAE6OF01A7F8K.18.11.A11.1.454.CMB.1.raw
  modified_base (403)..(403): a, c, t, g, unknown or other
  misc_feature (403)..(403): n is a, c, g, or t
tcagtacgagtatgcacgaccggtgctcgatttagctacgactgcaggggcagcaagatggtgttgcagacccaggtcttcatttctctgttgctctggatctctggtgccggacggggacatcgtgatcgaccagtctccagacctcccgtggttgtgtctcgtgggcgaggacgggccaccataccaacgtcgacaacgtccacgaccgaagtagttacgttttaactacgacgtactacccaaacaaacttaaaccaacttacttacgtcgttacggtaaccagacaaacgaaaccgaaggaaccacgtacccctaacgtaacggtccctactaacgtttacgacgggtactacgtaccggtaccccggggtacgggtccccgggtcccgtcgaaccgtntacgtagggacgaccgagggtcgggtacgacgggtacgagtacttccactcctacgacctacgtaccaaccctacctacgacgtaagggtacctaacgggtaaagtacggttggtaccggttaacgttaacgtttttaacggttacttaacgggtcctaaacgtacctaaaccgtttaactaccgttaaccgttcccgtacccttagtcctagtcggtacggacgggacgtaacgagggtagagtacgagaacgcgtcggtacgcgtacgcctactcgttccaggttccctcttacgtcccctaccctcgtacctcgtaaccg

SEQ ID NO: 52310 - DNA, 955 bp, Homo sapiens
  misc_feature: GYAE6OF01A1AZ5.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtgccgacggggacatcgtgatcgacccagtctccagactccgtggttgtgtctcgtgggcgaggagggccaccatcaactcgacaacgtccacgaccgagtacgttgttttaactaacgagcctaaccaaaaccaaactaaacctaaaccgttactttacgtccgtttacggtaccaaggaccaaacggaaaacccgaacgggtaaccaacccggtaaccccccgttaacggttacccttacgttaacttttaccggtacgggtacctaacgttaccccggttaaccccgggggtaccggttccccgggggtacccgtaccggacccgttacgttacgtaacgggacggccggacgggtccggggttacggtacgggtaactaacggttacgtttaccgtaccttacccgtacctaacccgtaacgtaccctaacccgtaacccgtcgaccgtacggtacgtaaggtaacggtaacgttcgggtaacgggtaccttttaaggttttaaccgttacgttagtaccgacggtaaacttaaccgtttaactttacgtttaacccggttcccctttaccgttaaccgtttacccgggttaaccggggtttacccggggaaaccgggggttaacgggaacccggttaacgggggttaaacggtaacccgtaaacggttaaccccgggttaaaaaccggttaggttcccgggggttacctaccgggttaccgtaacccgtaacccgtttggttaccccgtttaacggtttccccttaccgggtaaacccctttcccgggtttaaccccccaacgtttaacccggtaccgtttaaccggaaacccgttttacccg

SEQ ID NO: 52311 - DNA, 677 bp, Homo sapiens
  misc_feature: GYAE6OF01ED7FY.18.11.A11.1.454.CMB.1.raw
  modified_base (210)..(210): a, c, t, g, unknown or other
  misc_feature (210)..(210): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtcctctgggcgagagggccaccatcaactgcaagtccagccagagtgtttttanacagctcccaaacaataaaccaacttacttaagcttggtacccagcagaaacccaggacacgaccccctaaggtcctactattttaccgtggggacctagttccgtacccggggacgttcccggggggtccctagacccggtagttcacggaaggccaggtccgggtctggggactaggtacttcactcttcgaccatacaccaaacctgactaggccttaggaagtatcggtaggctaaggtttattactggtacacgtgaaacttacttaataacgttccctcttaccttcgtacccggtttacgggacgggtaacgggtaaccccaagggttacggaacgtaacgttaaccgaaaacggaacccttaggtagggtcccgttagaccctaaccgtaacgtcctttggttaccctttctaccgtttccctaccccggttacccaatttccgtcgtacgtaaacccg

SEQ ID NO: 52312 - DNA, 824 bp, Homo sapiens
  misc_feature: GYAE6OF01EGIWY.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtgccggacggggacatcgtgatcgacccagtcctccagtacctccgtggttgtcgtctcgtgggcgagacggccaccatcaactgactaacgtccagaccaggtagtttagttttactaaccacgtacccttaaccaaaactaaacgtaaaacctaaacctttaactttacggtaccgtttacggtaaccaacgaaccgaaaccggaaaacccgacgggtaacccaacccggtaccccccgttaaaacgggtcccttacgttaacgttttaccggcggggtacctacgttaccccgggtaaccccgggggacggtttccccgggggttacccctacggtacccgtaacgtttaccggaacgggacggacccggtagggtcccgggttacggtacggggaacctaggtttacctttaccgtacccgttacctacccgaaccgtactaacccgaaccctaaaccggtgaccgtacggtatacggtaaggtcttaggtaccgttacgttaacgttttacgttacgtcgtacgtacgtaactaacgtttacgttaactccgtttaccctcgtacctaccggttaccggtaccgggtacgggtaccggtaacggtacgggtacgaacgtaacgtaaccgaacgtacgttgacgtctacgacctacgtacttcgtacgttctaccgtccttcccgtacctacttacctacgtcgtacgtaccg

SEQ ID NO: 52313 - DNA, 725 bp, Homo sapiens
  misc_feature: GYAE6OF01DSMHC.18.11.A11.1.454.CMB.1.raw
  modified_base (235)..(235): a, c, t, g, unknown or other
  misc_feature (235)..(235): n is a, c, g, or t
  modified_base (252)..(252): a, c, t, g, unknown or other
  misc_feature (252)..(252): n is a, c, g, or t
  modified_base (332)..(332): a, c, t, g, unknown or other
  misc_feature (332)..(332): n is a, c, g, or t
tcagtacgagtatgcacgaccggtgctcgatttagctacgactgcaggggcagcaagatggtgttgcagacccaggtcttcatttctctgttgctctggatctctggtgccgacggggactatcgtgatgacccagtctccagacctcccgttgggttgtcgtcgtcgtggggccgaaggacgggcccaaccatcaacgtgaccaaggtccaggccaaggacgttagtttttaanaccaggtctacccaaanaaactaacgaacttacgttagccttaggtacccagtacaacgaaaccgaggaccacgccctaacggtcctcgtattacgnggcactccggtaccggacgtcccggggtacctgaccgagttaccgagtacggtcgacgggtcgggttcgacggggacctaggtactttaccgaacctcttacccgaccaagtacccaaccgaaccctacgggccaacgggtccgtaaggaccgtaagttcggtaggtaccttagttaactttcgtagttcgaacgtactaacggttacttaacggtactcctaccgtttctaccggtaaccggtttcggggaaccggttaacgggaccgttaacgggaggtacggtaagtacccgaaacggtactacgggtacggtacgaccgtacgtacccgtacgtacccttcgttcttactaccctccggttaccctacgaccttcggtaccagttaccc

SEQ ID NO: 52314 - DNA, 706 bp, Homo sapiens
  misc_feature: GYAE6OF01B9J79.18.11.A11.1.454.CMB.1.raw
  modified_base (135)..(135): a, c, t, g, unknown or other
  misc_feature (135)..(135): n is a, c, g, or t
  modified_base (600)..(600): a, c, t, g, unknown or other
  misc_feature (600)..(600): n is a, c, g, or t
  modified_base (606)..(606): a, c, t, g, unknown or other
  misc_feature (606)..(606): n is a, c, g, or t
tcagtacgagtatgcacgaccggtgctcgatttagctacgactgcaggggcagcaagatggtgttgcagacccaggtcttcatttctctgttgctctggatctctggtgccggacgggacatcgtgatcgacccngtctccagaccttcccgttggttcgtcgtctcgtcgggacgaggacggccaccatccaacgtcgactaacgtccacgccgagtacgtttagttttacaccacgcctaccaaactaaactaaacctacttaacgtacggtacgttacgggtaaccaggaacctaacgaaaccgacggaacctacccggtacccccgttaacggtcctactacggttacgtcgggacctacgtacccggtacccggggaccggttcccgggtaccctacggtactacgtcgacggcggacgtcgggccggtagtacgggacagttacttccgacttcgaccacctactaaccaccaccgtgacgagtacctaaggacgtagtggacgttacgttagtttactacgtgacctagtaacctatacgtacttccgtccctactaccgtcggtaccggtcgggcgaacggacggtaagganacgtanacgtaaacgtgtacggcgtacctacggactcgtacgttctacgtttaccgccttacccggttcccttaccccgtactaagttcgtaccgttaccgtaacg

SEQ ID NO: 52315 - DNA, 788 bp, Homo sapiens
  misc_feature: GYAE6OF01CEWV8.18.11.A11.1.454.CMB.1.raw
  modified_base (228)..(228): a, c, t, g, unknown or other
  misc_feature (228)..(228): n is a, c, g, or t
  modified_base (291)..(291): a, c, t, g, unknown or other
  misc_feature (291)..(291): n is a, c, g, or t
  modified_base (751)..(751): a, c, t, g, unknown or other
  misc_feature (751)..(751): n is a, c, g, or t
  modified_base (773)..(773): a, c, t, g, unknown or other
  misc_feature (773)..(773): n is a, c, g, or t
tcagtacgagtatgcacgaccggtgctcgatttagctacgactgcaggggcagcaagatggtgttgcagacccaggtcttcatttctctgttgctctggatctctggtgccgacgggacatcgtgatcgaccctagtcctccagtacctcccgtggttgtcgtcctcgtgggcgaggacgggcccaccattaccaacgtgaccaacgtccagccagtagttgttttanaccgagtcctacaaacaactaacgtaacttacgttagcgttacgtaccagtcaaacgaaaccnggaaccaccgtaccccgtaaggtcctactacgttacggtcggactacgtccggtacccggggtacgtccccgggtacctacggacccgtattcgacggtacgacggtacggtccgggttaccgagggtaacctacggttacttttacccggacctttacccgtacccgtaaccgtaacccgtaccccgtaaaacccgtacccgttcgaacccggttaaacggggtccttaaacgggaaaccggtttgttaccgggttaacgggtttaacctttaacggtttttaaccgtttaaccgtacgttaaccgttaacggaaacctttaaacggttaaccttaacgttaacccgttccccttacccgttacgttacccggtacgggtttacccgggaacgggtaaccggtaacgtacgggtacgtaacgtacgtaacgaacgtacgtcgtcgacgtcgactcgtancgtctctccgcttccggtaccnattcgaactcgtacg

SEQ ID NO: 52316 - DNA, 957 bp, Homo sapiens
  misc_feature: GYAE6OF01CRAUI.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtcgccgacggggacatcgtgatcgacccagtcctccagaccttcccgtggttgtcgtctcgtgggacgaggacgggcccaccatccaacgtgccaacgtccacggcccgtaaggtagtttagtttttaacacgacggtaccttaacccaaaactaaactaaaccgacgtaccttaacttacggtccgtttacgggtacccaaggtaaccaaacggaaaacccgagggaacccacccggtaaccccccgttaaacggttcccttacgttaacgtttaccggtcgggtaccctaaccggtccccggtaacccggggtccgggtttccccggggaccctcggaccgtattaccggaacggtacggaccgtaagggtcccgggtacggtagggaaccgttagttaccgtttaccgtaacccttacccgtaccggtaaacccctaaccgtaacccctaaacccccgaacggttccggaccgtaacgggttaccgtaacggaaacggtttacgttaccggggtacgggttaaaccgttttacgttttaaacgttaacccggttagttaccgtaaacggtaaccttaaaccgtttaccgttaaactttccccggtttacccccttaccctttaccggttacccggttaacccgggggtttaccggggacccggggttaaacggggtacccggtaaaggggggtccgtaaacggtaaacccttaaccggtaaacgacggttaccggacggttaccctccggaaacccgttctacccgtttaacggtttccctaccgtttaacccacccggtttaccccttccccggaactttacccgtaccggttaccgttaaacccg

SEQ ID NO: 52317 - DNA, 863 bp, Homo sapiens
  misc_feature: GYAE6OF01ANSAI.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtgccggacggggacatcgtgatcgacccagtcctccagacctccgtggttgtgtctcgtgggcgaggcggcccaccatacaactgacaacgtccacgccaggtacgtttagttttaacaccacgcctaaccaaactaaactaaacctaaaccttaacgttacgtaccgttacggtaaccgagaccaaaccggaaaccggacggaccgacccggtacccccgtaacggttccctaccttacgtttaccggtcggtacctaccggttaccccggtaccccggggtaccgggttcccgggtacccgtacggtacccggtacgttaccggagggtaccgggacgtacggggtaccggggttacgggtacgggaacgtacggttacctttaccgaaccgttccctaccaaccgtacctacccgaacccgtaccgttcgaccggtacggtaccgtagggtaacgtacgggttcgggtaccggttaactttaaggttttacgttaacggtaccgtaaacgtacctaaacttaaccttacgtttaaccgtacccggtttacccttacccgttccggtttaacggtcccgggtttaccggggaacgggtaaccgggtaacggttacgggagggtaaactaacccgtaacggtaaaccgacgggttcgtacggccgttaaccgacctaccggttcttacgggttcccgttaacttcccgttacccttcccgtacccgtacttaccgtactacccgtaattccccgg

SEQ ID NO: 52318 - DNA, 934 bp, Homo sapiens
  misc_feature: GYAE6OF01ENQLG.18.11.A11.1.454.CMB.1.raw
tcagtacgagtatgcacgaccggtgctcgatttagctacgactgcaggggcagcaagatggtgttgcagacccaggtcttcatttctctgttgctctggatctcgtggtcgccggacgggacatcgtgatcgaccctagtcctccacgtaccgttccgttggttgtcgtcgtcggtcgggacgaggacggcccaccgtactacaacgtgacgtaacgtccgacggaccgtagtaggtttactttactacgacgtacctaaccaaacgtaataaacctaacttacgttacgtcgttacggtaccacgtacaaacggaaccgtaacggacctacccgtaccccgtaacgttcctacgttacgttaccggcggtacctaccggttacccggtaccgggggtaccgggttccccggggttacccgtacggtaaccgttacgttacggaacgggacggtccggtacgggtaccgggttacggtacgggtaaccgtacttacgtttacccgacctttacccgtaccgtaaccctaccgtaaccccgtaacccggtaaccgttacggaaccggtaacggtaccggtaaacgggtaaacggtacgttttaccgggtacgggtttaaacttttaacgtttttaacggttaccgttaccgggaaactaacgttaaaccgttaaagtttacccgttaaccgttttacccgttccccgtttacctacccgtttacgggggtacccgggttacccgggaaggggtaaccggtaacgggttaagggtacccggtaaattaaccggaaactaaaccggggttcgtacgggttcggtaccctagaaccccgttacgttccgttaaccggttcctttaaaccggcccctttacggttaccccccccgtcgggtacccttaacgttcccgttacgaaccgtttaaaccccgg

SEQ ID NO: 52319 - DNA, 960 bp, Homo sapiens
  misc_feature: GYAE6OF01CIXMB.18.11.A11.1.454.CMB.1.raw
  modified_base (101)..(101): a, c, t, g, unknown or other
  misc_feature (101)..(101): n is a, c, g, or t
tcagtacgagtatgcacgaccggtgctcgatttagctacgactgcaggggcagcaagatggtgttgcagacccaggtcttcatttctctgttgctctaggntctctggtcgccggagggacatcggtgactcgacccagtcctaccgaagtcctccgttgggttgtcgtccgtcggtcgggacgtaggaccgggcccaacctatacccgtaaacgttcggaaccgtaaaaccgttcccaacggtacccggtaaggtttaaggtttttaacgttttttaaacaaccgaaccggtaccccttaaaaccctaaaaacttaaaaacctaaaaacccgttaaaccgttttaaaccggttaaccggttaccggttttacgggaaaacccgacggtaacccgaaaaaccggaaaaacccggttaacggaacccgtaacccgggtaaaccccccgttaaacgggttcccttaacgtttaaaccggtttacccgggtacgggtaacccgtaacccgggttaaccccggggtaacccccggggttaccggggttaccccccgggggttacccgtaacccggtaaccgtacgttacggaacgggtacgaccgggtacgggtcgggtacggtacggacgtaacggttccttaaccgtccgtacgtaacccaactccgtaacccgaacctaaccgtcggtacgacgtacgtaacgggaacgtgtagttccggtagtttaacgtttaagttacgacgtacgactaacgttacttactaacgttcctacccttccgtaccgttacggtacggtccgggaacggacgggtaaaccggtaggtaaccgaaggtaaccgtaaaccgtaaggtaccgtcgttacggcccgtaggtacctaaacgtctacggttttaacgttccgttacccttacgttaccccgtacgtaccgttacttacgtaccgtaaccgttaccgg

SEQ ID NO: 52320 - DNA, 794 bp, Homo sapiens
  misc_feature: GYAE6OF01CBPDQ.18.11.A11.1.454.CMB.1.raw
  modified_base (587)..(587): a, c, t, g, unknown or other
  misc_feature (587)..(587): n is a, c, g, or t
tcagtacgagtatgcacgaccggtgctcgatttagctacgactgcaggggcagcaagatggtgttgcagacccaggtcttcatttctctgttgctctggatctctggtcgccggacggggacatcggtgactcgacccagtcctccgagtaccttcccgtggttgtcgtctcgtgggacgaggacggacccacatacacgtcgacaacgtccagccgaagtagttagttttaacacgactacctaaccaaaactaaactaaacctaaccttaacgttacgtccgtttacgggaacccagtaaccgaaacggaaaaccgaacgggaaccctaaccccggtaacccccgttaaacggtcccttaacgtaacgtttaccggcgggtacctacccggttaacccgggttaccccgggggtacgggttccccgggtaccgtacggacccgtagtacgacggacggtcggacggtccgggtacgacgggactaggttcttaccgactccaccaaccgtactacccaaccgtaaccgtcggacgtacggacgtaggaactacggttcggtataaccgttagtttaactcggtanaacgaagtactaacttactcgtaccctcctccgtacgtcggtacgggtccggaacgggtagtaaccgaagggtacgtaagtaacgaaaccgtaacgtacggtaggtcggaccctagtaaccccgtacgttacggttcttacggtttaccctaccgtaccccgttacccgttaccccgaaatttccgtaacgcgttaaacctaaccgg

SEQ ID NO: 52321 - DNA, 764 bp, Homo sapiens
  misc_feature: GYAE6OF01BIE5B.18.11.A11.1.454.CMB.1.raw
  modified_base (693)..(693): a, c, t, g, unknown or other
  misc_feature (693)..(693): n is a, c, g, or t
  modified_base (745)..(745): a, c, t, g, unknown or other
  misc_feature (745)..(745): n is a, c, g, or t
  modified_base (750)..(750): a, c, t, g, unknown or other
  misc_feature (750)..(750): n is a, c, g, or t
  modified_base (756)..(756): a, c, t, g, unknown or other
  misc_feature (756)..(756): n is a, c, g, or t
tcagtacgagtatgcacgaccggtgctcgatttagctacgactgcaggggcagcaagatggtgttgcagacccaggtcttcatttctctgttgctctggatcgtctggtcgccgacggggacagtcgtgatcgacccagtcgtccagacctcccgtggttgtgtctcgtgggcgaggcgggccacactcaacgtcgacgaacgtccgacgccgaaggtacgtttacgtttttaacaaccgacgtccgtaccaaacctaaacgtaactaacttacgttacgtccgttacggtacccaaggtcaaaccggaaaccgtacggaacccaccggtacccccgtaaaggttcctacgttaacgtttacggcgggctacgtccggggtaccccgggggtacggtttcccggaccgtaccggaactcgtacggacggcggacgtacgggtcggtacgtacggactagttcctacctaccgtcctaccgtacaccttaccgaaccctcgtacgggcgttacggacgtaacgggacttacgggttacggtacgtttacctttaaggttttactccgacgtagtaacctacgttaacgtttactacggtttaccctcccttccttaccggtaccgggttcggtaaccgggacgggtaaccgaaccggttagggacgtaaaccgacgtaaaccggacggttacgnggtccgtaccgacacctagtcgtttactccgtacttacggtcctcccgtacnctacnccgtanacccttcg

SEQ ID NO: 52322 - DNA, 645 bp, Homo sapiens
  misc_feature: GYAE6OF01ALK5P.18.11.A11.1.454.CMB.1.raw
  modified_base (212)..(212): a, c, t, g, unknown or other
  misc_feature (212)..(212): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctcgtgggcgaggagggccaccatcaactgcaagtccagccagtagttgttttanacagctaccaacaataacaactacttagcttggtaccagacaagaaaccaggaccacgaccccctaaggtcctactattacgtgggcagtccgtacccgggagtccgggtccctgaccgtattcgaggacggcaggcgggtcgtagggactagtactttaccgactccgtacaacctactaccaacctaaccgtcgacgtacggctagaagtagtggtcggtacttagtttacttacgtgtacagactaatactactacgttccctctacgtacgacggttcgggacgggtaccggtaacgtaagggtacggaacgtacgtaaccgtaaaacgtacgttcggtacggtacctcgaccgtacccgtacgttccgttacgtccctttacgtaccctttcccgtacccgtactacttccgtacgtacgttaacccg

SEQ ID NO: 52323 - DNA, 786 bp, Homo sapiens
  misc_feature: GYAE6OF01CGUQV.18.11.A11.1.454.CMB.1.raw
  modified_base (484)..(484): a, c, t, g, unknown or other
  misc_feature (484)..(484): n is a, c, g, or t
  modified_base (707)..(707): a, c, t, g, unknown or other
  misc_feature (707)..(707): n is a, c, g, or t
tcagtacgagtatgcacgaccggtgctcgatttagctacgactgcaggggcagcaagatggtgttgcagacccaggtcttcatttctctgttgctctggatctctggtcgccggacggggacatcgtgatcgaccagtcctccacgacctccgtggttgtcgtctcgtgggcgaggacggccacatcaacgtcgacaacgtccacgccgaggtagtttgttttaacacgagcctaaccaaactaaactaaacctaaacgttacttacgtaccgtttacggtaaccacgactaaacggaaaccgtacggaaccgtaacccgtacccccgttaacggtccttacttaacgtttacgcgggtacctacgtcccggtacccgggtcggttcccgggtaccgtacgacgtcgtacgacggacggcgacggtcgggtcgtacggacgtacgtacttcgacctctaccacctacgtaccaaccgtaaccgnggaccgtacggtacgtaggtaacgtggtcgtacggttacttaagttacgtttccgagacgtaacgtacttaacttcctaaccgtttaccgtcccttacgttaccgttacggtacccggggtacgggtacggggtaaccggtaaccggagggtaacgaacggtacgaaaaccggtacggtaacgtcggtaccctcgggtaaccgtaccctaaggttcccgtttnttaccggtttaccttccccggttaaccttaccccccgggttaccctaactaccgtttcctaaacggtccctttaaacgg

SEQ ID NO: 52324 - DNA, 794 bp, Homo sapiens
  misc_feature: GYAE6OF01CZ2N0.18.11.A11.1.454.CMB.1.raw
  modified_base (70)..(70): a, c, t, g, unknown or other
  misc_feature (70)..(70): n is a, c, g, or t
  modified_base (130)..(130): a, c, t, g, unknown or other
  misc_feature (130)..(130): n is a, c, g, or t
  modified_base (723)..(723): a, c, t, g, unknown or other
  misc_feature (723)..(723): n is a, c, g, or t
  modified_base (730)..(730): a, c, t, g, unknown or other
  misc_feature (730)..(730): n is a, c, g, or t
tcagtacgagtatgcacgaccggtgctcgatttagctacgactgcaggggcagcaagatgggtgttgcanacccaggtcttcatttctctgttgctctggatctctggtcggccggacggggacatcgtnatcgacctagtcctccagtaccttccgtggttcgtcgtcctcggtggggacggagggacgggccaacctactacgaactgaccaacgtccacggaccaaggttacgtttagtttttaacaccgtacgtacctaaaccaaaaactaaaactaaaccgtaaacctttacgttacggtaccgtacgggtaaccaacggaaccgtaaacggaaaaccgaacgggaacccgtaacccggtaaccccggttaacgttacctacgttaacttaccggcgggtacctacgtacccggtaaccgggggtaccggtcccggggtacctacggacgtcgttacggacggacggtacggcgggtacgggtacggtacggaacgtacgttaccttcgtactacctaccaacgtactaaccaaccgtacccgtcgtacgtacggtacgtaacgagttacggtggtacgtacgttttaacgtttagtacgtcgtacgtaagtaacttaacgttactacggttacccttccctttacgtccttaccgggtacgggtacgggaacgggaacgaacgggttaggtacgactacaaacggacgtacgtgggntaaccgnacctacgtcgtcttacgttcctcgttacccaaccttcccgtatacgtacgtccgtacctacggg

SEQ ID NO: 52325 - DNA, 863 bp, Homo sapiens
  misc_feature: GYAE6OF01ATVR4.18.11.A11.1.454.CMB.1.raw
  modified_base (661)..(661): a, c, t, g, unknown or other
  misc_feature (661)..(661): n is a, c, g, or t
  modified_base (855)..(855): a, c, t, g, unknown or other
  misc_feature (855)..(855): n is a, c, g, or t
tcagtacgagtatgcacgaccggtgctcgatttagctacgactgcaggggcagcaagatggtgttgcacgtacccgaggtcttcatttctcttgttcgctcgtggatctcgtggtcggccggacggggactacgtcggtagtataccggaccctagttcctccgaagtccgttcccgttgggttgtccgtctcggtcggggaccgacggaccgggccaacctatacctaacgtcggacctaacgtccgacggaccgtaaggttaggtttacttttaacgacgtacgtaccctaactaaaacctaaacttaaaccgtaacgtttacgttgtaaccggtttacggaacctacggaaccgaaaacggaaccggtaaccgacccgtaaccgttacccccgttaaggtcccttaggttaacttcggtacggaccttaccggtccgggtaaccgggtcggtcccgggttaccacggtaccgtacgtacggaacggtcggacggtacgggttaccggtacggtacggaaccggttaattaccgttttaccgaaccttccgaccgttaaaccgtcctacccgtaaccgtaccggtcgggacgtacggtaaccggtaagagggttaccgtaacggtcgggtttaacttaacgggtttaactcccggttanaacggtacgtaaacgttaccttcggtaaccttaccggtccttaccgtcgttaccggggtaccggtaccgggtaacgggacggtaaccgtgggacggttaactaccgtaacggaacggttacgcggtacggtacggtccacgggttactagtcgtttccctcggttatacccgtccgtaccgactaagtaccgtntacgtccg

SEQ ID NO: 52326 - DNA, 849 bp, Homo sapiens
  misc_feature: GYAE6OF01CF4RM.18.11.A11.1.454.CMB.1.raw
  modified_base (393)..(393): a, c, t, g, unknown or other
  misc_feature (393)..(393): n is a, c, g, or t
tcagtacgagtatgcacgaccggtgctcgatttagctacgactgcaggggcagcaagatggtgttgcagacccaggtcttcatttctctgttgctctggatctctggtcgccggacggggacatcgtgatcgaccagtcctccacgaccttcccgtggttgtgtcctcgtggggcgaggacgggccaccatacaactgacaagtccgacgccgaggtagttgttttaacactacgtacctaccaaactaaactaaacctaaacttacgttagaccgtttcggaaccagtacaaacgaaaaccgacggaccaccggtaccccgttaacggtcctactacgtttacgtcgggaccacgtaccggtacccgggtaccggttcccgggggttacccncggtaaccgtagttacgagggacggctacgggtcggtaccgtagggaccgtagtcttacacctctaccaacctactaccaaccctaacgttcgaccgacggtacgtacggtaagtgtacgggttacgtacgtttaagttttaaccttacgtagtaacgtaactacgttaaacttaccgttaacttaacccgtttcccgtaccgtttaccccgttacgggtaacccgggtttaccgggacgggggtaaaccgaaccgggttaaggggggtacggaacgttaaccgtaaaccgtaaaacgggtctaacggggttccgggtccgaaccgtacccggtaaccgtttcgttcccggttttacccggtttccgttttacccccgggtttaaccctttccccgggaaaccctttacgggttaccccgttaacggttaaacccgtttcgtttaaacccccgggg

SEQ ID NO: 52327 - DNA, 498 bp, Homo sapiens
  misc_feature: GYAE6OF02HHFGG.18.11.A11.1.454.CMB.1.raw
  modified_base (207)..(207): a, c, t, g, unknown or other
  misc_feature (207)..(207): n is a, c, g, or t
  modified_base (478)..(478): a, c, t, g, unknown or other
  misc_feature (478)..(478): n is a, c, g, or t
tcagtacgagtatgcacgaccggtgctcgatttagctacgactgcagggcgagcaagatggtgttgcagacccaggtcttcatttcctctgttgctctggatctctggtgccgacgggacatcgtgatgacccagtctccagactccctggttgtgtctctgggcgagagggccaccatcaactgcaagtccagccagagtgtttanacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaacgatgtggcagtttatactgtcagcaatactatagtcctcctctcacgttcggcgaggaccaaggtggagatcaaacgactgtgctgcacgatctgtcttnatcttccgccatctgactac

SEQ ID NO: 52328 - DNA, 495 bp, Homo sapiens
  misc_feature: GYAE6OF02FXNV4.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtgccgacgggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgtggcagtttatactgtcagcaatactatagtcctctctcacgttcggcggaggaccaaggtgagatcaaacgactgtgctgcacatctgtcttcatcttcccgcatctgactac

SEQ ID NO: 52329 - DNA, 499 bp, Homo sapiens
  misc_feature: GYAE6OF02FOFMR.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgtttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgtggcagtttattactgtcagcaatactatagtcctctctcacgttcggcggagggaccaaggtgagatcaaacgactgtgctgcaccatctgtcttcatcttcccgccatctgactac

SEQ ID NO: 52330 - DNA, 525 bp, Homo sapiens
  misc_feature: GYAE6OF02IYEWW.18.11.A11.1.454.CMB.1.raw
  modified_base (440)..(440): a, c, t, g, unknown or other
  misc_feature (440)..(440): n is a, c, g, or t
  modified_base (470)..(470): a, c, t, g, unknown or other
  misc_feature (470)..(470): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagtcttgtaccacgcagaaaccaacggacagccccctaacggtacctccatttacttgggcgatctacccgggacgtccggggtcccgtcgaccgacttcagaggcagcgggtcgtgggacagatttcactctcaccactcacccaacctcgcaggctgaagatggtggcagttttattactgtcagcaatactattagtccttccnctcacgttcggcggagggaccaaggtgganatcaaacgactgtggctgcaccatctgtcttcatccttcccgaccatctcgatac

SEQ ID NO: 52331 - DNA, 499 bp, Homo sapiens
  misc_feature: GYAE6OF02GZ1NE.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgtggcagtttatactgtcagcaatactatagtcctcctctcacgttcggcggaggaccaaggtgagatcaaacgactgtgctgcaccgatctgtcttcatcttcccgcatctgactac

SEQ ID NO: 52332 - DNA, 504 bp, Homo sapiens
  misc_feature: GYAE6OF02IXVYA.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtcccggggtccctgaccgattcagaggcagcgggtctgggacagatttcactctcaccatcaccaacctgcaggctgaagatgtggcagttttatactgtcagcaatactatagtcctcctctcacgttcggcggagggaccaagggtgagatcaaacgactgtgctgcacgatctgtcttcattccttccgccatctgactac

SEQ ID NO: 52333 - DNA, 499 bp, Homo sapiens
  misc_feature: GYAE6OF02I1I9W.18.11.A11.1.454.CMB.1.raw
  modified_base (208)..(208): a, c, t, g, unknown or other
  misc_feature (208)..(208): n is a, c, g, or t
  modified_base (376)..(376): a, c, t, g, unknown or other
  misc_feature (376)..(376): n is a, c, g, or t
  modified_base (470)..(470): a, c, t, g, unknown or other
  misc_feature (470)..(470): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttanacagctccaacaataacaactacttagcttggtaccagcagaaaccaggacagccccctaaggtcctcattactgggcatctacccgggagtccggggtccctgaccgattcagaggcagcgggtctgggacagatttcactctcacatcaccaactgcaggctgaanatgtgcagtttatactgtcagcaatactatagtcctcctctcacgttcggcggaggaccaaggtggagataccaaacgtactgtggctgcaccntctgtcttcatcctcccgcatctgactac

SEQ ID NO: 52334 - DNA, 560 bp, Homo sapiens
  misc_feature: GYAE6OF02GVDKN.18.11.A11.1.454.CMB.1.raw
tcagtacgagtatgcacgaccggtgctcgatttagctacgactgctaggggtcggaagcaagatggtgttcgccaggaccctaggtcgttcatttcgtctcgtttgctctggatactctggtggccgacgggaccatcggtgtagtgacccagttcgttccagtactccctggtttagtgtctctgggcgagagggccaccatcaactgcaagtccgagccagacgtgttttatacgagcctcaacaataacaactacttagcttggtaccagcagaaacctaggacagtcccctaaggtcctcatttacgtcggcatctacccggagtccgggtaccgtgaccgattcgagaggctagtcgggtctgggacagactttcactctcacatcaccgaactcgcagggctgaagatgtgcaggtttactactgtacagactaatactatagtcctactctacacgtttcggacggaggaccaaggtgaagacttacaaacgtactgtcgctgacaccgtagtctagtacttcgattccttcccgctacgtcctactactacg

SEQ ID NO: 52335 - DNA, 516 bp, Homo sapiens
  misc_feature: GYAE6OF02IC2J4.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgacccgattcagaggcagcgggtctgggacagatttcactctcaccatcaccaacctgcaggctgaagatgtggcagtttatactgtcagcaatactatagtcctctctcacgttcggcggagggaccaagggtcggagacttacaaacggaactgtagctgccaccaatcctgtccttcacttcttcccgcctatctgactac

SEQ ID NO: 52336 - DNA, 490 bp, Homo sapiens
  misc_feature: GYAE6OF02IWYGK.18.11.A11.1.454.CMB.1.raw
  modified_base (455)..(455): a, c, t, g, unknown or other
  misc_feature (455)..(455): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcattactgggcatctacccgggagtccggggtccctgaccgattcagaggcagcggtctgggacagatttcactctcacatcaccaactgcaggctgaagatgtggcagtttatactgtcagcaaatactatagtcctctctcacgttcgcggaggaccaaggtgagatcaaacgactgngctgcacatctgtctcatcttccgcatctgactac

SEQ ID NO: 52337 - DNA, 502 bp, Homo sapiens
  misc_feature: GYAE6OF02JF26F.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgtggcagtttatactgtcagcaatactatagtcctcctctcacgtcggcggagggaccaagggtggagatcaaacgactgtgctgcacatctgtcttcatccttcccgcctatctagaatc

SEQ ID NO: 52338 - DNA, 499 bp, Homo sapiens
  misc_feature: GYAE6OF02HQQOJ.18.11.A11.1.454.CMB.1.raw
  modified_base (208)..(208): a, c, t, g, unknown or other
  misc_feature (208)..(208): n is a, c, g, or t
  modified_base (487)..(487): a, c, t, g, unknown or other
  misc_feature (487)..(487): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttanacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgtggcagtttatactgtcagcaatactatagtcctcttctcacgttcggcgagggaccaagggtgagatcaaacgactgtgctgcaccatctgtcttcatcttccnctatctgactac

SEQ ID NO: 52339 - DNA, 503 bp, Homo sapiens
  misc_feature: GYAE6OF02F4KE0.18.11.A11.1.454.CMB.1.raw
  modified_base (379)..(379): a, c, t, g, unknown or other
  misc_feature (379)..(379): n is a, c, g, or t
  modified_base (482)..(482): a, c, t, g, unknown or other
  misc_feature (482)..(482): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgtttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagntgtggctagtttatactgtcagcaatactatagtcctcctctcacgttcggcggtagggaccaaggtcgagatacgaaagactgagctgccacatctgtcttnatctcccgccatcctgactac

SEQ ID NO: 52340 - DNA, 528 bp, Homo sapiens
  misc_feature: GYAE6OF02IRFJH.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtgccgacgggacatcgtgatgacccagtctccagactccctggttgtgtctctgggcgagagggccaccatcaactgcaagtccagccagagtgttttatacagctccaacaataacaactactagcttggtaccagcagaaaccaggacagccccctaaggtcctcatttactgggcatctacccgggagtccggggtccctgaccgattcagaggcaggcgggtctgggacagatttcactctcaccatcaccaacctgcaggctgaagatgtggcagtttattactgtcagcaatactatagtcctcctctctacgttcggcggagggaccgaaggtggagatacgaaaacgaacgttgacggctggacctaccgattcctcgttcttcagttccttccccgcctactcctgactacg

SEQ ID NO: 52341 - DNA, 500 bp, Homo sapiens
  misc_feature: GYAE6OF02GEV8E.18.11.A11.1.454.CMB.1.raw
  modified_base (470)..(470): a, c, t, g, unknown or other
  misc_feature (470)..(470): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgtggcagtttatactgtcagcaatactatagtcctcctctcacgttcggcggagggaccaaggtgagatcaaacgactgtggctgcacntctgtcttcatcttcccgccatctgactac

SEQ ID NO: 52342 - DNA, 502 bp, Homo sapiens
  misc_feature: GYAE6OF02FT28M.18.11.A11.1.454.CMB.1.raw
  modified_base (448)..(448): a, c, t, g, unknown or other
  misc_feature (448)..(448): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgtggcagtttatactgtcagcaatactatagtcctctctcacgttcggcggagggaccaaggtgganatcaaacgaactgtggctgcaccatctgtcttcatcttcccgccatctgactac

SEQ ID NO: 52343 - DNA, 498 bp, Homo sapiens
  misc_feature: GYAE6OF02IFTDG.18.11.A11.1.454.CMB.1.raw
  modified_base (472)..(472): a, c, t, g, unknown or other
  misc_feature (472)..(472): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaaccaggacagccccctaaggtcctcatttactgggcatctacccgggagtccggggtccctgaccgattcagaggcagcgggtctgggacagatttcactctcaccatcaccaacctgcaggctgaagatgtggcagtttatactgtcagcaatactatagtcctcctctcacgttcggcgaggaccaaggtgagatcaaacgactgtgctgcaccatcngtcttcatcttcccgcatctgactac

SEQ ID NO: 52344 - DNA, 492 bp, Homo sapiens
  misc_feature: GYAE6OF02H4B5M.18.11.A11.1.454.CMB.1.raw
  modified_base (374)..(374): a, c, t, g, unknown or other
  misc_feature (374)..(374): n is a, c, g, or t
  modified_base (463)..(463): a, c, t, g, unknown or other
  misc_feature (463)..(463): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccggagtccggggtcctgaccgatcagagcagcgggtctgggacagatttcactctcaccatcaccaactgcagctgaagntgtggctagtttatactgtcagcaatactatagtcctctctcacgtcggcggaggaccaaggtcgagatacaaacgactgtgctgcacntctgtcttcatctcccgctatctgactac

SEQ ID NO: 52345 - DNA, 499 bp, Homo sapiens
  misc_feature: GYAE6OF02HBOIY.18.11.A11.1.454.CMB.1.raw
  modified_base (379)..(379): a, c, t, g, unknown or other
  misc_feature (379)..(379): n is a, c, g, or t
  modified_base (382)..(382): a, c, t, g, unknown or other
  misc_feature (382)..(382): n is a, c, g, or t
  modified_base (460)..(460): a, c, t, g, unknown or other
  misc_feature (460)..(460): n is a, c, g, or t
  modified_base (469)..(469): a, c, t, g, unknown or other
  misc_feature (469)..(469): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcattactggcatctacccgggagtccggggtccctgaccgattcagacggcagcgggtctgggacagatttcactctcaccatcaccaacctgcaggctgaagntgngcagtttatactgtcagcaatactatagtcctcctctcacgttcggcgacgggaccaaggtgagatcaaacgactggngctgcacgntctgtctcatccttcccgctatctgactac

SEQ ID NO: 52346 - DNA, 490 bp, Homo sapiens
  misc_feature: GYAE6OF02IZ2L5.18.11.A11.1.454.CMB.1.raw
  modified_base (455)..(455): a, c, t, g, unknown or other
  misc_feature (455)..(455): n is a, c, g, or t
  modified_base (463)..(463): a, c, t, g, unknown or other
  misc_feature (463)..(463): n is a, c, g, or t
tcagtacgagtatgcacgaccggtgctcgatttagctacgactgcagggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactggcatctacccgggagtccgggtccctgaccgattcagaggcagcggtctgggacagatttcactctcaccatcaccaactgcaggctgaagatgtggcagtttatactgtcagcaatactatagtcctcctctcacgttcggcgaggaccaaggtgagatacaaacgactgngctgcacntctgtcttcatcctccgcatctgacac

SEQ ID NO: 52347 - DNA, 501 bp, Homo sapiens
  misc_feature: GYAE6OF02I2PNH.18.11.A11.1.454.CMB.1.raw
  modified_base (467)..(467): a, c, t, g, unknown or other
  misc_feature (467)..(467): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgtttatacagctccaacaataacaactacttagcttggtaccagcagaaaccaggacagccccctaaggtcctcattactgggcatctacccgggagtccggggtccctgaccgattcagaggcagcgggtctgggacagattcactctcaccatcaccaacctgcaggctgaagatgtggcagtttatactgtcagcaatactatacgtcctctctcacgtcggcggaggaccaaggtgagatacaaacgactgtgctgacaccntcctgtcttcatccttccgcctatctcgactaac

SEQ ID NO: 52348 - DNA, 494 bp, Homo sapiens
  misc_feature: GYAE6OF02G5DMT.18.11.A11.1.454.CMB.1.raw
  modified_base (379)..(379): a, c, t, g, unknown or other
  misc_feature (379)..(379): n is a, c, g, or t
  modified_base (457)..(457): a, c, t, g, unknown or other
  misc_feature (457)..(457): n is a, c, g, or t
  modified_base (465)..(465): a, c, t, g, unknown or other
  misc_feature (465)..(465): n is a, c, g, or t
tcagtacgagtatgcacgaccggtgctcgatttagctacgactgcaggggcagcaagatggtgttgcagacccaggtcttcatttctctgttgctctggatctctggtgccgacgggacatcgtgatgacccagtctccagactccctggttgtgtctctgggcgagagggccaccatcaactgcaagtccagccagagtgtttatacagctccaacaataacaactacttagcttggtaccagcagaaaccaggacagccccctaaggtcctcatttactgggcatctacccgggagtccggggtccctggaccgattcagaggcagcgggtctgggacagatttcactctcacatcacaactgcaggctgaagatgnggcagtttatactgtcagcaatactatagtcctcctctcacgttcggcggaggaccaaggtgagatacaaacgactgngctgcacntctgtcttcatcttccgcatctagactac

SEQ ID NO: 52349 - DNA, 505 bp, Homo sapiens
  misc_feature: GYAE6OF02HYI4B.18.11.A11.1.454.CMB.1.raw
  modified_base (474)..(474): a, c, t, g, unknown or other
  misc_feature (474)..(474): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccccgggagtccggggtccctgaccgattcagaggcagcgggtctgggacagatttcactctcaccatcaccaactgcaggctgaagatgtggctagttttatactgtcagcaatactatagtcctcctctcacgttcggcggaggaccaaggtggagatacaaacgactgtggctgcacntctgtcttcatccttcccgctatctgactac

SEQ ID NO: 52350 - DNA, 526 bp, Homo sapiens
  misc_feature: GYAE6OF02JU43Y.18.11.A11.1.454.CMB.1.raw
  modified_base (284)..(284): a, c, t, g, unknown or other
  misc_feature (284)..(284): n is a, c, g, or t
  modified_base (381)..(381): a, c, t, g, unknown or other
  misc_feature (381)..(381): n is a, c, g, or t
  modified_base (501)..(501): a, c, t, g, unknown or other
  misc_feature (501)..(501): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgtttatacagctccaacaataacaactacttagcttggtaccagcagaaaccaggacagccccctaaggtcctacatttacgngggacatcgtacccgggagtccgggtcctgaccgattcgagaggcagcgggtctgggacagtattcactctcacatcaccactgcagctagagatgngctagtttatactgtcagacaagtactatacgtcctctctcgtacgttcggcggaaggaccaagggtagacgtataccgaaacgtacgtggtcgacctgacctaccagtctgttaccttnacttcctaccgctagtctagactac

SEQ ID NO: 52351 - DNA, 505 bp, Homo sapiens
  misc_feature: GYAE6OF02H49VI.18.11.A11.1.454.CMB.1.raw
  modified_base (465)..(465): a, c, t, g, unknown or other
  misc_feature (465)..(465): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgtggctagttttattactgtcagcaatactatagtccctctctcacgttcggcggaggaccaagggtgagatacaaacgactgngctgccacatctgtcttcattccttcccgcatctgactac

SEQ ID NO: 52352 - DNA, 500 bp, Homo sapiens
  misc_feature: GYAE6OF02I7JRT.18.11.A11.1.454.CMB.1.raw
  modified_base (457)..(457): a, c, t, g, unknown or other
  misc_feature (457)..(457): n is a, c, g, or t
tcagtacgagtatgcacgaccggtgctcgatttagctacgactgcaggggcagcaagatggtgttgcagacccaggtcttcatttctctgttgctctggatctctggtgccgacgggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattccagaggcagcgggtctgggacagatttcactctcaccatcaccaacctgcaggctgaagatgtggcagtttattactgtcagcaatactatagtcctcctctcacgttcgcggaggaccaggtgagatcaaacgacngtgctgcaccgatctgtcttcatcttcccgccatcctgactac

SEQ ID NO: 52353 - DNA, 506 bp, Homo sapiens
  misc_feature: GYAE6OF02HMA6B.18.11.A11.1.454.CMB.1.raw
  modified_base (385)..(385): a, c, t, g, unknown or other
  misc_feature (385)..(385): n is a, c, g, or t
  modified_base (429)..(429): a, c, t, g, unknown or other
  misc_feature (429)..(429): n is a, c, g, or t
  modified_base (469)..(469): a, c, t, g, unknown or other
  misc_feature (469)..(469): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcaagaaaccaggacacgaccccctaaggtcctcatttactgggcatctacccgggagtcccggggtccctgaccgattcagaggcaggcgggtctgggacagatttcactctcaccatcaccaactgcaggctagaagntgtgctagtttatactgtcagactaatactatacgtcctcctcnctacgtcggcggagggaccaggtgagatacaaacgtatgngctgcaccatctgtctcatcctcccgcatctgactac

SEQ ID NO: 52354 - DNA, 501 bp, Homo sapiens
  misc_feature: GYAE6OF02HYGHJ.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgtggcagtttatactgtcagcaatactatagtcctctctcacgttcggcggaggaccaaggtggagatcaaacgactgtgctgcaccatctgtcttcatccttcccgcctatctgactac

SEQ ID NO: 52355 - DNA, 514 bp, Homo sapiens
  misc_feature: GYAE6OF02GMTHC.18.11.A11.1.454.CMB.1.raw
  modified_base (282)..(282): a, c, t, g, unknown or other
  misc_feature (282)..(282): n is a, c, g, or t
  modified_base (376)..(376): a, c, t, g, unknown or other
  misc_feature (376)..(376): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaagtcctcatttacnggcatctacccgggagtccgggtccctgaccgattcagaggcagcggtctgggacagatttcactctcaccatcaccaacctgcaggctgaagntgtggctagtttattactgtcagcaaatactaatacgtccttcctctcacgtttcggcggagggaccaggtgagatacgaaacacgtggtgctagcacctatcgtgtcttcgattccttcccgccatcctagacctac

SEQ ID NO: 52356 - DNA, 504 bp, Homo sapiens
  misc_feature: GYAE6OF02G2DEJ.18.11.A11.1.454.CMB.1.raw
  modified_base (382)..(382): a, c, t, g, unknown or other
  misc_feature (382)..(382): n is a, c, g, or t
  modified_base (463)..(463): a, c, t, g, unknown or other
  misc_feature (463)..(463): n is a, c, g, or t
  modified_base (472)..(472): a, c, t, g, unknown or other
  misc_feature (472)..(472): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgtttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgnggctagtttatactgtcagcaatactatacgtcctctctctacgttcggcggagggaccagggtgagatacaaacgactgngctgcaccntctgtcttcattcctcccgctatctagactac

SEQ ID NO: 52357 - DNA, 497 bp, Homo sapiens
  misc_feature: GYAE6OF02F73TZ.18.11.A11.1.454.CMB.1.raw
  modified_base (469)..(469): a, c, t, g, unknown or other
  misc_feature (469)..(469): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgtggcagtttatactgtcagcaatactatagtcctctctcacgttcggcggagggaccaaggtgagatacaaacgactgtgctgcacntctgtctcatccttcccgcatctgacta

SEQ ID NO: 52358 - DNA, 496 bp, Homo sapiens
  misc_feature: GYAE6OF02IEUZX.18.11.A11.1.454.CMB.1.raw
  modified_base (457)..(457): a, c, t, g, unknown or other
  misc_feature (457)..(457): n is a, c, g, or t
  modified_base (465)..(465): a, c, t, g, unknown or other
  misc_feature (465)..(465): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgtttatacagctccaacaataacaactacttagcttggtaccagcagaaaaccaggacagccccctaaggtcctcatttactgggcatctacccgggagtccggggtccctgaccgattcagaggcagcgggtctgggacagatttcactctcaccatcaccaacctgcaggctgaagatgtggcagtttatactgtcagcaatactattagtcctctctcagttcggcgaggaccaggtggagatcaaagactgngctgcacntctgtcttcatccttcccgccatctcgatac

SEQ ID NO: 52359 - DNA, 504 bp, Homo sapiens
  misc_feature: GYAE6OF02ISGB9.18.11.A11.1.454.CMB.1.raw
  modified_base (475)..(475): a, c, t, g, unknown or other
  misc_feature (475)..(475): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcaagaaaccaggacagccccctaaggtcctcatttactggcatctacccgggagtccggggtccctgaccgattcagaggcagcgggtctgggacagtatttcactctcaccatccaccaacctgacaggctgaagatgtgctagtttatactgtcagactaatactatacgtcctctctcacgttcggcggaggaccaggtgagactacaaacgactgtgctgcaccntctgtctcatcttcccgctactctgacta

SEQ ID NO: 52360 - DNA, 512 bp, Homo sapiens
  misc_feature: GYAE6OF02GC84J.18.11.A11.1.454.CMB.1.raw
  modified_base (470)..(470): a, c, t, g, unknown or other
  misc_feature (470)..(470): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgtggctagtttattactgtcagcaaatactatacgtcctcctctcacgttcggcggtagggaccaagggtgagtatacgaaacgactgngctgcaccatctgtctcgatccttcccgctactctagactac

SEQ ID NO: 52361 - DNA, 515 bp, Homo sapiens
  misc_feature: GYAE6OF02GN3GX.18.11.A11.1.454.CMB.1.raw
tcagtacgagtatgcacgaccggtgctcgatttagctacgactgcaggggcagcaagatggtgttgcagacccaggtcttcatttctctgttgactctggatctctggtgccgacggggacatcgtgatgacccagtcgtcccagacctccctggttgtgtctctgggcgagagggccaccatcaactgcaagtccagccagagtgttttatacagctccaacaataacaactacttagcttggtaccagcagaaaccaggacagccccctaaaggtcctcatttactgggcatctacccgggagtccggggtccctgaccgattcagagcagcgggtctgggacagactttcactctcaccatcaccaacctgcaggctgaagatgtgcagttttatactgtcagcaatactatacgtccctctctcacgttcggcggagggactaaggtgagatacaaacgagtcgtaggtctgcaccatacctgtacttcattctcccgcagtctgactacg

SEQ ID NO: 52362 - DNA, 539 bp, Homo sapiens
  misc_feature: GYAE6OF02H9TJ7.18.11.A11.1.454.CMB.1.raw
  modified_base (283)..(283): a, c, t, g, unknown or other
  misc_feature (283)..(283): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttacngggcatcctacccgggagtcccggggtccctgaccgattcagaggcagcgggtctgggacagatttcactctcaccatcaccacctgcaggctgaagatgtggctagtttatactgtcagctaatactatacgttccctctctcacgttcggcgagggaccaggtggagacttacgaaacgtaactggtaggctaggaccaccgtaatcctgttccttactacttcccttcccgccctaattccttagacctaacg

SEQ ID NO: 52363 - DNA, 497 bp, Homo sapiens
  misc_feature: GYAE6OF02JBQ83.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccgggtccctgaccgattcagaggcagcggtctgggacagatttcactctcaccatcaccaacctgcaggctgaagatgtggcagtttatactgtcagcaatactatagtcctctctcacgttcggcggaggaccaaggtgagatcaaacgaactgtagctgcaccatctgtcttcatccttccgccatctgacta

SEQ ID NO: 52364 - DNA, 555 bp, Homo sapiens
  misc_feature: GYAE6OF02H53T5.18.11.A11.1.454.CMB.1.raw
  modified_base (208)..(208): a, c, t, g, unknown or other
  misc_feature (208)..(208): n is a, c, g, or t
  modified_base (521)..(521): a, c, t, g, unknown or other
  misc_feature (521)..(521): n is a, c, g, or t
  modified_base (545)..(545): a, c, t, g, unknown or other
  misc_feature (545)..(545): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttanacagctccaacaataacaactacttagcttggtaccagcagaaaccaggacacgccccctaaggtcccctactatttacgtcgggctatccgtacccggggacggttcccgggggtcccctcggaccgtattccgaggacgcgaggccggtcgtggacagtatttcactctcacatccaccactgcaggctagaagatgtggctagtttatacgtgtacagactaatactattacgtccctcctctacgtacggttccggacggtacggaccgaggtgacgatacgaaacgctgtaggctgccacattccgtntcttactacttcccttccgacctntctacgatac

SEQ ID NO: 52365 - DNA, 502 bp, Homo sapiens
  misc_feature: GYAE6OF02FXLLA.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgtggcagtttatactgtcagcaatactatagtcctctctcacgttcggcggagggaccaaggtgagatacaaacgactgtggctgcacatctgtcttcattcttcccgcctatctgactac

SEQ ID NO: 52366 - DNA, 509 bp, Homo sapiens
  misc_feature: GYAE6OF02JHCQF.18.11.A11.1.454.CMB.1.raw
  modified_base (208)..(208): a, c, t, g, unknown or other
  misc_feature (208)..(208): n is a, c, g, or t
  modified_base (283)..(283): a, c, t, g, unknown or other
  misc_feature (283)..(283): n is a, c, g, or t
  modified_base (470)..(470): a, c, t, g, unknown or other
  misc_feature (470)..(470): n is a, c, g, or t
  modified_base (479)..(479): a, c, t, g, unknown or other
  misc_feature (479)..(479): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttanacagctccaacaataacaactacttagcttggtaccagcagaaaccaggacagccccctaaggtcctcatttacngggcatcgtacccgggagtcccggggtccctgaccgattcagaggcagcgggtctgggacagatttcactctcacatcaccaactgacaggctagaagatgtggactagtttactactgtacagctaatactatacgtcctcctctactacgtcggcggacggacaggtgagatacgaaacgactgngctgcaccntctgtcttcatccttccgctatctagctac

SEQ ID NO: 52367 - DNA, 514 bp, Homo sapiens
  misc_feature: GYAE6OF02GYSQP.18.11.A11.1.454.CMB.1.raw
  modified_base (485)..(485): a, c, t, g, unknown or other
  misc_feature (485)..(485): n is a, c, g, or t
  modified_base (495)..(495): a, c, t, g, unknown or other
  misc_feature (495)..(495): n is a, c, g, or t
  modified_base (502)..(502): a, c, t, g, unknown or other
  misc_feature (502)..(502): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcattactgggcatcgtacccgggagtcccggggtccctgaccgattcagaggcaggcgggtctgggacagatttcactctcaccatcaccaacctgcaggctagaagatgtggctagtttatactgtcagcaatactatacgtcctcctctcctacgttccggcggaacgggaccaagggtgagatacaaacgtactgtgctgcaccgtntctgtcttcntcctccnctatctgactac

SEQ ID NO: 52368 - DNA, 498 bp, Homo sapiens
  misc_feature: GYAE6OF02GCRRK.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgtgctagtttatactgtcagcaatactatagtcctctctcacgttcggcgaggaccaggtgagactacaaacgactgtgctgcaccatctgtcttcattctccgcctatctgactac

SEQ ID NO: 52369 - DNA, 532 bp, Homo sapiens
  misc_feature: GYAE6OF02H4214.18.11.A11.1.454.CMB.1.raw
  modified_base (383)..(383): a, c, t, g, unknown or other
  misc_feature (383)..(383): n is a, c, g, or t
  modified_base (485)..(485): a, c, t, g, unknown or other
  misc_feature (485)..(485): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcaagaaaccaggacagccccctaaggtcctcatttactgggcatcctacccgggagtccggggtccctgaccgattcagaggcaggcgggtctgggacagatttcactctcaccatcaccaacctgcaggctgaagntgtggctagttttatactgtcagcaatactatacgtcctctctcacgttcggcggagggaccagggtggagactacgaaacgactggtgctgacctaccgtntccttgtcctttacacttcccttaccccgctacttctacgactaccg

SEQ ID NO: 52370 - DNA, 510 bp, Homo sapiens
  misc_feature: GYAE6OF02IXLHW.18.11.A11.1.454.CMB.1.raw
  modified_base (206)..(206): a, c, t, g, unknown or other
  misc_feature (206)..(206): n is a, c, g, or t
  modified_base (392)..(392): a, c, t, g, unknown or other
  misc_feature (392)..(392): n is a, c, g, or t
tcagtacgagtatgcacgaccggtgctcgatttagctacgactgcaggggcagcaagatggtgttgcagacccaggtcttcatttctctgttgctctggatctctggtgccgacgggacatcgtgatgacccagtctccagactccctggttgtgtctctgggcgagagggccaccatcaactgcaagtccagccagagtgtttanacagctccaacaataacaactacttagcttggtaccagcagaaaccaggacagcccctaaggtcctcatttactgggcatctacccgggagtccggggtccctgaccgattcagaggcagcgggtctgggacagatttcactctcacatcaccaactgcaggctgaagatgtggctagtttatacngtcagcaatactatagtcctctctcacgttcggcggaaggaccaaggtgaagactcaaaacgactgtgctgccaccgaatctgtccttacacttccgttcccgctactctcgaactac

SEQ ID NO: 52371 - DNA, 715 bp, Homo sapiens
  misc_feature: GYAE6OF02IO9EB.18.11.A11.1.454.CMB.1.raw
  modified_base (145)..(145): a, c, t, g, unknown or other
  misc_feature (145)..(145): n is a, c, g, or t
  modified_base (311)..(311): a, c, t, g, unknown or other
  misc_feature (311)..(311): n is a, c, g, or t
tcagtacgagtatgcacgaccggtgctcgatttagctacgactgctaggggtcggagcaagatggtgttgcacgacccaggtcttcatttctcgtgttgctcgtccggatctctggtcgccggacgggacatcgtgatgacccgngtcctccagacctcctggttgtgtctctggcgagagggcccacatcaactcgcctaagtccagccagagttgtttagacagctaccaacaaataacaacttacgttacggcttaggtaccaggactaagaaaccaggtacacgccccctaaggtcctacatttacngggcataccgtaacccgggtagtcccgggtacctcgaccctattcagtagcgagcggtctggacctagtacgttcaactccgtacgacctataccgaaccgtaactggacgacggtcgtagaagtggtagtcggactttaagtttacttaccgtcgttaaccgagtacctaaagtacctaagttaccgtacccgttaccttccgtaccgtacgttaccggggacggtaacgggacccgttaaagggtggtaaactcttaacggaaaacccgttaagttaccgggttagtacccgttacgacccgtaaccgttaccttacccgtaccgggtttaacccaccggttaaccgttaccccgtttaccccggacttaaaccgtttacccggttaacgtacgttaacccg

SEQ ID NO: 52372 - DNA, 504 bp, Homo sapiens
  misc_feature: GYAE6OF02GR7IB.18.11.A11.1.454.CMB.1.raw
  modified_base (284)..(284): a, c, t, g, unknown or other
  misc_feature (284)..(284): n is a, c, g, or t
  modified_base (475)..(475): a, c, t, g, unknown or other
  misc_feature (475)..(475): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaaggtcctcatttacngggcatctacccgggagtccgggtccctgaccgattcagaggcagcgggtctggggacaggatttcactctcaccatcaccaacctgcaggctgaagatgtggctagtttatactgtcagcaatactatacgtcctctctcacgttcggcggaggaccaagggtggagatacaaacgactgtgctgcaccntctgtctcatccttccgccatctgactac

SEQ ID NO: 52373 - DNA, 576 bp, Homo sapiens
  misc_feature: GYAE6OF02GIFHR.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatccaccaacctgcaggctagaagatgtggctagtttattactgtcacgcaatactatacgtccttcctctactacggttcggcgggacggaccaagggtgaagtactacgaaaaccggtaacgttggtacggccgttcgaccctaacccgtattacccgttaggttccctttacgaaccgtttccctttccccggacctactccgttacgacttaacg

SEQ ID NO: 52374 - DNA, 507 bp, Homo sapiens
  misc_feature: GYAE6OF02FM3JO.18.11.A11.1.454.CMB.1.raw
  modified_base (354)..(354): a, c, t, g, unknown or other
  misc_feature (354)..(354): n is a, c, g, or t
  modified_base (462)..(462): a, c, t, g, unknown or other
  misc_feature (462)..(462): n is a, c, g, or t
  modified_base (473)..(473): a, c, t, g, unknown or other
  misc_feature (473)..(473): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcaggcgggtctgggacagatttcactcncacatcaccacctgcaggctgaagatgtggctagtttatactgtcagcaatactattacgtcctctctcacgttcggcggaggaccaggtgagatacgaaacgactgngctgacacctntctgtcttcatccttcccgacctatcctgactac

SEQ ID NO: 52375 - DNA, 496 bp, Homo sapiens
  misc_feature: GYAE6OF02JH6YA.18.11.A11.1.454.CMB.1.raw
  modified_base (378)..(378): a, c, t, g, unknown or other
  misc_feature (378)..(378): n is a, c, g, or t
  modified_base (446)..(446): a, c, t, g, unknown or other
  misc_feature (446)..(446): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgtttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccacctgcaggctgaagntgtggcagtttatactgtcagcaatactatagtcctcctctcacgttcggcggagggaccaaggtganatcaaacgactgtgctgcacatctgtcttcatcttcccgcatctgactac

SEQ ID NO: 52376 - DNA, 556 bp, Homo sapiens
  misc_feature: GYAE6OF02GHAMS.18.11.A11.1.454.CMB.1.raw
  modified_base (208)..(208): a, c, t, g, unknown or other
  misc_feature (208)..(208): n is a, c, g, or t
  modified_base (284)..(284): a, c, t, g, unknown or other
  misc_feature (284)..(284): n is a, c, g, or t
  modified_base (385)..(385): a, c, t, g, unknown or other
  misc_feature (385)..(385): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttanacagctaccaacaataacaactacttagcttggtaccagcagaaaccaggacagccccctaaggtcctcatttacnggcatcgtacccgggagtcccggggtccctggaccgattcaggacggcaggcgggtctgggacagtatttcactctcaccatcaccaactgcaggctgaantgtggctagtttatactgtcagactaatactatcgtccttcctctcgtacgttcggacggtacggacctagggtgacgtactacgaaacgtacgtggtacgctgaccaccgtattccgttcgtacctttcacgttcccgttcccgacctacgttcccgtacgaccttaacg

SEQ ID NO: 52377 - DNA, 505 bp, Homo sapiens
  misc_feature: GYAE6OF02GUWHF.18.11.A11.1.454.CMB.1.raw
  modified_base (380)..(380): a, c, t, g, unknown or other
  misc_feature (380)..(380): n is a, c, g, or t
  modified_base (430)..(430): a, c, t, g, unknown or other
  misc_feature (430)..(430): n is a, c, g, or t
  modified_base (472)..(472): a, c, t, g, unknown or other
  misc_feature (472)..(472): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagntgtggctagtttatactgtcagcaatactatagtcctctctcacgttcgnggacggacaggtgagatacgaaacgactgtagctcgcaccgntcctgtcttcatcttcccgctactctgactacg

SEQ ID NO: 52378 - DNA, 498 bp, Homo sapiens
  misc_feature: GYAE6OF02IPUGW.18.11.A11.1.454.CMB.1.raw
  modified_base (402)..(402): a, c, t, g, unknown or other
  misc_feature (402)..(402): n is a, c, g, or t
  modified_base (460)..(460): a, c, t, g, unknown or other
  misc_feature (460)..(460): n is a, c, g, or t
  modified_base (470)..(470): a, c, t, g, unknown or other
  misc_feature (470)..(470): n is a, c, g, or t
tcagtacgagtatgcacgaccggtgctcgatttagctacgactgcagggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaaccaggacacgacccccctaaggtcctacatttactggcatcgtacccgggagtccgggtcctgaccgatcagagcagcggtctgggacagatttcactctcaccatcacaacctgcagctagaagatgtgctagtttatactgtcagnaactataatagtcctctctctacgtcggcgaggaccgaggtgagatacaaacgactgngctgcaccgntctgtctcatcctccgcatctagactac

SEQ ID NO: 52379 - DNA, 557 bp, Homo sapiens
  misc_feature: GYAE6OF02JDPQ8.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccggggagtccggggtccctggaccgattcagaggcagcgggtctgggacagatttcactctcaccatcaccacctgcaggctgaagtgtggcgacttagttactcgtgtacactataactactagtcctcctctctcgtaccggtcggacggacgacgtaggtacgagtacgaacgaacgtacgtggtcgtcgtacgaccacgtcttcgttcgttaccttacgtccttccccgtaccctacctacttcgtacgtacttaaccg

SEQ ID NO: 52380 - DNA, 514 bp, Homo sapiens
  misc_feature: GYAE6OF02H4JT2.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtgtcgacggggacatcgtgatgacccagtctccagactccctggttgtgtctctgggcgagagggccaccatcaactgcaagtccagccagagtgttttatacagctccaacaataacaactacttagcttggtaccagcaagaaaccaggacagccccctaaggtcctcatttactgggcatctacccgggagtcccggggtccctgaccgattcagaggcagcgggtctgggacagatttcactctcaccatcaccaacctgcaggctgaagatgtggctagttttatactgtcagcaatactatacgtcctctctcacgttcggcggacggaccagggtgagactacgaaacgaactgtcgctgcaccatctgtcttcattccttcccgctatctacgactaac

SEQ ID NO: 52381 - DNA, 529 bp, Homo sapiens
  misc_feature: GYAE6OF02GCLCH.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtgccgactgggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtccctcatttactgggcatctacccgggagtccggggtccctgaccgattcagaggcagcgggtctgggacagattcactctcaccatcaccaactgcaggctgagatgtggctagtttatactgtcagcaatactatacgtcctcctctcacggttcggacggacgggaccaagggtggaagtactacgaaacgtactgtcggctggaccacctattctgttcttcgtacttccttccccgactacttcctgtaacc

SEQ ID NO: 52382 - DNA, 516 bp, Homo sapiens
  misc_feature: GYAE6OF02IB3XG.18.11.A11.1.454.CMB.1.raw
  modified_base (384)..(384): a, c, t, g, unknown or other
  misc_feature (384)..(384): n is a, c, g, or t
  modified_base (402)..(402): a, c, t, g, unknown or other
  misc_feature (402)..(402): n is a, c, g, or t
  modified_base (472)..(472): a, c, t, g, unknown or other
  misc_feature (472)..(472): n is a, c, g, or t
  modified_base (507)..(507): a, c, t, g, unknown or other
  misc_feature (507)..(507): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcaagaaaccaggacagccccctaaggtcctcatttactgggcatcctacccggggagtcccggggtccctggaccgattcagaggcagcgggtctgggacagatttcactctcaccatcaccaacctgcaggccaagntgtggctagtttattacngtcagcaatactatagtccttcctctccacgttcggcggtaggaccaagggtggagatacaaacgactgnggctgcaccatctgtcttcatccttcccgcattcngaccatacg

SEQ ID NO: 52383 - DNA, 503 bp, Homo sapiens
  misc_feature: GYAE6OF02GB49W.18.11.A11.1.454.CMB.1.raw
  modified_base (472)..(472): a, c, t, g, unknown or other
  misc_feature (472)..(472): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtcctgaccgattcagaggcagcgggtctgggacagatttcactctcaccatcaccaacctgcaggctgaagatgtggctagtttattactgtcagcaatactatagtcctctctcacgttcggcggaggaccaaggtgagatcgaaacgactgtcgctgcaccgntctgtcttcattccttccgcactctgactac

SEQ ID NO: 52384 - DNA, 628 bp, Homo sapiens
  misc_feature: GYAE6OF02JXIBN.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagttgttttatacagctccaacaataacaactacttagcttggtaccagcaagaaaccaggacacgccccctaaggtcctactattacgtgggcactcgtacccgggagtcccggggtcctgaccgatcgagacggcaggcgggtctgggacagtactttcactctacaccatccgaccacctgaccaggcctaggaagtgtggtacgtactttaagttacgtacgtcgtacgacgtaactaactacttagttccgtccttacctccgtacgtccgggtcgggacgggtacggaacggtggaggaacgtacctaacgaaacgtcggtacggtacgtcgtacgaccgtaccttcgttaccgttcgttaccgttaccttacccgtttccccgtaacccgtccgtttacctaccgttacgtacccgttaaccg

SEQ ID NO: 52385 - DNA, 513 bp, Homo sapiens
  misc_feature: GYAE6OF02G2U63.18.11.A11.1.454.CMB.1.raw
  modified_base (380)..(380): a, c, t, g, unknown or other
  misc_feature (380)..(380): n is a, c, g, or t
  modified_base (480)..(480): a, c, t, g, unknown or other
  misc_feature (480)..(480): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctcaagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagntgtggctagttttatactgtcagcaatactatacgtccctcctctcacggtttcggcggagggaccaagggtggagatacgaaacgactgtgctgcaccntctgtcttcattccttcccgccatctcgactac

SEQ ID NO: 52386 - DNA, 543 bp, Homo sapiens
  misc_feature: GYAE6OF02HE5N4.18.11.A11.1.454.CMB.1.raw
  modified_base (214)..(214): a, c, t, g, unknown or other
  misc_feature (214)..(214): n is a, c, g, or t
  modified_base (388)..(388): a, c, t, g, unknown or other
  misc_feature (388)..(388): n is a, c, g, or t
  modified_base (393)..(393): a, c, t, g, unknown or other
  misc_feature (393)..(393): n is a, c, g, or t
tcagtacgagtatgcacgaccggtgctcgatttagctacgactgcaggggcagacgaagatggtgttgccagacccaggtcttcatttctctgttgctctcggatctctggtgcccgacggggacatcgtgatgacccagtctccagactccctggttgtgtctctgggcgagagggccaccatcaactcgcaagtcccagccagagtgtttanacagctccaacaataacaactacttagcttggaccagcagaaaccaggacagccccctaaggtcctcatttactgggcatctacccgggagtacccggggtccctgaccgacttacagaggcagcgggtctgggacagactttcactctcgaccatccacctaacctgcaggcngaagntgtgctagtttactactgtcagcaatactatgtccctctctcacgttcggcgagggacctaaggtggagatacaaacgactgtggactcgccaccgtatccgtgttccgtacgtaacgttccgtttacccgcctattccgtagactaacg

SEQ ID NO: 52387 - DNA, 615 bp, Homo sapiens
  misc_feature: GYAE6OF02GGH24.18.11.A11.1.454.CMB.1.raw
  modified_base (172)..(172): a, c, t, g, unknown or other
  misc_feature (172)..(172): n is a, c, g, or t
  modified_base (227)..(227): a, c, t, g, unknown or other
  misc_feature (227)..(227): n is a, c, g, or t
  modified_base (232)..(232): a, c, t, g, unknown or other
  misc_feature (232)..(232): n is a, c, g, or t
  modified_base (235)..(235): a, c, t, g, unknown or other
  misc_feature (235)..(235): n is a, c, g, or t
  modified_base (243)..(243): a, c, t, g, unknown or other
  misc_feature (243)..(243): n is a, c, g, or t
  modified_base (265)..(266): a, c, t, g, unknown or other
  misc_feature (265)..(266): n is a, c, g, or t
  modified_base (274)..(274): a, c, t, g, unknown or other
  misc_feature (274)..(274): n is a, c, g, or t
  modified_base (299)..(299): a, c, t, g, unknown or other
  misc_feature (299)..(299): n is a, c, g, or t
tcagtacgagtatgcacgaccggtgctcgatttagctacgactgcaagggggacggagcgaagactggtgttgcaagacccgaggtctttcatttcgtctgttgctctggatactctggtggccgacggggacatcggtgtagtgaccagtctccgtacgtactcctggttnttagtcgtctcggcgtagacgggccaccatcaactggcaagtccaggccagagtntttanacngctccaanaataacactacttagctgaccnncagaaccngacagacccctagtcctatattacnggcataccgtacccggggacgtccgggtacctgaccgagtccagggacgtcgaggcgggttctagggactagtatttacacttctacaactagtacaaccaactgacaggtctagaagtatcggtaggactagtttactactgtacagactaaagtactaagttacgtaccttacctctactacggtttcggacggaacggaaccaagggtacgaagtactacgaaaaccgtatggtacgggactacgaccaccgtgttccttagttccttacgtacgttacccgttacccgacctagtaccgtagaccttaacgg

SEQ ID NO: 52388 - DNA, 536 bp, Homo sapiens
  misc_feature: GYAE6OF02IHW4Z.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactggcatcgtacccgggagtccggggtccctgaccgattcagaggcaggcggtcgtgggacagtatttcactctcaccatcaccaacctgcaggctagaagatgtgactagtttatactgtacagctaatactatacgtcctctctcacgttcggcggacggaccaaggtggaagtatacgaaacgactgtagctacgaccacctaactctcgttcttctacttccttaccccgcctacgttcctcgtactaacg

SEQ ID NO: 52389 - DNA, 511 bp, Homo sapiens
  misc_feature: GYAE6OF02FTCGX.18.11.A11.1.454.CMB.1.raw
  modified_base (380)..(380): a, c, t, g, unknown or other
  misc_feature (380)..(380): n is a, c, g, or t
  modified_base (475)..(475): a, c, t, g, unknown or other
  misc_feature (475)..(475): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagntgtggctagtttattactgtcagacaatactatagtcctcctctctacgttcggcggaggaccaagggtgagatcaaacgactgcgctgcacctntcttcgtcttcatccttccgcctatccgtgactacg

SEQ ID NO: 52390 - DNA, 518 bp, Homo sapiens
  misc_feature: GYAE6OF02I2TUK.18.11.A11.1.454.CMB.1.raw
  modified_base (379)..(379): a, c, t, g, unknown or other
  misc_feature (379)..(379): n is a, c, g, or t
  modified_base (382)..(382): a, c, t, g, unknown or other
  misc_feature (382)..(382): n is a, c, g, or t
  modified_base (447)..(447): a, c, t, g, unknown or other
  misc_feature (447)..(447): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacacgccccctaaggtcctcatttactggcatcctacccgggagtccggggtccctgaccgattcgagaggcagcgggtctgggacagatttcactctcacatcaccaactgcagctgaagntgngctagtttatactgtcagcaatactatacgtccctctctctacgtcggcgagggaccaggtgganacgtacaaacgacgtgtcgctcgcaccattcctgtccttacacttccttcccgacctatccagtactaacg

SEQ ID NO: 52391 - DNA, 517 bp, Homo sapiens
  misc_feature: GYAE6OF02HMZV4.18.11.A11.1.454.CMB.1.raw
  modified_base (199)..(199): a, c, t, g, unknown or other
  misc_feature (199)..(199): n is a, c, g, or t
  modified_base (277)..(277): a, c, t, g, unknown or other
  misc_feature (277)..(277): n is a, c, g, or t
  modified_base (284)..(284): a, c, t, g, unknown or other
  misc_feature (284)..(284): n is a, c, g, or t
  modified_base (397)..(397): a, c, t, g, unknown or other
  misc_feature (397)..(397): n is a, c, g, or t
  modified_base (451)..(451): a, c, t, g, unknown or other
  misc_feature (451)..(451): n is a, c, g, or t
  modified_base (478)..(478): a, c, t, g, unknown or other
  misc_feature (478)..(478): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagngtgttttatacagctccaaacaataacaactacttagcttggtaccagcagaaaccaggacagccccctaaggtcctnatttacngggcatcctacccgggagtcccggggtccctgaccgattcagaggcagcgggtctgggacagatttcactctcaccatcaccaacctgcaggctagaagatgtggcagttttntactgtcagcaatactatagtcctcttctcacgttcggcggagggaccaagggngagatcgaaacgactgtagctgcaccntcctgtcttcacttccttcccgcctagtcctagacctac

SEQ ID NO: 52392 - DNA, 501 bp, Homo sapiens
  misc_feature: GYAE6OF02HAKL5.18.11.A11.1.454.CMB.1.raw
  modified_base (470)..(470): a, c, t, g, unknown or other
  misc_feature (470)..(470): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgtggctagtttatactgtcagcaatactatagtcctctctcacgttcggcggagggaccaggtgagatacaaacgactgtgctgcaccntctgtcttcatccttcccgccatctgactac

SEQ ID NO: 52393 - DNA, 511 bp, Homo sapiens
  misc_feature: GYAE6OF02GZPCN.18.11.A11.1.454.CMB.1.raw
  modified_base (365)..(365): a, c, t, g, unknown or other
  misc_feature (365)..(365): n is a, c, g, or t
  modified_base (375)..(375): a, c, t, g, unknown or other
  misc_feature (375)..(375): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcggtctgggacagatttcactctcacatcaccactncagctagagntgtgctagtttatactgtcagacaatactatcgtcctctctctcgtcggcggacggaccgaggtgagactacgaaacgtatgtgctgaccacgtctctgtccttacacttcccgtcccgcctactctacgactacg

SEQ ID NO: 52394 - DNA, 506 bp, Homo sapiens
  misc_feature: GYAE6OF02JG6EH.18.11.A11.1.454.CMB.1.raw
  modified_base (375)..(375): a, c, t, g, unknown or other
  misc_feature (375)..(375): n is a, c, g, or t
  modified_base (423)..(423): a, c, t, g, unknown or other
  misc_feature (423)..(423): n is a, c, g, or t
  modified_base (501)..(501): a, c, t, g, unknown or other
  misc_feature (501)..(501): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgtttatacagctccaaacaataacaactacttagcttggtaccagcagaaaccaggacacgcccctaaggtcctcatttactgggcatctaccgggagtccgggtcctgaccgatcagaggcagcgggtctgggacagacttcactctcacatcaccaactgcaggctgaacgntgtggctagtttatactgtacagtacaatactatacgtcctcctctcnccgttcggcggacggaccaaggtgagtatacaaacgatgacgctagccactatctgtcttcatccttccgccatctanactac

SEQ ID NO: 52395 - DNA, 500 bp, Homo sapiens
  misc_feature: GYAE6OF02IZ34N.18.11.A11.1.454.CMB.1.raw
  modified_base (284)..(284): a, c, t, g, unknown or other
  misc_feature (284)..(284): n is a, c, g, or t
  modified_base (378)..(378): a, c, t, g, unknown or other
  misc_feature (378)..(378): n is a, c, g, or t
  modified_base (471)..(471): a, c, t, g, unknown or other
  misc_feature (471)..(471): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacacgccccctaaggtcctcatttacngggcatctacccgggagtccggggtccctgaccgattcagaggcagcgggtctgggacagatttcactctcacatcaccaactgcagctgaagntgtggctagtttattactgtcagcaatactatacgtcctctctcacgttcggcggaggaccaagggtgagatacaaacgactgtgctgcaccntctgtctcatccttccgcatctagactac

SEQ ID NO: 52396 - DNA, 502 bp, Homo sapiens
  misc_feature: GYAE6OF02GGDSW.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgtggcagtttattactgtcagcaatactatagtcctcctctcacgttcggcgagggaccaagggtgagatcaaacgactgtggctgcaccatcctgtcttcatcttcccgcatctgactac

SEQ ID NO: 52397 - DNA, 678 bp, Homo sapiens
  misc_feature: GYAE6OF02H0KNR.18.11.A11.1.454.CMB.1.raw
tcagtacgagtatgcacgaccggtgctcgatttagctacgactgcaggggacgaggcaagatggtgttagcaggacccaggtcttcatttctctgttgctctggatcctcctggtgccgacggggacatcgtggatgacccagtcctccagactccctggttgtgtctcgtcgggcgaggagggccaccatcaactgcaagtccagccagagttgtttatacagctacaacaataaacaactacttaagcttaggtaccagtacaagaaaccaaggacaacgaccccctaaggtccctacactttactgggactatccgtacccgggagttaccggggtccctgaccgattcgagaggcagcgggtctgggacagtattcatctcacgatcaccaacgtgcaggctagaagtactgtacgctaaggttttatacgttgacagactaacgttacgtagtaacgttcccttacttaccttacgaccggtttacgggaccgggtaaggggtaacccgaaagggttcgggaaggtacgttaaccgaaaaccggtacgttacgggtttcggggactacgggacccgtaaacccgtacgttccggttacgttccctttaaccgacgttttaccccgttcccccggaccgttaacccgttccgttacccggaacccttaacccgg

SEQ ID NO: 52398 - DNA, 509 bp, Homo sapiens
  misc_feature: GYAE6OF02GL5VA.18.11.A11.1.454.CMB.1.raw
  modified_base (476)..(476): a, c, t, g, unknown or other
  misc_feature (476)..(476): n is a, c, g, or t
  modified_base (497)..(497): a, c, t, g, unknown or other
  misc_feature (497)..(497): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcaagaaaccaggacacgccccctaaggtcctcatttactggcatctacccgggagtccgggtccctgaccgattcagaggcaggcgggtctgggacagtatttcactctcaccatccaccaacctgcaggctagaagatgtggctagttttatactgtcagacaatactatacgtcctcctctcacgttcggcggaggaccaggtgagatacaaacgtatgtgctgcacntctgtcttctatccgttcccnctatctgactac

SEQ ID NO: 52399 - DNA, 506 bp, Homo sapiens
  misc_feature: GYAE6OF02JG1J2.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctagaagatgtggctagttttatactgtcagcaatactatacgtcctctctcacgttcggcggagggaccaggggtcgacatcgaagcgaatgtggctgcacatctgtcttcattccttcccgctactctgac

SEQ ID NO: 52400 - DNA, 500 bp, Homo sapiens
  misc_feature: GYAE6OF02FFSZ2.18.11.A11.1.454.CMB.1.raw
  modified_base (376)..(376): a, c, t, g, unknown or other
  misc_feature (376)..(376): n is a, c, g, or t
  modified_base (488)..(488): a, c, t, g, unknown or other
  misc_feature (488)..(488): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttatcttggtaccagcagaaaccaggacagccccctaaggtcctcatttactgggcatctaccgggatccggggtccctgaccgattcagaggcagcggtctgggacagatttcactctcaccatcaccaactgcaggctgaagntgtgcagttatactgcagcaatactatagcctctctcacgttcggcggaggaccaagggtgaagatacgaaacgaactgtacggctgcaccgatctgtcttcattcctcccnctatctgactac

SEQ ID NO: 52401 - DNA, 515 bp, Homo sapiens
  misc_feature: GYAE6OF02F9CQL.18.11.A11.1.454.CMB.1.raw
  modified_base (379)..(379): a, c, t, g, unknown or other
  misc_feature (379)..(379): n is a, c, g, or t
tcagtacgagtatgcacgaccggtgctcgatttagctacgactgcaggggcagcaagatggtgttgcagacccaggtcttcatttctctgttgctctggatctctggtgccggcggggacatcgtgatgacccagtctccagactccctggttgtgtctctgggcgagagggccaccatcaactgcaagtccagccagagtgtttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagntgtggctagtttattactgtcagcaatactatacgtcctcctcttcacggttcggcggacggaccaagggtgaagatacaaacgactgtgctgcaccatcctgtccttcacttccttcccgcctatctagactacg

SEQ ID NO: 52402 - DNA, 497 bp, Homo sapiens
  misc_feature: GYAE6OF02GK5UU.18.11.A11.1.454.CMB.1.raw
  modified_base (208)..(208): a, c, t, g, unknown or other
  misc_feature (208)..(208): n is a, c, g, or t
  modified_base (462)..(462): a, c, t, g, unknown or other
  misc_feature (462)..(462): n is a, c, g, or t
  modified_base (470)..(470): a, c, t, g, unknown or other
  misc_feature (470)..(470): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttanacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgtcaggctgaagatgtgcagttttatactgtcagcaatactatacgtcctctctctacgttcggcgaggaccaaggtgagatcgaaacgactgngctgcacntctgtctcatctcccgcatctgactac

SEQ ID NO: 52403 - DNA, 507 bp, Homo sapiens
  misc_feature: GYAE6OF02HG25M.18.11.A11.1.454.CMB.1.raw
  modified_base (478)..(478): a, c, t, g, unknown or other
  misc_feature (478)..(478): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacacgcccctaaggtcctcatttactgggcatctacccgggagtccggggtccctgaccgattcagaggcagcgggtctgggacagatttcactctcaccatccaccaactgcaggctagaagatgtggctagtttatactgtcagcaaatactattacgtccctcctctcgtacgttcggcggagggaccaaggtgagataccaaagactgtgctgcacntctgtctcattcctccgcctatctgactc

SEQ ID NO: 52404 - DNA, 510 bp, Homo sapiens
  misc_feature: GYAE6OF02HPDHK.18.11.A11.1.454.CMB.1.raw
  modified_base (284)..(284): a, c, t, g, unknown or other
  misc_feature (284)..(284): n is a, c, g, or t
  modified_base (381)..(381): a, c, t, g, unknown or other
  misc_feature (381)..(381): n is a, c, g, or t
  modified_base (466)..(466): a, c, t, g, unknown or other
  misc_feature (466)..(466): n is a, c, g, or t
  modified_base (483)..(483): a, c, t, g, unknown or other
  misc_feature (483)..(483): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaaacaataacaactacttagcttggtaccagcagaaaccaggacagccccctaaggtcctcatttacngggcatctacccgggagtcccggggtccctgaccgattcagagcaggcgggtctgggaaatatttcactctcaccatccacaacctgcagctgaagntgtgctagtttatactgtcagcaatactatacgtcctcctctcacgttcggcggagggaccaagggtgagatacgaaacgactgngctgccacatctgtctnacttcctcccgctatctagactatacg

SEQ ID NO: 52405 - DNA, 506 bp, Homo sapiens
  misc_feature: GYAE6OF02G4YMO.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtcccggggtccctgaccgattcagaggcagcgggtctgggacagatttcactctcaccatcaccaactgcaggctgaagatgtggctagttttatactgtcagcaatactatacgtcctcctctctacgttcggcggagggaccaagggtgagatacaaacgactgtgctgcacatctgtcttcatccttcccgctatctgactac

SEQ ID NO: 52406 - DNA, 489 bp, Homo sapiens
  misc_feature: GYAE6OF02F6SNM.18.11.A11.1.454.CMB.1.raw
  modified_base (454)..(454): a, c, t, g, unknown or other
  misc_feature (454)..(454): n is a, c, g, or t
  modified_base (462)..(462): a, c, t, g, unknown or other
  misc_feature (462)..(462): n is a, c, g, or t
  modified_base (483)..(483): a, c, t, g, unknown or other
  misc_feature (483)..(483): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctaccaacaataacaactacttagcttggtaccagcagaaaccaggacagccccctaaggtcctcatttactgggcatctacccgggagtccgggtcctgaccgattcagagcagcgggtctgggacagatttcactctcaccatcaccaactgcaggctgaagatgtgctagtttatactgtcagacaatactatacgtcctctctcacgtcggcgaggaccaggtgagatacaacgatgngctgcacntctgtctcatcctccgcatcngactac

SEQ ID NO: 52407 - DNA, 505 bp, Homo sapiens
  misc_feature: GYAE6OF02IB1EC.18.11.A11.1.454.CMB.1.raw
  modified_base (314)..(314): a, c, t, g, unknown or other
  misc_feature (314)..(314): n is a, c, g, or t
  modified_base (369)..(369): a, c, t, g, unknown or other
  misc_feature (369)..(369): n is a, c, g, or t
  modified_base (450)..(450): a, c, t, g, unknown or other
  misc_feature (450)..(450): n is a, c, g, or t
  modified_base (472)..(472): a, c, t, g, unknown or other
  misc_feature (472)..(472): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaaacaaataaacaactacttagcttggtaccagcagaaaccaggacagcccctaaggtcctcatttactgggcatctacccgggagtccggggtcccngaccgattcagaggcagcgggtctgggacagatttcactctcacatcaccaactncaggctgaagatgtggctagtttatactgtcagcaatactaatagtcctctctcacgttcggcggaggaccgaagtggganatacaaacgactgtgctgcacntctgtccttcatccttccgctatctcgactaac

SEQ ID NO: 52408 - DNA, 585 bp, Homo sapiens
  misc_feature: GYAE6OF02G531R.18.11.A11.1.454.CMB.1.raw
  modified_base (385)..(385): a, c, t, g, unknown or other
  misc_feature (385)..(385): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatccgtacccgggagtcccggggtccctgaccgattccagaggcaggcgggtctgggacagtatttcactctcaccatcaccaactgcaggctgaagntgtgctagtttatctgtcagcaatactatacgtccctcctctctacggttccggacggacgggaaccgaagggtcggaagtacgttaaccgaaaacggtacttaggtcggtacttacgacctaacccgtagttccgttacggttaccttaccgtactttcccgtttccccggaccttaacttccgtagtaacccttaacg

SEQ ID NO: 52409 - DNA, 507 bp, Homo sapiens
  misc_feature: GYAE6OF02FGZE1.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgtggctagtttattactgtcagcaatactatacgtcctctctcacgttcggcggaggaccaaggtgagatacgaaacgactgtggctgcactatctgtcttcattccttcccgccatctagactac

SEQ ID NO: 52410 - DNA, 526 bp, Homo sapiens
  misc_feature: GYAE6OF02HJDEF.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaactgcaggctgaagatgtggcagtttatactgtcagcaatactatacgtcctcctctcacgttcggcgagggaccaaggtggagatacgaaacgactgtggcctagaccaccattccgtgtcctttcacgttccttccccggacctatccgtagacctaacg

SEQ ID NO: 52411 - DNA, 506 bp, Homo sapiens
  misc_feature: GYAE6OF02HJJNZ.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattccagaggcagcgggtctgggacagatttcactctcaccatcaccaacctgcagctgaagatgtggctagtttatactgtcagcaatactatacgtcctcctctcacgttcggcggagggaccaaggtgagatacgaaacgactgtgctgcaccatctgtcttcatccttccgcctatctagactac

SEQ ID NO: 52412 - DNA, 550 bp, Homo sapiens
  misc_feature: GYAE6OF02G8MTV.18.11.A11.1.454.CMB.1.raw
  modified_base (386)..(386): a, c, t, g, unknown or other
  misc_feature (386)..(386): n is a, c, g, or t
  modified_base (408)..(408): a, c, t, g, unknown or other
  misc_feature (408)..(408): n is a, c, g, or t
  modified_base (491)..(491): a, c, t, g, unknown or other
  misc_feature (491)..(491): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgtttatacagctccaacaataacaactacttagcttggtaccagcagaaaccaggacacgaccccctaaggtcctctatttactgggcatccgtacccgggagtcccggggtccctggaccgattcaggaggcagtcgggtctgggacagatttcactctcaccatcaccaactgcagctgaagngtgtgactagtttatactgtangactaatactagtctcctctctacgtacgtcggcgaggaccaaggtgagactacgaaacgtacgtgtaggctagccgtacctntacctgttaccttactaaccgttccgttaccccggacctacttccgtacgtacctaacg

SEQ ID NO: 52413 - DNA, 512 bp, Homo sapiens
  misc_feature: GYAE6OF02I5HY3.18.11.A11.1.454.CMB.1.raw
  modified_base (207)..(207): a, c, t, g, unknown or other
  misc_feature (207)..(207): n is a, c, g, or t
  modified_base (355)..(355): a, c, t, g, unknown or other
  misc_feature (355)..(355): n is a, c, g, or t
  modified_base (380)..(380): a, c, t, g, unknown or other
  misc_feature (380)..(380): n is a, c, g, or t
  modified_base (383)..(383): a, c, t, g, unknown or other
  misc_feature (383)..(383): n is a, c, g, or t
  modified_base (422)..(422): a, c, t, g, unknown or other
  misc_feature (422)..(422): n is a, c, g, or t
  modified_base (451)..(451): a, c, t, g, unknown or other
  misc_feature (451)..(451): n is a, c, g, or t
  modified_base (475)..(475): a, c, t, g, unknown or other
  misc_feature (475)..(475): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgtttanacagctccaacaataacaactactagcttggtaccagcagaaaccaggacagccccctaaggtcctcatttactgggcatcctaaccgggagtccggggtcctgaccgattccgagaggcaggcgggtctgggacaggatttcactcncaccatcaccaactgcagctgaagntgnggacagtttatctgtcagtcaatactatagtccctcctntcacgttcggcgaggacaagggtagaganacgaaacgactgtgctagcaaccntctgtctcgatcccttcccgctactctacgactaacg

SEQ ID NO: 52414 - DNA, 536 bp, Homo sapiens
  misc_feature: GYAE6OF02FW8QU.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcaggcgggtctgggacagatttcactctcaccatcaccaactgcaggctagaagatgtggctagtttatactgtcagcaatactatacgtccttcctctctacgttcggcgggtagggaccgtaaggtggaagatacgaaacgtacgtgtagctagccaccgtatcctagttccttacacgttccttcccgacctacttcctgactaacg

SEQ ID NO: 52415 - DNA, 521 bp, Homo sapiens
  misc_feature: GYAE6OF02GTH6M.18.11.A11.1.454.CMB.1.raw
  modified_base (447)..(447): a, c, t, g, unknown or other
  misc_feature (447)..(447): n is a, c, g, or t
  modified_base (492)..(492): a, c, t, g, unknown or other
  misc_feature (492)..(492): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagttgttttatacagctccaacaataacaactacttagcttggtaccagcagaaaccaggacagccccctaaggtcctcattactgggcatctaccgggagtccggggtccctgaccgattcagaggcagcgggtctgggacagattcactctcaccatccaccaactgcaggctgaagatgtgctagtttatactgtcagcaatactatagtcctctctcacgttcggcggacgggacctagggtganactacgaaacgacgtgtcgctgcctaccgattcgtacgtcttacngttcccgtcccgtcctactctacgactac

SEQ ID NO: 52416 - DNA, 502 bp, Homo sapiens
  misc_feature: GYAE6OF02IDDHS.18.11.A11.1.454.CMB.1.raw
  modified_base (479)..(479): a, c, t, g, unknown or other
  misc_feature (479)..(479): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgtggctagtttatactgtcagcaatactatagtcctctctcacgttcggcggagggaccaaggtgagatacaaacgactgtgctgcacatctgtcttnattcttcccgcctatctgactac

SEQ ID NO: 52417 - DNA, 555 bp, Homo sapiens
  misc_feature: GYAE6OF02JAMLY.18.11.A11.1.454.CMB.1.raw
  modified_base (380)..(380): a, c, t, g, unknown or other
  misc_feature (380)..(380): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgtttatacagctccaacaataacaactacttagcttggtaccagcagaaaccaggacagccccctaaggtcctacattactgggcatctacccgggagtcccggggtccctgaccgattcgagaggcaggcgggtctgggacagtatttcactctcaccatcaccaactgcagctgaanatgtgctagtttatactgtcagtcaatactattacgtcctacctctcgtaccgtcggacggagggaccctaagggtcggaagtactacgaaacggtactggtaggctacgcctaccagttcctacgtccttacctacttcccgtttccccgacctagtccgtacgtacttaaccg

SEQ ID NO: 52418 - DNA, 510 bp, Homo sapiens
  misc_feature: GYAE6OF02JA877.18.11.A11.1.454.CMB.1.raw
  modified_base (286)..(286): a, c, t, g, unknown or other
  misc_feature (286)..(286): n is a, c, g, or t
  modified_base (469)..(469): a, c, t, g, unknown or other
  misc_feature (469)..(469): n is a, c, g, or t
  modified_base (472)..(472): a, c, t, g, unknown or other
  misc_feature (472)..(472): n is a, c, g, or t
  modified_base (477)..(477): a, c, t, g, unknown or other
  misc_feature (477)..(477): n is a, c, g, or t
  modified_base (504)..(504): a, c, t, g, unknown or other
  misc_feature (504)..(504): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagttgttttatacagctccaacaataacaactacttagcttggtaccagcagaaaccaggacacgcccccctaaggtcctcatttacngggcatctacccgggagtcccggggtccctgaccgattcagaggcagcgggtctgggacagatttcactctcaccatcaccaacctgcaggctgaagatgtcggctagtttatactgtcagcaatactattacgtccttcctctctacgtcgggcggagggacagggtgagatacaagactgngcngcacntctgtctcactccttcccgctactctnactacg

SEQ ID NO: 52419 - DNA, 584 bp, Homo sapiens
  misc_feature: GYAE6OF02GM89M.18.11.A11.1.454.CMB.1.raw
  modified_base (208)..(208): a, c, t, g, unknown or other
  misc_feature (208)..(208): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttanacagctaccaacaataacaactacttagcttggtaccagcagaaaccaggacagccccctaaggtcctcattactgggcatccgtacccgggagtcccggggtccctgaccgattccagaggcaggcgggtctgggacagatttcactctcaccatcaccaactgcaggctagaagatggtcggctagttttattacgtgtacagacaattactatacgttcctccttctctacggttccgggacggtaagggaccgtaaggtggaacgacttaacgaaacgtaacgtggtacggcctagacctaccgtaagtccgttcggtcctttaccgtaacttcccgtttaccccggccttaacgttccttacgacctaacg

SEQ ID NO: 52420 - DNA, 525 bp, Homo sapiens
  misc_feature: GYAE6OF02G2UKH.18.11.A11.1.454.CMB.1.raw
  modified_base (282)..(282): a, c, t, g, unknown or other
  misc_feature (282)..(282): n is a, c, g, or t
  modified_base (483)..(483): a, c, t, g, unknown or other
  misc_feature (483)..(483): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgtttatacagctccaacaataacaactacttagcttggtaccagcagaaaccaggacagccccctaaggtcctcatttacngggcatcgtacccgggagtccggggtccctggaccgattcagaggcagcgggtctgggacagatttcactctcaccatcaccaactgcaggctgaagatgtggctagttttatactgtacagacaatactatacgttcctactctctacgttcgggcggaggaccgaggtggagatacaaacgactgtcgctgaccacctntccttgtccttcacttccttcccgcctacttcctagactacg

SEQ ID NO: 52421 - DNA, 545 bp, Homo sapiens
  misc_feature: GYAE6OF02IALAK.18.11.A11.1.454.CMB.1.raw
  modified_base (207)..(207): a, c, t, g, unknown or other
  misc_feature (207)..(207): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcagagggccaccatcaactgcaagtccagccagagtgttttanacagctaccaacaataacaactactagcttggaccagcagaaaccaggacagccccctaaggtcctcatttactgggcatcaccgggagtccgggtccctgaccgattcgagaggcagcgggtctgggacagatttcactctcaccagtcaccaactgcaggctgaagactggtgacagtttatactgtcagcaatctatagtcctactctctacgttcggacggagggtacccaaggtcggaagacgtaccaaacgaactggagtctcggacaccgatttccgtacgtccgtttacaacgttccttaccccggcctacgttcctacggacttaaccg

SEQ ID NO: 52422 - DNA, 758 bp, Homo sapiens
  misc_feature: GYAE6OF02IPYGZ.18.11.A11.1.454.CMB.1.raw
  modified_base (222)..(222): a, c, t, g, unknown or other
  misc_feature (222)..(222): n is a, c, g, or t
  modified_base (311)..(311): a, c, t, g, unknown or other
  misc_feature (311)..(311): n is a, c, g, or t
tcagtacgagtatgcacgaccggtgctcgatttagctacgactgcaggggcgagcaagagtggtgttgccagacccaggtcttcatttctctgttgctctggatctctggtgaccgacgggacatcgtgatgacccagtctccagactccctggttgtgtctcgtagggtacgagacgggccaccatacaactgacaacgtccgagccagaggttgttttanacagcctaccaacgaactaacaactacttagccttaggaccagcaacgaaaccaggactacgaccccttaaggccttactactttacgnggactacgtacccgtaccgggacgtcccggggtacctagaccgtattccggaggacggtcctaggtcgggttacagggacctaggtactttcaccgttcgtaccacgtataccgaacccaaccgtgacccgtagggtacctaaggaacgttacgtcgggtacggtacttaacgtttttaacgtaaccgtaggtaccaaacggtaaccttaaacgttaaccttaacgtttaaaccggtttccccgttacctaccccgttaacgttaaccgggttaccggggaacggggtaaaccggtaaccgtaagggtacggaacgtaacttaaccgaaaccgtacggtcggttagaccctagaccgtaacccgtagttaccggaacgttaccgtttacccgaagtttcccccgtttacccgacctttaggttacccggtaacgtaaccgttaacgg

SEQ ID NO: 52423 - DNA, 560 bp, Homo sapiens
  misc_feature: GYAE6OF02H2TG3.18.11.A11.1.454.CMB.1.raw
  modified_base (381)..(381): a, c, t, g, unknown or other
  misc_feature (381)..(381): n is a, c, g, or t
  modified_base (399)..(399): a, c, t, g, unknown or other
  misc_feature (399)..(399): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataaacaactacttagcttggtaccagcagaaaccaggacagccccctaaggtcctcatttactgggcatctacccgggagtccggggtccctgaccgattcagaggcagcgggtctgggacagatttcactctcaccatcagcagcctgcaggctgaagntgcggctagtttatttcngtcagcagttattatgattacgttggacgttccggaccgaaagggaccctaaggtggaagtaactcgaaaaacgacgttaggtcggtacttacgccgtaactacttcgttcgttaccgtttcctactttcccgttacccccgcctattccgtacgtaaccg

SEQ ID NO: 52424 - DNA, 534 bp, Homo sapiens
  misc_feature: GYAE6OF02IO2K7.18.11.A11.1.454.CMB.1.raw
  modified_base (285)..(285): a, c, t, g, unknown or other
  misc_feature (285)..(285): n is a, c, g, or t
  modified_base (383)..(383): a, c, t, g, unknown or other
  misc_feature (383)..(383): n is a, c, g, or t
  modified_base (497)..(497): a, c, t, g, unknown or other
  misc_feature (497)..(497): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctaccaacaataacaactacttagcttggtaccagcagaaaccaggacacgccccctaaggtcctcatttacngggcatcgtacccgggagtccggggtcctgaccgattcagaggcaggcgggtctgggacagatttcactctcaccatcaccaacctgcaggctagaanatgtggctagttttattacgtgtacagactaaattactatacgttccttcctctcctacggtttcgggcgggaggacctaagggtgagatacaaacgactgacgctgaccacgnttctgttcttctacttccttcccgctatcctgactac

SEQ ID NO: 52425 - DNA, 517 bp, Homo sapiens
  misc_feature: GYAE6OF02HTX3W.18.11.A11.1.454.CMB.1.raw
  modified_base (329)..(329): a, c, t, g, unknown or other
  misc_feature (329)..(329): n is a, c, g, or t
  modified_base (468)..(468): a, c, t, g, unknown or other
  misc_feature (468)..(468): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataaacaactacttagcttggtaccagcagaaaccaggacagaccccctaaggtcctcaatttactgggcatctacccgggagtcccggggtccctggaccgattcagnggcagcgggtctgggacagatttcactctcaccatcaaccaactacaggctgaagatgtgactagtttatactgtcagacaattacatacgtcctcctctcacgttcggcggaggaccgaggtgagatacaaagactgngctgcacatctcgtcttcacttccttcccgcacttcgtcactattaccg

SEQ ID NO: 52426 - DNA, 709 bp, Homo sapiens
  misc_feature: GYAE6OF02FI1PQ.18.11.A11.1.454.CMB.1.raw
  modified_base (664)..(664): a, c, t, g, unknown or other
  misc_feature (664)..(664): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtcctcagacctccgttggttgtcgtctcggtggcgaggacggccacactacacgtcgacaacgtccacgaccgaagtagtttagttttaactaacgacgtcctaaccaaaactaaaactaaacctaaactttaacgttacgtcgtttacggtaaccacgacaaacgaaaccgaggaaccaccgtaccccgttaacggtccctacttaactttacggtcgggactacttacccgggtaacccggggtacgggttccccggggttccctacggaccgtacttacgaggacggcgacgggccgggttacgtagggacaggttactttaccaccttcctaccaacctactacccaacccaacgtcgacgacggtacgtacggaaagtgttgggtacgacgtttaagttttaacttcgtacgtacgacgtactaactacttattacgtcccttcctctacgtacggttccgggacgggtacggaccgtagggtcggagtactaaccgaaacgtacgtggtcgactgaccacgtnttctcgttcttactacttcccgttccgacctactcgtagacttac

SEQ ID NO: 52427 - DNA, 501 bp, Homo sapiens
  misc_feature: GYAE6OF02FXK3V.18.11.A11.1.454.CMB.1.raw
  modified_base (468)..(468): a, c, t, g, unknown or other
  misc_feature (468)..(468): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccgggtcctgaccgattcagaggcagcgggtctgggacagatttcactctcaccatcaccaacctgcaggctgaagatgtggctagtttattactgtcagcaatactatagtcctctctcacgttcggcgaggaccaggtgagatacaaacgactgtagctgcacgntctgtctcatccttcccgctatctacgactacg

SEQ ID NO: 52428 - DNA, 573 bp, Homo sapiens
  misc_feature: GYAE6OF02IX7RV.18.11.A11.1.454.CMB.1.raw
  modified_base (209)..(209): a, c, t, g, unknown or other
  misc_feature (209)..(209): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctcgtgggcgagagggccaccatcaactgcaagtccagccagagtgttttanacagctaccaaacaataacaactacttagcttggtaccagcagaaaccaggacacgccccctaaaggtcctacatttacgtgggactatccgtacccgggagtcccggggtccctgaccgattcagacggcagcgggtctgggacagatttcactctcaccatcaccaacctgcaggctagaagtatggtggactagtttacttactgtaccagctaatactatacgtaccctcgtctcacggttccggacggacggaccagggtcgaagtactacgaaacgtacgtggtgacgtgtaccaacctagttcgttacggttcttaccgtagtcccgtttcccgacctacttcctacgaccttaacg

SEQ ID NO: 52429 - DNA, 508 bp, Homo sapiens
  misc_feature: GYAE6OF02GECKA.18.11.A11.1.454.CMB.1.raw
  modified_base (467)..(467): a, c, t, g, unknown or other
  misc_feature (467)..(467): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaacgatgtgctagttttatactgtcagacaatactattacgtcctcctctcacgttcggcggaggaccaggtgagtatacaaacgtactgngctgcaccatctagtcttcattccttccgctatctgactac

SEQ ID NO: 52430 - DNA, 528 bp, Homo sapiens
  misc_feature: GYAE6OF02IXTFO.18.11.A11.1.454.CMB.1.raw
  modified_base (208)..(208): a, c, t, g, unknown or other
  misc_feature (208)..(208): n is a, c, g, or t
  modified_base (523)..(523): a, c, t, g, unknown or other
  misc_feature (523)..(523): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttanacagctccaacaataacaactacttagcttggtaccagcagaaaccaggacacgccccctaaggtcctcatttactggcatcctacccgggagtccggggtccctgaccgattcgagaggcagcgggtctgggacagtatttcactctcaccatccaccaacctgcaggctgaagatgtggctagtttattactgtcaagctaaatactatacgtcctcctctcgacgttcgggacggagggaccaagggtcgaagactacgaaacgactggagtctagacacgattctagtcttcattccttcccgctatctanactac

SEQ ID NO: 52431 - DNA, 503 bp, Homo sapiens
  misc_feature: GYAE6OF02FOSPN.18.11.A11.1.454.CMB.1.raw
  modified_base (380)..(380): a, c, t, g, unknown or other
  misc_feature (380)..(380): n is a, c, g, or t
  modified_base (476)..(476): a, c, t, g, unknown or other
  misc_feature (476)..(476): n is a, c, g, or t
  modified_base (498)..(498): a, c, t, g, unknown or other
  misc_feature (498)..(498): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagntgtggctagtttatactgtcagcaatactattactcctcctctctacgttcggcggagggaccaagggtgaagatacgaaacgactgtgctgcacntctgtctcatcctccgcatctnactac

SEQ ID NO: 52432 - DNA, 500 bp, Homo sapiens
  misc_feature: GYAE6OF02I70W6.18.11.A11.1.454.CMB.1.raw
  modified_base (208)..(208): a, c, t, g, unknown or other
  misc_feature (208)..(208): n is a, c, g, or t
  modified_base (295)..(295): a, c, t, g, unknown or other
  misc_feature (295)..(295): n is a, c, g, or t
  modified_base (459)..(459): a, c, t, g, unknown or other
  misc_feature (459)..(459): n is a, c, g, or t
  modified_base (466)..(466): a, c, t, g, unknown or other
  misc_feature (466)..(466): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttanacagctccaacaataacaactacttagcttggtaccagcagaaaccaggacagccccctaagtcctcattactggcatctaccgggngtccggggtcctgaccgattcagaggcagcgggtctgggacagatttcactctcaccatcaccaactgcaggctgaacgatgtgcagtttatactgtcagtcaatactatagtcctcctctcacgttcggcgagggaccaaggtgagatcaaacgaactgtgcngcaccgntactgtacttcaatcttcccgccagtctgactac

SEQ ID NO: 52433 - DNA, 664 bp, Homo sapiens
  misc_feature: GYAE6OF02F6310.18.11.A11.1.454.CMB.1.raw
  modified_base (378)..(378): a, c, t, g, unknown or other
  misc_feature (378)..(378): n is a, c, g, or t
  modified_base (475)..(475): a, c, t, g, unknown or other
  misc_feature (475)..(475): n is a, c, g, or t
tcagtacgagtatgcacgaccggtgctcgatttagctacgactgcagggggcagcaagatggtgttgccagacccaggtcttcatttcttctgttgctctggatctctggtgccgacggggacgatcgtgatgacccagtctccagacctccctggttgtgtctctgggcgagagggccaccatcaactggcaagtccagccagagtgttttatacagctaccaacaataactaactacttagcttgtaccagcaagaaacccaggacacgaccccccttaaggtcctacatttacgtggcactccgtacccggggagtcccggggtccctgaccgattcgagaggcacggcgggtctgggacagtactttcacttcnccacatcaaccactgacaggctagaaagtcgtggtacggactaagttttacttacgtgtacaagtactaaactacgttataccggtcccttctcctntacccgggttcgggaccggaagggaaccgtagggtggaacgaacttacccgaaaacgtaacgttcgggtaggtacccttacggaccctaaccgttaacgttccggtttacggtttacccttacccgttaccgtttacccccgtttccccggaaccctttagttcccgtttacggaaccccgtttaaccg

SEQ ID NO: 52434 - DNA, 511 bp, Homo sapiens
  misc_feature: GYAE6OF02HOFS6.18.11.A11.1.454.CMB.1.raw
  modified_base (208)..(208): a, c, t, g, unknown or other
  misc_feature (208)..(208): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttanacagctccaacaataacaactacttagcttggtaccagcagaaaccaggacagccccctaaggtcctcatttactgggcatcctacccgggagtccggggtccctgaccgattcagaggcagcgggtctgggacagatttcactctcaccatcaccaactgcaggctgaagatgtggctagtttatactgtcagcaatactatacgtcctccttctcacgttcggcggaggaccaaggtggagatacaaacgactgtgctgctaccgatctgtcttcacttccttcccgcctatctagactac

SEQ ID NO: 52435 - DNA, 522 bp, Homo sapiens
  misc_feature: GYAE6OF02HMFHN.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtcctgaccgattcagaggcagcgggtctgggacagatttcactctcaccatcaccaacctgcaggctgaagatgtggctagttttattactgtcagcaatattttggtattccgatccaccttcggaccaagggacacgacgtggaagaattaaaagactgtgctgcaccattctgtcttacgacttccttcccgctatcctagtaccattaccg

SEQ ID NO: 52436 - DNA, 510 bp, Homo sapiens
  misc_feature: GYAE6OF02GHCTQ.18.11.A11.1.454.CMB.1.raw
  modified_base (476)..(476): a, c, t, g, unknown or other
  misc_feature (476)..(476): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtcctgaccgattcagaggcaggcgggtctgggacagatttcactctcaccatccaccaacctgcaggctgaagatgtgctagtttattactgtcagcaatactattacgtcctcctctcacgttcggcggaggaccaaggtggaagatacaaacgactgtgctgcaccntctgtcttacattccttcccgccatctagactac

SEQ ID NO: 52437 - DNA, 511 bp, Homo sapiens
  misc_feature: GYAE6OF02F73YZ.18.11.A11.1.454.CMB.1.raw
  modified_base (380)..(380): a, c, t, g, unknown or other
  misc_feature (380)..(380): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagntgtggctagtttattactgtcagcaatactattacgtcctcctctctacgttcggcggagggaccaagggtggagatacaaacgaacgtgtaggctgcaccgatctgtcttcatctccgccatctgactac

SEQ ID NO: 52438 - DNA, 563 bp, Homo sapiens
  misc_feature: GYAE6OF02HJFR9.18.11.A11.1.454.CMB.1.raw
  modified_base (217)..(217): a, c, t, g, unknown or other
  misc_feature (217)..(217): n is a, c, g, or t
  modified_base (357)..(357): a, c, t, g, unknown or other
  misc_feature (357)..(357): n is a, c, g, or t
tcagtacgagtatgcacgaccggtgctcgatttagctacgactgcaggggcagcaagatggtgttgcagacccaggtcttcatttctctgttgctctggatctctggtgccgacgggacatcgtgatgacccagtctccagactccctggttgtgtctctgggcgagagggccaccatcaactgcaagtccagccagagtgtttatacagctccaanaataacaactactagcttaggtaccagcagaaaccaggacagaccccctaaaggtcctcattactgggcatctacccgggagttcccggggtccctggaccgattccagacggcaggcgggtctgggacagattcactcncacatcacaactgcagctgaagatgtaggcagtttatacgtgtcagctaatactattacgtcctcgtctcacgttcggcggaagggtacccaagggtcgaagtataccgaaaaggtacgtggtaggacttagacgaccgtaagttcctaggttacctttacgaccgttcccgttaccccgcctacgttaccctagaaccgttaacc

SEQ ID NO: 52439 - DNA, 659 bp, Homo sapiens
  misc_feature: GYAE6OF02JRPW1.18.11.A11.1.454.CMB.1.raw
  modified_base (207)..(207): a, c, t, g, unknown or other
  misc_feature (207)..(207): n is a, c, g, or t
  modified_base (284)..(284): a, c, t, g, unknown or other
  misc_feature (284)..(284): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgtttanacagctccaacaataacaactacttagcttaggtaccagcagaaaccaggacacgcccctaaggtcctctatttacngggctacgtccgtacccggggacggttcccggggtccctggacccgtattcgacggtacggcgaggtccgggttacgtagggactagtagtttcaccgtctcaccgactacaaccaaccgtcgacacggactaggaacgtatacggtcggctaaggttttactacgtgtacagtaccaattacctagtaccgttcccttacgtacttaccgtaaccgggtttccgggaccggtaacgggtaactaacggggtggtaaacgtacgttaacggaaaccgtaaacggtgtacgggtactacggtaaccacccgtaagttcctacggttacttaccgtattccccgttacccgacttaccgttctaccgtacttaaccg

SEQ ID NO: 52440 - DNA, 543 bp, Homo sapiens
  misc_feature: GYAE6OF02HBOTB.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagttgtttatacagctccaacaataacaactacttagcttggtaccagcagaaaccaggacacgccccctaaggtcctcatttactgggcatcgtacccgggagtccgggtccctgaccgattcgagaggcagcgggtctgggacagatttcactctccaccactcaaccaactgacaggctagaagtatgtagactagttttatacttgtacagactaatactaattacgtcctctactcacgttcgggcgacgggaccaggtgagtactacaaacgtactggtcgactgaccaccgtatcgtcgttacctctacttcccttacccgcctatccgtagacctac

SEQ ID NO: 52441 - DNA, 485 bp, Homo sapiens
  misc_feature: GYAE6OF02IF9O5.18.11.A11.1.454.CMB.1.raw
  modified_base (363)..(363): a, c, t, g, unknown or other
  misc_feature (363)..(363): n is a, c, g, or t
  modified_base (365)..(365): a, c, t, g, unknown or other
  misc_feature (365)..(365): n is a, c, g, or t
  modified_base (422)..(422): a, c, t, g, unknown or other
  misc_feature (422)..(422): n is a, c, g, or t
  modified_base (436)..(436): a, c, t, g, unknown or other
  misc_feature (436)..(436): n is a, c, g, or t
  modified_base (450)..(450): a, c, t, g, unknown or other
  misc_feature (450)..(450): n is a, c, g, or t
  modified_base (474)..(474): a, c, t, g, unknown or other
  misc_feature (474)..(474): n is a, c, g, or t
  modified_base (481)..(481): a, c, t, g, unknown or other
  misc_feature (481)..(481): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaaacaataacaactacttagcttggtaccagcagaaaccaggacagccccctaaggtcctcatttactgggcatctacccgggagtccggggtccctgaccgattcagaggcagcggtctgggacagattcatctcacatcacactncngctgagatgtggctagtttatactgtcagcaatactatagtcctctctcacgttcgnggaggacaggtganatcaaacgaactgngctgcacatctgtcttcatctccnccatctnatac

SEQ ID NO: 52442 - DNA, 546 bp, Homo sapiens
  misc_feature: GYAE6OF02ICQU9.18.11.A11.1.454.CMB.1.raw
  modified_base (211)..(211): a, c, t, g, unknown or other
  misc_feature (211)..(211): n is a, c, g, or t
  modified_base (404)..(404): a, c, t, g, unknown or other
  misc_feature (404)..(404): n is a, c, g, or t
  modified_base (481)..(481): a, c, t, g, unknown or other
  misc_feature (481)..(481): n is a, c, g, or t
  modified_base (500)..(500): a, c, t, g, unknown or other
  misc_feature (500)..(500): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctcgtgggcgaggagggccaccatcaactgcaagtccagccagagttgttttanacagctccaaacaaataacaactacttagcttaggtaccagcaacgaaaccaggacacgaccccctaaggtcctacatttactgggcatccgtacccgggaggtcccgggtccctgaccgtattcagaggcaggcgggtctgggacagtatttcactctcaccatcaaccaacctgacaggctagaacgatgnggtctagtttatactgtacagactaatactaactacgttcctactcctctacgtcggcgggaacggaccgagtgganatacaaacgactggtagcngaccactctctacgtcttacacttcctccgctactctcgattaccg

SEQ ID NO: 52443 - DNA, 652 bp, Homo sapiens
  misc_feature: GYAE6OF02I7WIJ.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtgccgacgggacatcgtgatgacccagtctccagactccctggttgtgtctctgggcgagagggccaccatcaactgcaagtccagccagagtgttttatacagctaccaacaataacaactacttagcttggtaccagcagaaaccaggacagccccctaaggtcctcatttactgggcatctacccgggagtccggggtccctgaccgattcgagaggcagcggtctgggacagtacttcgactctaccactataccaaccctaacgtcgaccgacggtactacgaagacgtttggacggtacgtttaagtttttaacgtacgtttttagacgtaacgtaactaaacttaacgtttaagttaccgtttaccccttccttacccgttacgtaccgggtttccgggaacgggtaaccggtaaccggaagggtaggaacgtaacgtaaccgaaaacgtactgggtacgtacgtcgtaccaccgttaacgtcgttcgttacctacgtaccttcccggttacccaccgtacttcgtactacttaaccg

SEQ ID NO: 52444 - DNA, 529 bp, Homo sapiens
  misc_feature: GYAE6OF02IHOUW.18.11.A11.1.454.CMB.1.raw
tcagtacgagtatgcacgaccggtgctcgatttagctacgactgcagggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactactagcttggtaccagcagaaaccaggacagccccctaaggtcctcatttactgggcatctacccgggagtccggggtccctgaccgattcagagcagcggtctgggacagatttcactctcaccatcaccaacctgcaggctgaagatgtggactagtttattactgtacagtacaattactatacgtcctcctctcacgttcggcgggaggaccaagggtgagtataccaaacgtactgtagcgtagccaccgatccttgtccttctattcccttcccgacctactcctagactaac

SEQ ID NO: 52445 - DNA, 508 bp, Homo sapiens
  misc_feature: GYAE6OF02FT7MC.18.11.A11.1.454.CMB.1.raw
  modified_base (283)..(283): a, c, t, g, unknown or other
  misc_feature (283)..(283): n is a, c, g, or t
  modified_base (474)..(474): a, c, t, g, unknown or other
  misc_feature (474)..(474): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttacngggcatctacccgggagtccggggtccctgaccgattcagaggcaggcgggtctgggacagatttcactctcaccatcaccaacctgcaggctgaagatgtggctagtttattactgtcagcaatactatacgtcctctctctacgttcggcggaggaccagggtgagatacaaacgactgtgctgcacgntctgtacttcattccttcccgccatctagactac

SEQ ID NO: 52446 - DNA, 552 bp, Homo sapiens
  misc_feature: GYAE6OF02GHA09.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacacgccccctaaggtcctcatttactggcatccgtacccgggagtccggggtccctggaccgattcagagcaggcgggtcgtgggacagtatttcactctcaccatacaccaactgcaggctagagatggtagtctagtttatacgtgtacagtacaactactattacgtcccttcctctcgtacgtcgggacggacggaccgtaagggtgagtactaacgaaacgacgttggacgctgacctaccgtagttcgtcgtccttcacttcccgtacccgcctatctacgactaacg

SEQ ID NO: 52447 - DNA, 528 bp, Homo sapiens
  misc_feature: GYAE6OF02HQXCL.18.11.A11.1.454.CMB.1.raw
  modified_base (496)..(496): a, c, t, g, unknown or other
  misc_feature (496)..(496): n is a, c, g, or t
  modified_base (516)..(516): a, c, t, g, unknown or other
  misc_feature (516)..(516): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtcccggggtccctgaccgattcagaggcagcgggtctgggacagatttcactctcaccatcaccaacctgacaggctagaagatggtggctagttttatactgtcagctaatactattacgtcctcctctccacggttccggcggtagggaacccaagggtcgagactacgaaacgtactgtgactcgacaccgtntcctgtcttcattcctcccnctatctgactac

SEQ ID NO: 52448 - DNA, 535 bp, Homo sapiens
  misc_feature: GYAE6OF02HFLG7.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatcctacccgggagtccggggtccctgaccgattcagaggcaggcgggtctgggacagtatttcactctcaccatcaccaactgcaggctagaagatgtgctagtttattactgtcagactaatactatacgtccctcctctctacggttcggcggagggaccaaggtggagactaccaaacgactgtcggctgcacctatcctgtccttctacttcccgttacccgcctacttccgtagtacctacg

SEQ ID NO: 52449 - DNA, 508 bp, Homo sapiens
  misc_feature: GYAE6OF02GBYNA.18.11.A11.1.454.CMB.1.raw
  modified_base (465)..(465): a, c, t, g, unknown or other
  misc_feature (465)..(465): n is a, c, g, or t
  modified_base (495)..(495): a, c, t, g, unknown or other
  misc_feature (495)..(495): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcagctagaagatgtggctagtttattacgtgtcagacaatactatacgtcctcctctcacgttcggcgacggacaggtgagatacgaaacgatagngctcgcaccgatctgtcttcattcctcccnctatctgactacg

SEQ ID NO: 52450 - DNA, 536 bp, Homo sapiens
  misc_feature: GYAE6OF02G0VJB.18.11.A11.1.454.CMB.1.raw
  modified_base (338)..(338): a, c, t, g, unknown or other
  misc_feature (338)..(338): n is a, c, g, or t
  modified_base (376)..(376): a, c, t, g, unknown or other
  misc_feature (376)..(376): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcaagaaaccaggacagccccctaaggtcctcatttactgggcatccgtacccgggagtccggggtccctgaccgattcagaggcagcggtcngggacagattcactctcaccatcagcagcctgcaggcngaagatggcggctagtttattctagtcagtcagtattatgattacgtggtacgttcggaccgaagggaccaacggtggaacgataccgaaacgaacgtgtacggctagaccaccatccgttgtacctttcacttcccttcccgacctacttctagtaacc

SEQ ID NO: 52451 - DNA, 520 bp, Homo sapiens
  misc_feature: GYAE6OF02ITLZK.18.11.A11.1.454.CMB.1.raw
  modified_base (285)..(285): a, c, t, g, unknown or other
  misc_feature (285)..(285): n is a, c, g, or t
  modified_base (381)..(381): a, c, t, g, unknown or other
  misc_feature (381)..(381): n is a, c, g, or t
  modified_base (493)..(493): a, c, t, g, unknown or other
  misc_feature (493)..(493): n is a, c, g, or t
  modified_base (508)..(508): a, c, t, g, unknown or other
  misc_feature (508)..(508): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacacgccccctaaaggtcctcatttacnggcatcgtacccgggagtccggggtccctgaccgattcagaggcagcgggtctgggacagactttcactctcaccatcaccaactgcagctgaagntgtggactagttttattactgttcagactaatactatacgttcctcctctctacgttcggcggacggaccgtaaggtggagactacgaaaacgactgtgctgcacgtatctntcttcattctacccncatctagactac

SEQ ID NO: 52452 - DNA, 493 bp, Homo sapiens
  misc_feature: GYAE6OF02FRMQT.18.11.A11.1.454.CMB.1.raw
  modified_base (281)..(281): a, c, t, g, unknown or other
  misc_feature (281)..(281): n is a, c, g, or t
  modified_base (458)..(458): a, c, t, g, unknown or other
  misc_feature (458)..(458): n is a, c, g, or t
  modified_base (488)..(488): a, c, t, g, unknown or other
  misc_feature (488)..(488): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggaccagcagaaaccaggacagcccctaaggtcctcatttacnggcatctaccgggagtccgggtcctgaccgattcagagcagcgggtctgggacagatttcactctcacatcaccaactgcaggctgaagatgtggcagtttattactgtacagcaaatactatacgtcctcctctcacgttcggcggagggaccaaggtggagatacaaacgactgnggctgcaccatctgtctcatctccgcatcngacac

SEQ ID NO: 52453 - DNA, 549 bp, Homo sapiens
  misc_feature: GYAE6OF02I1XNY.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacacgccccctaaggtcctcatttactgggcatcgtacccgggaggtcccggggtccctggaccgattcagaggcaggcgggtctgggacagtatttcactctcaccatcaaccaacctgcaggctagaagatggtggctaagttttatactgtcagcaatactatacgtcctcctctctacgttcggacggtacggaccgagggtcggagtagtaccaaacgtactggtacggctagccacctagttcctagttccttcacttcccgttaccccgctactctacgactacg

SEQ ID NO: 52454 - DNA, 611 bp, Homo sapiens
  misc_feature: GYAE6OF02JL9M0.18.11.A11.1.454.CMB.1.raw
  modified_base (208)..(208): a, c, t, g, unknown or other
  misc_feature (208)..(208): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttanacagctccaaacaataacaactacttagcttaggtaccagcagaaaccaggacacgaccccctaaggtcctacatttactgggcactcgtacccgggagtccgggtccctgaccgattcagaggcaggccggtcgtgggacaggatttcactctacaccatccaccaacctgacaggctagaagatgtgactagtttatactgtcagacaatactatacgttccctctcctacgtaccgttcgggacggaacgggtaccgaagggttacggaacgtaaccgttaacgaaaaccggtacgttacgggacgtaccgttacggacaaccccgtattaccgttcgtttaccttaccgtaacgtttcccctttaccccgaccgtaactttcccgtacgtaccctaacg

SEQ ID NO: 52455 - DNA, 512 bp, Homo sapiens
  misc_feature: GYAE6OF02FMBDG.18.11.A11.1.454.CMB.1.raw
  modified_base (378)..(378): a, c, t, g, unknown or other
  misc_feature (378)..(378): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccgggtccctgaccgattcagagcagcgggtctgggacagatttcactctcaccatcaccaacctgcaggctgaagntgtgcagtttatactgtacagcaatactatacgtccttcctctcacgtttcggcggtagggaccaggtgagatacaaacgactgtcgctagcacgatctcgtcttcgattccgttccgcctatctagtactacg

SEQ ID NO: 52456 - DNA, 594 bp, Homo sapiens
  misc_feature: GYAE6OF02JUYJ9.18.11.A11.1.454.CMB.1.raw
  modified_base (385)..(385): a, c, t, g, unknown or other
  misc_feature (385)..(385): n is a, c, g, or t
  modified_base (407)..(407): a, c, t, g, unknown or other
  misc_feature (407)..(407): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctcgtgggcgagagggccaccatcaactgcaagtccagccagagtgttttatacagctaccaacaataacaactacttagcttaggtaccagacagaaaccaggaccacgaccccctaaggtcctctactttacgtgggcctatccgtacccggggtacgtcccggggtccctcggaccgtattacgacgaggcaggcgggtcgtggacagtacttcactctacaccntacacactgcaggctagaacgngtcggtagactagttttatacgtcgtacagtactaatacttatccgtacttccgtcgtacgtaccggttacgggcggtaacgggaccaagggtcggaactacgtactaaacggaactcggtacgcctgacctacgtctacgtactccttactacgtccccttaccgacgttactcgtactactaccg

SEQ ID NO: 52457 - DNA, 592 bp, Homo sapiens
  misc_feature: GYAE6OF02H9SC8.18.11.A11.1.454.CMB.1.raw
  modified_base (208)..(208): a, c, t, g, unknown or other
  misc_feature (208)..(208): n is a, c, g, or t
  modified_base (354)..(354): a, c, t, g, unknown or other
  misc_feature (354)..(354): n is a, c, g, or t
  modified_base (402)..(402): a, c, t, g, unknown or other
  misc_feature (402)..(402): n is a, c, g, or t
  modified_base (406)..(406): a, c, t, g, unknown or other
  misc_feature (406)..(406): n is a, c, g, or t
  modified_base (424)..(424): a, c, t, g, unknown or other
  misc_feature (424)..(424): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttanacagcctaccaacaataacaactacttagcttaggtaccagcaagaaaccaggacacgccccctaaggtcctactatttactgggcataccgtacccgggacggttcccggggtccctgaccgtattcgagaggcgaggcgggtcngggacagtatttcactctcaccatacaacccactgcgaggctagaagngtgnggctagtttactactgtnacgacaattactattacgttcctccttctaccgttcggtaccgggacggaacgggaaccgtaaggggtggaagtactaacgaaaacggtaccgtggtacgcgtagacctaacctagttccgtcgttccttactaccttccgttcccgaccttacgtctacgactaccg

SEQ ID NO: 52458 - DNA, 531 bp, Homo sapiens
  misc_feature: GYAE6OF02H93JJ.18.11.A11.1.454.CMB.1.raw
  modified_base (208)..(208): a, c, t, g, unknown or other
  misc_feature (208)..(208): n is a, c, g, or t
  modified_base (357)..(357): a, c, t, g, unknown or other
  misc_feature (357)..(357): n is a, c, g, or t
  modified_base (370)..(370): a, c, t, g, unknown or other
  misc_feature (370)..(370): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttanacagctccaaacaataacaactacttagcttggtaccagcaagaaaccaggacacgccccctaaggtcctacatttactgggcatcctacccgggagtcccggggtcctggaccgattcagaggcagcggtctgggacagattcactcncacatcaccactncagctagagatgtggctagtttatacgtgtcagcaatactattacgtcctctctctacgtcggcggacggaccgaggtgagatacaaacgagtgtgctgactaccgatccttgtccttacgtacttccgtaccccgtccaacttccgtaccgtactaaccg

SEQ ID NO: 52459 - DNA, 504 bp, Homo sapiens
  misc_feature: GYAE6OF02G566R.18.11.A11.1.454.CMB.1.raw
  modified_base (474)..(474): a, c, t, g, unknown or other
  misc_feature (474)..(474): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgtggctagtttattactgtcagcaatactatacgtcctcctctcacgttcggcggagggaccaagggtgagatcaaacgactgtgctgcaccntctgtcttcatccttcccgcatctgactac

SEQ ID NO: 52460 - DNA, 591 bp, Homo sapiens
  misc_feature: GYAE6OF02HKMNF.18.11.A11.1.454.CMB.1.raw
  modified_base (217)..(217): a, c, t, g, unknown or other
  misc_feature (217)..(217): n is a, c, g, or t
tcagtacgagtatgcacgaccggtgctcgatttagctacgactgcagggggccaagcaacgatgggtgttgccagacccaggtcttcatttctctgttgctctggatctctggtgccgtacggggacatcgtgatggacccagtctccagactccctggttgtgtctctgggcgagagggccaccatcaactgcaagtccgagccagagtgttttanacagctcaacaataacaactacttagcttggtaccagacaagaacaggacacgacccctaaggtcctcatttacgtcgggacagtcgtacccggggaggttcccgggggtcccgtggaccgagttccgagtaggcgaggcgggtctagggacagactttcactctcaccatcaccaactgactacggctagaacgatacgtggtactagtttactacgtgtacaagtcaatactattacgtcctccttctacgtaccggttcgggacggtacggtacctaagggtcgagtactacgaaacgtactgttggctgtaccaaccgtaattcgttacgtccttactacgttaccttcccgctacttctacgtactacg

SEQ ID NO: 52461 - DNA, 529 bp, Homo sapiens
  misc_feature: GYAE6OF02ICZOF.18.11.A11.1.454.CMB.1.raw
  modified_base (282)..(282): a, c, t, g, unknown or other
  misc_feature (282)..(282): n is a, c, g, or t
  modified_base (376)..(376): a, c, t, g, unknown or other
  misc_feature (376)..(376): n is a, c, g, or t
  modified_base (495)..(495): a, c, t, g, unknown or other
  misc_feature (495)..(495): n is a, c, g, or t
tcagtacgagtatgcacgaccggtgctcgatttagctacgactgcagggcagcaagatggtgttgcagacccaggtcttcatttctctgttgctctggatctctggtgccgacggggacatcgtgatgacccagtctccagactccctggttgtgtctctggcgagagggccaccatcaactgcaagtccagccagagtgttttatacagctccaacaataacaactacttagcttggtaccagcaagaaaccaggacagccccctaaggtcctcatttacngggcatcctacccgggagttcccggggtccctaggacccgattcagacggcagacggtctgggacagatttcactctacaccatcacctacctnacaggctagaagatgtggactagttttatactgtcagcaatactatacgtcctcctctcacgttcggcgacggaccaggtggagtacgtacgaaacggtactgtacggctcgacaccgntcctgtcttcacttcctcccgctatctgactacg

SEQ ID NO: 52462 - DNA, 533 bp, Homo sapiens
  misc_feature: GYAE6OF02H9GC9.18.11.A11.1.454.CMB.1.raw
  modified_base (208)..(208): a, c, t, g, unknown or other
  misc_feature (208)..(208): n is a, c, g, or t
  modified_base (357)..(357): a, c, t, g, unknown or other
  misc_feature (357)..(357): n is a, c, g, or t
  modified_base (380)..(380): a, c, t, g, unknown or other
  misc_feature (380)..(380): n is a, c, g, or t
  modified_base (437)..(437): a, c, t, g, unknown or other
  misc_feature (437)..(437): n is a, c, g, or t
  modified_base (453)..(453): a, c, t, g, unknown or other
  misc_feature (453)..(453): n is a, c, g, or t
  modified_base (470)..(470): a, c, t, g, unknown or other
  misc_feature (470)..(470): n is a, c, g, or t
  modified_base (474)..(474): a, c, t, g, unknown or other
  misc_feature (474)..(474): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagttgtttanacagctcaaacaataacaactacttagcttggaccagcaagaaaccaggacacgtccccctaaggtcctcactttactgggcatccgtaccggagtcccgggcctgaccgattcagagcagcggtcgtggacagattcactctcactancaccaacctgcagctagaacgangtggctagtttatagtgtacagtacaatactaatacgtccctctcctcacgttcggngggtacggacaacggngagatacaaacgactgnggcnggactaccgatacgtcgttctttaccacttccttccccgacttactcgtagtactaacg

SEQ ID NO: 52463 - DNA, 504 bp, Homo sapiens
  misc_feature: GYAE6OF02GYMHG.18.11.A11.1.454.CMB.1.raw
  modified_base (381)..(381): a, c, t, g, unknown or other
  misc_feature (381)..(381): n is a, c, g, or t
  modified_base (448)..(448): a, c, t, g, unknown or other
  misc_feature (448)..(448): n is a, c, g, or t
  modified_base (464)..(464): a, c, t, g, unknown or other
  misc_feature (464)..(464): n is a, c, g, or t
  modified_base (471)..(471): a, c, t, g, unknown or other
  misc_feature (471)..(471): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccggggagtcccggggtccctgaccgattcagaggcagcgggtctgggacagatttcactctcaccatcaccaactgcaggctgaagntgtggctagtttatactgtcagcaatctatacgtcctcctctcacgttcggcggaggaccaggtganagtcaaacgactgtgntgcacgntctgtcttacattccttccgctatctagactac

SEQ ID NO: 52464 - DNA, 540 bp, Homo sapiens
  misc_feature: GYAE6OF02G6VHT.18.11.A11.1.454.CMB.1.raw
  modified_base (283)..(283): a, c, t, g, unknown or other
  misc_feature (283)..(283): n is a, c, g, or t
  modified_base (376)..(376): a, c, t, g, unknown or other
  misc_feature (376)..(376): n is a, c, g, or t
  modified_base (388)..(388): a, c, t, g, unknown or other
  misc_feature (388)..(388): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagttccaacaataacaactacttagcttggtaccagcagaaaccaggacagccccctaaggtcctcatttacngggcatccgtacccggggagtccggggtccctgacccgattcaggaggcaggcgggtctggggacagtattcactctcaccatcaccaacctncaggctgaagtntggtgctagtttatactgtcagcaatactatacgtcctctctctacgttcgcggacggaccgtaagggtgagtatacgaaacgtatgtagctgccactagtctagttccttacgtacttccttcccgacttacttctacgacctattacccg

SEQ ID NO: 52465 - DNA, 524 bp, Homo sapiens
  misc_feature: GYAE6OF02F2TSK.18.11.A11.1.454.CMB.1.raw
  modified_base (492)..(492): a, c, t, g, unknown or other
  misc_feature (492)..(492): n is a, c, g, or t
  modified_base (502)..(502): a, c, t, g, unknown or other
  misc_feature (502)..(502): n is a, c, g, or t
  modified_base (515)..(515): a, c, t, g, unknown or other
  misc_feature (515)..(515): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgccaggctagaagatggtggctagtttattcgtgtcagctaatactattacgtccttctctcgtacgttcgggcgtacgggaccagggtggagagtacgaaacgtacgtgtaggctagcacctntctgtcttcncttcctccgcctntctgatacg

SEQ ID NO: 52466 - DNA, 556 bp, Homo sapiens
  misc_feature: GYAE6OF02IQ4LG.18.11.A11.1.454.CMB.1.raw
  modified_base (209)..(209): a, c, t, g, unknown or other
  misc_feature (209)..(209): n is a, c, g, or t
  modified_base (284)..(284): a, c, t, g, unknown or other
  misc_feature (284)..(284): n is a, c, g, or t
  modified_base (377)..(377): a, c, t, g, unknown or other
  misc_feature (377)..(377): n is a, c, g, or t
  modified_base (399)..(399): a, c, t, g, unknown or other
  misc_feature (399)..(399): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgaccccagtctccagactccctggttgtgtctctgggcgagagggccaccatcaactgcaagtccagccagagtgttttanacagctccaacaataacaactacttagcttggtaccagcagaaaccaggacagccccctaaggtcctcatttacngggcatcgtacccgggagtccgggtcctgaccgattcagagcagcggtctgggacagtattcactctcacatcaccaactgcaggctagaagntgtgctagtttactactgtcancaatactatacgtcctctctctacgtcggcggagggaccaaggtcggagtaacgtcgaaaaccgtacgtggtacgcgtacgacctacccgtaattccgtacgttacctttacctacgttcccgttaccccgcctaacgttcccttaggacctaaccg

SEQ ID NO: 52467 - DNA, 505 bp, Homo sapiens
  misc_feature: GYAE6OF02IQIPH.18.11.A11.1.454.CMB.1.raw
  modified_base (451)..(451): a, c, t, g, unknown or other
  misc_feature (451)..(451): n is a, c, g, or t
  modified_base (464)..(464): a, c, t, g, unknown or other
  misc_feature (464)..(464): n is a, c, g, or t
  modified_base (467)..(467): a, c, t, g, unknown or other
  misc_feature (467)..(467): n is a, c, g, or t
  modified_base (472)..(472): a, c, t, g, unknown or other
  misc_feature (472)..(472): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactggcatcctaccgggagtccggggtccctggaccgattcagagcagcgggtcgtgggacagattcactctcaccatcaccactgcagctagaagagtgtgactagtttatactgtacagctaatactatacgtcctactctactacgtcggcggtaggaccgaggtganatacaaacgatgngcngcacntctctcttcactccttcccgcatctcgactacg

SEQ ID NO: 52468 - DNA, 534 bp, Homo sapiens
  misc_feature: GYAE6OF02IK51D.18.11.A11.1.454.CMB.1.raw
  modified_base (208)..(208): a, c, t, g, unknown or other
  misc_feature (208)..(208): n is a, c, g, or t
  modified_base (326)..(326): a, c, t, g, unknown or other
  misc_feature (326)..(326): n is a, c, g, or t
  modified_base (444)..(444): a, c, t, g, unknown or other
  misc_feature (444)..(444): n is a, c, g, or t
  modified_base (493)..(493): a, c, t, g, unknown or other
  misc_feature (493)..(493): n is a, c, g, or t
  modified_base (502)..(502): a, c, t, g, unknown or other
  misc_feature (502)..(502): n is a, c, g, or t
  modified_base (507)..(507): a, c, t, g, unknown or other
  misc_feature (507)..(507): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttanacagctccaacaataacaactacttagcttggtaccagcaagaaaaccaggaacacgacccccctaaggtcctcatttactagggcatccgtacccgggaggttcccgggggttaccnggaccgtattcgagaggcaggtcgggtctgggacagacttcactctcacatcaaccactgcaggctagaacgtatggtgtactagtttactactgtacagtacaatactatacgtccnctctactaccggtggcgacggacaaggtgagatacgaaacgctgtgacngaccacgtntcgtnttactcattcctccgtcatctcatacg

SEQ ID NO: 52469 - DNA, 506 bp, Homo sapiens
  misc_feature: GYAE6OF02F75U5.18.11.A11.1.454.CMB.1.raw
  modified_base (465)..(465): a, c, t, g, unknown or other
  misc_feature (465)..(465): n is a, c, g, or t
  modified_base (474)..(474): a, c, t, g, unknown or other
  misc_feature (474)..(474): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccggggagtcccggggtccctgacccgattcagaggcagcgggtctgggacagatttcactctcaccatcaccaacctgcaggctgaagatgtggctagttttatactgtcagcaatactatacgtcctcctctcacgttcggcggaggaccaagggtgagatcaaagctgngctgcaccntctgtcttcattcctcccgctatctagactac

SEQ ID NO: 52470 - DNA, 519 bp, Homo sapiens
  misc_feature: GYAE6OF02JA5XQ.18.11.A11.1.454.CMB.1.raw
  modified_base (208)..(208): a, c, t, g, unknown or other
  misc_feature (208)..(208): n is a, c, g, or t
  modified_base (352)..(352): a, c, t, g, unknown or other
  misc_feature (352)..(352): n is a, c, g, or t
  modified_base (382)..(382): a, c, t, g, unknown or other
  misc_feature (382)..(382): n is a, c, g, or t
  modified_base (450)..(450): a, c, t, g, unknown or other
  misc_feature (450)..(450): n is a, c, g, or t
  modified_base (480)..(480): a, c, t, g, unknown or other
  misc_feature (480)..(480): n is a, c, g, or t
  modified_base (484)..(484): a, c, t, g, unknown or other
  misc_feature (484)..(484): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttanacagctccaacaataaccaactacttagcttggtaccagcagaaaccaggacagccccctaaggtcctcattactgggcatctaccgggagtccggggtccctgaccgattcagaggcaggcggtctgggacagatttcactcncaccatcacaacctgcaggctagaagatgnggactagttttatacgtgtacagtacaatactatagtcctcctctcgacgttcggcggaggacgaggngagactacgaaacgactgtgctcgcacgtntctntctctacgttcgtacccgctattcgactattaccg

SEQ ID NO: 52471 - DNA, 576 bp, Homo sapiens
  misc_feature: GYAE6OF02FN5MU.18.11.A11.1.454.CMB.1.raw
  modified_base (524)..(524): a, c, t, g, unknown or other
  misc_feature (524)..(524): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctaccaacaataacaactacttagcttaggtaccagcaagaaaccaggacacgaccccctaaggtcctcatttactgggcactccgtacccggggaggtcccggggtccctgaccgattcaggaggcaggcgggtctgggacagtatttcactctcaccatcaccaactgcaggctagaagagtgtaggctagtttattactgtacgtagactaaatactattacgtcccttcctctacgtacggttcgggacggacggaccgtaaggtaggacgtagtacgaaacgtacgtggtcgctacgcctaaccgtnttacgtcgttaccttctacgttcccgttcccgacctacttcgtactactacg

SEQ ID NO: 52472 - DNA, 553 bp, Homo sapiens
  misc_feature: GYAE6OF02HW9J1.18.11.A11.1.454.CMB.1.raw
  modified_base (207)..(207): a, c, t, g, unknown or other
  misc_feature (207)..(207): n is a, c, g, or t
  modified_base (455)..(455): a, c, t, g, unknown or other
  misc_feature (455)..(455): n is a, c, g, or t
  modified_base (523)..(523): a, c, t, g, unknown or other
  misc_feature (523)..(523): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgtttanacagctcaacaataacaactacttagcttggtaccagcaagaaaaccaggacacgcccccctaaaggtccctctatttactgggcactccttaccccgggaggtcccgggggtccctggaccgtacttcgagacggcgagtccgggtactggggaacaggactttcactctcaccatcaaccaacctgcaggctagaagacttgtggctagttttatcgtgtcaagcaatatattagtcctctctcgngtcggacgaggaacctaggtacgagaatccgaaagacctgtaggtctcgctacccattcctgtccttnacttcctacccgcctacgtctcgattaacg

SEQ ID NO: 52473 - DNA, 525 bp, Homo sapiens
  misc_feature: GYAE6OF02FVKCJ.18.11.A11.1.454.CMB.1.raw
  modified_base (486)..(486): a, c, t, g, unknown or other
  misc_feature (486)..(486): n is a, c, g, or t
tcagtacgagtatgcacgaccggtgctcgatttagctacgactgcaggggcagcaagatggtgttgcagacccaggtcttcatttctctgttgctctggatctctggtgccgacgggacatcgtgatgacccagtctccagactccctggttgtgtctctgggcgagagggccaccatcaactgcaagtccagccagagtgttttatacagctaccaacaataacaactacttagcttggtaccagcagaaaccaggacagccccctaaggtcctcatttactgggcatctacccgggagtcccggggtccctgaccgattcagaggcaggcgggtctgggacaggatttcactctcaccatcaccaactgcaggctgaagatgtgctagtttattactgtcagcaatacttatacgtcctcctctctacgttcggcggacggaccaaggtggaagactaccgaaacgtacgtgtgctgccacgtntcttgtcttacacttccttcccgctactctacgataacc

SEQ ID NO: 52474 - DNA, 521 bp, Homo sapiens
  misc_feature: GYAE6OF02I0FXY.18.11.A11.1.454.CMB.1.raw
  modified_base (208)..(208): a, c, t, g, unknown or other
  misc_feature (208)..(208): n is a, c, g, or t
  modified_base (375)..(375): a, c, t, g, unknown or other
  misc_feature (375)..(375): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttanacagctccaacaataacaactacttagcttggtaccagcagaaaccaggacagccccctaaggtcctcatttactggcatctacccgggagtccggggtccctgaccgattcagaggcagcgggtcgtggacagatttcactctcaccatcaccactgcagctgagntgtggctagtttatactgtcagctaatactatactcctctctctcgtcgcggacggacaggtagagtatacgaaacgactggtcgctcgactaccagttcctacggttcttacacttccgttcccgcctacttccgtagacctacg

SEQ ID NO: 52475 - DNA, 525 bp, Homo sapiens
  misc_feature: GYAE6OF02ID9JA.18.11.A11.1.454.CMB.1.raw
  modified_base (490)..(490): a, c, t, g, unknown or other
  misc_feature (490)..(490): n is a, c, g, or t
tcagtacgagtatgcacgaccggtgctcgatttagctacgactgcagggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaaacaataacaactacttagcttggtaccagcagaaaccaggacacgccccctaaggtcctcatttactgggcatcgtacccgggagtccggggtccctgaccgattcagaggcagcgggtctggggacagtatttcactctcaccatcaccaacctgcaggctgaagatgtggctagtttattactgtcagacaatactattagtcctcctctccgtacgttcggcggagggaccaagggtgaagataacgaaacgactgtgctgacaccgnttcctgtcttcattccttccgcctatctgactacg

SEQ ID NO: 52476 - DNA, 507 bp, Homo sapiens
  misc_feature: GYAE6OF02I3BT7.18.11.A11.1.454.CMB.1.raw
  modified_base (282)..(282): a, c, t, g, unknown or other
  misc_feature (282)..(282): n is a, c, g, or t
  modified_base (378)..(378): a, c, t, g, unknown or other
  misc_feature (378)..(378): n is a, c, g, or t
  modified_base (453)..(453): a, c, t, g, unknown or other
  misc_feature (453)..(453): n is a, c, g, or t
  modified_base (461)..(461): a, c, t, g, unknown or other
  misc_feature (461)..(461): n is a, c, g, or t
  modified_base (466)..(466): a, c, t, g, unknown or other
  misc_feature (466)..(466): n is a, c, g, or t
  modified_base (469)..(469): a, c, t, g, unknown or other
  misc_feature (469)..(469): n is a, c, g, or t
  modified_base (475)..(475): a, c, t, g, unknown or other
  misc_feature (475)..(475): n is a, c, g, or t
  modified_base (494)..(494): a, c, t, g, unknown or other
  misc_feature (494)..(494): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctggcgagagggccaccatcaactgcaagtccagccagagtgttttatacagctccaacaataacaactacttagcttggtaccagcagaaaccaggacagccccctaaggtcctcatttacngggcatctacccggggagtccggggtccctgaccgattcgagaggcagcgggtcgtggacagtattcactctcacatcaccactgcagctagaagntgtcgatagtttatacgtgtcagctaatactagtacgtcctctctctacgtcggacggaggaccaggtgagtacncgaaacgngtagngcngctacntctgtctacattcgtcccnctactctgactac

SEQ ID NO: 52477 - DNA, 554 bp, Homo sapiens
  misc_feature: GYAE6OF02INRNJ.18.11.A11.1.454.CMB.1.raw
  modified_base (208)..(208): a, c, t, g, unknown or other
  misc_feature (208)..(208): n is a, c, g, or t
  modified_base (414)..(414): a, c, t, g, unknown or other
  misc_feature (414)..(414): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttanacagctaccaacaataacaactacttagcttaggtaccagcaagaaaccaggacagccccctaaggtcctcatttactgggcatctacccgggagtccggggtccctgacccgattccgagacggcacggcgggtcgtggggacagtactttcgactctacaccatcaccaacctgccagctagacgatgtggctagtttatactncagcaatatattacgtcctcctccgtactacgttcgggacggaggaccgagtcggaagtactacgaaacgactggcggctagccaccgtaagttctcggtacttcgactttcttcccgacttatccgttacgacttaacg

SEQ ID NO: 52478 - DNA, 527 bp, Homo sapiens
  misc_feature: GYAE6OF02GODFI.18.11.A11.1.454.CMB.1.raw
  modified_base (208)..(208): a, c, t, g, unknown or other
  misc_feature (208)..(208): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttanacagctccaacaataacaactacttagcttggtaccagcagaaaccaggacagccccctaaggtcctcatttactgggcatctacccgggagtccgggtccctgaccgattcagaggcagcgggtctgggacagtatttcactctcaccatcaccaacctgcaggctagaagatgtgctagttttactactgtcagcaatactatcgtcctctctcacgtcggcgacgggaccagggtggagtactacgaaacgacgtgtcggctagcaacccgtatccttgtccttacacttccttcccgcctatcctacgacctaac

SEQ ID NO: 52479 - DNA, 516 bp, Homo sapiens
  misc_feature: GYAE6OF02HE0XZ.18.11.A11.1.454.CMB.1.raw
  modified_base (365)..(365): a, c, t, g, unknown or other
  misc_feature (365)..(365): n is a, c, g, or t
  modified_base (388)..(388): a, c, t, g, unknown or other
  misc_feature (388)..(388): n is a, c, g, or t
  modified_base (433)..(433): a, c, t, g, unknown or other
  misc_feature (433)..(433): n is a, c, g, or t
  modified_base (475)..(475): a, c, t, g, unknown or other
  misc_feature (475)..(475): n is a, c, g, or t
  modified_base (482)..(482): a, c, t, g, unknown or other
  misc_feature (482)..(482): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcaagaaaccaggacacgccccctaaggtccctcatttacgtgggcatccgtacccggggagtcccggggtccctggaccgattccgagaggcaggcgggtctgggacagatttcactcncacatcaccactgcaggctgaanatgtgctagtttatactgcagacaaatactattacgtcctactcnctacgtcggcgaggaccaggtgagactacaaacgactgtgcncgcacgntctgtcttcattccttcccgctatctagactacg

SEQ ID NO: 52480 - DNA, 540 bp, Homo sapiens
  misc_feature: GYAE6OF02HDY9C.18.11.A11.1.454.CMB.1.raw
  modified_base (283)..(283): a, c, t, g, unknown or other
  misc_feature (283)..(283): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttgtaccagcagaaaccaggacacgccccctaaggtcctcatttacnggcatccgtacccgggagtccggggtccctgaccgattcagaggcagcgggtctgggacagtactttcactctcaccatcaccaactgcaggctagaagatgtgctaagttttactactgtacagtacaatactagtactcctacctctctaccggttcggcggagggtaccagggtgatactacgaaacggactgtagctagacacctatcctgtcctctacgttcccttcccggcctaagtccctactacttacg

SEQ ID NO: 52481 - DNA, 659 bp, Homo sapiens
  misc_feature: GYAE6OF02G1KO9.18.11.A11.1.454.CMB.1.raw
  modified_base (403)..(403): a, c, t, g, unknown or other
  misc_feature (403)..(403): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagtagttgttttatacagcctaccaacaactaacaacttacttagcttaggtaccagacaagaaccaggaccacgacccctacggtcctactacttacgtggcacgtccgtacccgggacggtcccgggtccctacgaccgtatcgagacggcgacggcggtcgtagggactagtactttcactcctacaccactaccaccaaccgngacgagcgtagaacgtagtggtggtacgttagttttaacttcgttacgtaccgtaatactaaactacttacttaccgttcccttacctccgtccgtaccgggtttccgggaacgggaccgggtaacggaaggtaggaacggtaacgtacgtaaaccggtaagtcggtacggtccgtacgcctaccgtacttccgttaccttcctttcccgtaccttccctttaccccgccttcctaacgttcgtaaccgttacccg

SEQ ID NO: 52482 - DNA, 613 bp, Homo sapiens
  misc_feature: GYAE6OF02G0KUR.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagacctcccgtggttgtgtctcgtgggcgaggacgggccaccatcaactgacaacgtccagccagagttgttttatacagcctaccaaacaaactaaaccaacttacttagtcttacggtaaccagcaacgaaaccaggacacgaccccctaaggtcctctatttacgtgggcactccgtacccggggacggtcccggggtccctcggaccgtattcgaggaggcaggcgggtcgtgggacagtatttcactctcaccatccaaccaacctgacacggctagaagtagtggtcggactaagttttaacttacgtgtacagactaaatactaattacgtccctcttctacgtacggttccgggacggacgggaaccgagggtggagtactaacgaaacgtacgtggtcgcgtcgacctaccgtactcgttcgttccttactaccttccttcccgactactctacgacttaaccg

SEQ ID NO: 52483 - DNA, 513 bp, Homo sapiens
  misc_feature: GYAE6OF02IVV4M.18.11.A11.1.454.CMB.1.raw
  modified_base (208)..(208): a, c, t, g, unknown or other
  misc_feature (208)..(208): n is a, c, g, or t
  modified_base (283)..(283): a, c, t, g, unknown or other
  misc_feature (283)..(283): n is a, c, g, or t
  modified_base (383)..(383): a, c, t, g, unknown or other
  misc_feature (383)..(383): n is a, c, g, or t
  modified_base (477)..(477): a, c, t, g, unknown or other
  misc_feature (477)..(477): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttanacagctccaacaataacaactacttagcttggtaccagcagaaaccaggacagccccctaaggtcctcatttacngggcatcgtacccgggagtccggggtccctggaccgattcagaggcaggcgggtctgggacagtatttcactctcaccatcaccaacctgcagctgaagntgtgactagtttatactgtcagcaatactatacgtcctctctcacgttcggcggaggaccaggtgagacgtacaaacgactgagctgccacctntctgttctctactccttccgccatctcgtactaacg

SEQ ID NO: 52484 - DNA, 594 bp, Homo sapiens
  misc_feature: GYAE6OF02IT1UD.18.11.A11.1.454.CMB.1.raw
  modified_base (449)..(449): a, c, t, g, unknown or other
  misc_feature (449)..(449): n is a, c, g, or t
  modified_base (525)..(525): a, c, t, g, unknown or other
  misc_feature (525)..(525): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctaccaacaataacaactacttagcttggtaccagcagaaaccaggacacgccccctaaggtcctcattactggcatcgtacccgggagtccggggtccctggaccgattcgagaggccagcgggtctgggacagtatttcactctcacctataccaccaaacctgacacggctagaagattggtggactaagtttaacttacgtgtacagctaaatactattaacgtccttccctntcctacgttccgggcggaacggaccgaagggtggaagtacgtaccaaaacggtactggtagccttagccaaccgtnttaccgtacgttccctttacgacctttccgtttaccccgtaccgtacttaccgttacggtaacttaccg

SEQ ID NO: 52485 - DNA, 717 bp, Homo sapiens
  misc_feature: GYAE6OF02ITCN6.18.11.A11.1.454.CMB.1.raw
tcagtacgagtatgcacgaccggtgctcgatttagctacgactgcagggggcagcaagatggtgttgcagacccaggtcttcatttctctgttgctctggatctctggtgccgacggggacatcgtgatgacccagtctccagactccctggttgtgtctctgggcgagagggccaccatcaactgacaagtccagccagagtgttttatacagctaccaacaataacaactacttagcttggtaccagcaagaaaccaggacacgcccccctaaggtcctactatttacgtcgggacacgttccgtacccggggacggttcccgggggtcccctacggaacccgtattccgaaggacgggccgacggtcggggtcgtcggggaaccaggtatttccaaccttcctaccgaaccctattacccaaaccctaaaccttgaccgaacgggtcctaggaaacgtagttcggtacgggtactaagttttaacttacgtggttacaagtactaaacttacgtacttacgtcccttccttctaccgtaccggttcgggacgggtaacggggtaacccgtaagggtacggacgtaacgtaaccgtaaaacggtaccttaggtacgggtaccgtcgaacccgtaccgaagtttacgttacgtttccttacccgtaacgtttccccttacccggaacccttacttcccggtacgttaacctaaccg

SEQ ID NO: 52486 - DNA, 522 bp, Homo sapiens
  misc_feature: GYAE6OF02F9SRD.18.11.A11.1.454.CMB.1.raw
  modified_base (349)..(349): a, c, t, g, unknown or other
  misc_feature (349)..(349): n is a, c, g, or t
  modified_base (373)..(373): a, c, t, g, unknown or other
  misc_feature (373)..(373): n is a, c, g, or t
  modified_base (377)..(377): a, c, t, g, unknown or other
  misc_feature (377)..(377): n is a, c, g, or t
  modified_base (473)..(473): a, c, t, g, unknown or other
  misc_feature (473)..(473): n is a, c, g, or t
tcagtacgagtatgcacgaccggtgctcgatttagctacgactgcagggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatcgtaccgggagtccggggtcctgaccgattcagagcagcggtctggacagattcactcncacatcaccaactgcagctagaanatgngctagtttatactgtcagactaatactatacgtcctctctctcgttcggcggtaggaccaggtgaagtataccgaaagacgtgcgctgacctacgntcttacgtcttactacgttccttcccggactacttccgtacgactaacg

SEQ ID NO: 52487 - DNA, 500 bp, Homo sapiens
  misc_feature: GYAE6OF02HT8M4.18.11.A11.1.454.CMB.1.raw
  modified_base (208)..(208): a, c, t, g, unknown or other
  misc_feature (208)..(208): n is a, c, g, or t
  modified_base (461)..(461): a, c, t, g, unknown or other
  misc_feature (461)..(461): n is a, c, g, or t
  modified_base (470)..(470): a, c, t, g, unknown or other
  misc_feature (470)..(470): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttanacagctccaacaataacaactacttagcttggtaccagcagaaaccaggacagccccctaaggtcctcatttactgggcatctacccgggagtccggggtccctgaccgattcagaggcagcgggtctgggacagtattcactctcaccatcaccaactgcagctgaagatgtggctagtttatactgtcagctaatactattacgtcctctctcacgttcggcggaggaccaggtgagatacaaacgactgngctgcaccntctgtcttacattcctccgcatctgactac

SEQ ID NO: 52488 - DNA, 592 bp, Homo sapiens
  misc_feature: GYAE6OF02H9JKE.18.11.A11.1.454.CMB.1.raw
  modified_base (207)..(207): a, c, t, g, unknown or other
  misc_feature (207)..(207): n is a, c, g, or t
  modified_base (284)..(284): a, c, t, g, unknown or other
  misc_feature (284)..(284): n is a, c, g, or t
  modified_base (338)..(338): a, c, t, g, unknown or other
  misc_feature (338)..(338): n is a, c, g, or t
  modified_base (438)..(438): a, c, t, g, unknown or other
  misc_feature (438)..(438): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagaggccaccatcaactgcaagtccagccagagtgttttanacagctccaacaataacaactacttagcttggtaccagcaagaaaccaggacagccccctaaggtcctacatttacngggacatcgtacccgggagtcccgggtcctggaccattcagagcaggcggtacnggacagactttcactctcaccatccaaccaactgcgacggctagaagctagtggactagttttaactactgtcagacaattactatacgtccctcctacnctacgtcggcggaacggggtaaccaagggtcgtaagacttaaccgaaaacggtaaacgttggtacgggaccttcgaccgaacccctaagttcccttggttaccctttccagtttccccttaccccggcccttaaattcctacgtaactttaacg

SEQ ID NO: 52489 - DNA, 619 bp, Homo sapiens
  misc_feature: GYAE6OF02GJZP9.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagacctccctggttgtgtctctgggcgagagggccaccatcaactgcaagtccagccagagtgttttatacagcctaccaaacaataacaactacttagcttggtaccagcagaaaccaggacacgccccctaaggtcctctatttactgggcatacgtacccgggtaggtaccggggtcctacgaccgtattcgagaggcaggcgggtcgtgggacagtatttacactctcacctactaccaacccaaacctgaccgaggctagaaacgtgtgtgacctagttttactactgtacatacgtaatactatacgtcccttactcctacgtaccggttcgggacggaacgggaccgaagggtcggaagtaactaaccaaaacgtaacgtggtacgtcgtacgaccaaccgtacttccttaccggttcttaccgtactttcccttaccccggtacctacgttaccgtacgtaacctaaccgg

SEQ ID NO: 52490 - DNA, 498 bp, Homo sapiens
  misc_feature: GYAE6OF02GVW1F.18.11.A11.1.454.CMB.1.raw
  modified_base (284)..(284): a, c, t, g, unknown or other
  misc_feature (284)..(284): n is a, c, g, or t
  modified_base (469)..(469): a, c, t, g, unknown or other
  misc_feature (469)..(469): n is a, c, g, or t
  modified_base (488)..(488): a, c, t, g, unknown or other
  misc_feature (488)..(488): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacacgccccctaaggtcctcatttacngggcatctacccgggagtccggggtccctggaccgattcagagcagcgggtctgggacagatttcactctcaccatcaccaactgcaggctgaacgatgtgctaagtttatactgtcagcaatactatacgtcctctctctacgttcggcgaggaccaggtgagatacaaagactgcgctgcacntctgtctctatcctccgcntctgactacg

SEQ ID NO: 52491 - DNA, 849 bp, Homo sapiens
  misc_feature: GYAE6OF02IL1UV.18.11.A11.1.454.CMB.1.raw
  modified_base (208)..(208): a, c, t, g, unknown or other
  misc_feature (208)..(208): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctggcgagaggccaccatcaactgacaagtccagccagagttgttttanacagcctaccaaacaaataacaactacttagcttggaccagcaagaaaccaggaccacgaccccctaaggtcctactatttacgtcgggacctacgttccgtaaccccggggtacggttcccggggggttacccctacggacccggtaacgtttccgaacgggtaacgggccgaagggtccggggttaccgtacgggggtaacctaggttaacgtttttacccgaacctttccgtaccctaacccgtaacttaccctaaaccccgtaaaacccgttcggtacccgtaaacggggtcccttaagggaaaacgttaacggtttacggggttacgggtaacctttaaagggttttttaaactttaaacccggttcgggttttaaacccgaaaggtaaccttaaaacggtttaaacccttaaacgtttaacccggtttccccttacccgtttaccgttacccgttaacccgggtttccggggaacccggggtaacggggtaaacccgtaaggggttaacggtaacgtaacgttaaaccgtaaaacggtaacgttacgggtccggtacttacgaccctaccgtattacccgtggttaccttcgacctttcccgttacccgaccttacgtacctacggaaccttacg

SEQ ID NO: 52492 - DNA, 541 bp, Homo sapiens
  misc_feature: GYAE6OF02HLFIN.18.11.A11.1.454.CMB.1.raw
  modified_base (387)..(387): a, c, t, g, unknown or other
  misc_feature (387)..(387): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacacgccccctaaggtcctcatttactgggcatcctacccgggagtccggggtccctgaccgattcaggagcaggcgggtctgggacagatttcactctcaccatcaccaacctgcaggctagaagatgnggactagttttatactgtcagcaatactatacgtcctcctctctacggttcggcggaggaccgaagggtgagtactacgaaacgactgtcgcgtacgccaccgtatccgttgttccttacgtacttcccgttacccgctactctacgactaacg

SEQ ID NO: 52493 - DNA, 544 bp, Homo sapiens
  misc_feature: GYAE6OF02IN1XV.18.11.A11.1.454.CMB.1.raw
  modified_base (211)..(211): a, c, t, g, unknown or other
  misc_feature (211)..(211): n is a, c, g, or t
  modified_base (282)..(282): a, c, t, g, unknown or other
  misc_feature (282)..(282): n is a, c, g, or t
  modified_base (399)..(399): a, c, t, g, unknown or other
  misc_feature (399)..(399): n is a, c, g, or t
  modified_base (492)..(492): a, c, t, g, unknown or other
  misc_feature (492)..(492): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagttgtttttaanacagctccaacaataacaactacttagcttggtaccagcaagaaaccaggacacgccccctaaggtcctanatttactgggactactccgtacccgggagtcccggggtccctcgaccgattcgagaggcaggtccgggtctgggacagtatttcactctcacactccaccactgacaggctagaagntgtgctagtttatctgtacagactaatactatacgtcctcctctacgtcgtcggcgaggaccaggtgacactacgaaacgtacgtgtacgctnaccgactctctcgttacttccaattccctacccgtatactctagacctaacg

SEQ ID NO: 52494 - DNA, 527 bp, Homo sapiens
  misc_feature: GYAE6OF02G9H3B.18.11.A11.1.454.CMB.1.raw
  modified_base (208)..(208): a, c, t, g, unknown or other
  misc_feature (208)..(208): n is a, c, g, or t
  modified_base (283)..(283): a, c, t, g, unknown or other
  misc_feature (283)..(283): n is a, c, g, or t
  modified_base (383)..(383): a, c, t, g, unknown or other
  misc_feature (383)..(383): n is a, c, g, or t
  modified_base (480)..(480): a, c, t, g, unknown or other
  misc_feature (480)..(480): n is a, c, g, or t
  modified_base (522)..(522): a, c, t, g, unknown or other
  misc_feature (522)..(522): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttanacagctccaacaataacaactacttagcttggtaccagcagaaaccaggacagccccctaaggtcctcatttacngggcatccgtacccgggagtcccggggtccctgaccgattcagaggcaggcgggtctgggacagatttcactctcaccatcaccaactgcaggctagaanatgtggctagtttacttactgtcagtcaaattctatacgtcctcctctacacgttcggcggacgggaccaggtcggatagtacaaacgactggtcgntcgcacctatcctgtcttacgattccgttcccgctactcctnactac

SEQ ID NO: 52495 - DNA, 596 bp, Homo sapiens
  misc_feature: GYAE6OF02I745T.18.11.A11.1.454.CMB.1.raw
  modified_base (363)..(363): a, c, t, g, unknown or other
  misc_feature (363)..(363): n is a, c, g, or t
  modified_base (377)..(377): a, c, t, g, unknown or other
  misc_feature (377)..(377): n is a, c, g, or t
  modified_base (391)..(391): a, c, t, g, unknown or other
  misc_feature (391)..(391): n is a, c, g, or t
  modified_base (437)..(437): a, c, t, g, unknown or other
  misc_feature (437)..(437): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagttgttttatacagctaccaaacaataaacaactacttagcttggtaccagacaagaaaccaggacacgccccctaaggtcctactattactgggacactaccgacccgggagtcccgggtccctgaccacttcagaggcagcggtctggacagattcactccncacatacaccaacngacaggctagaagntgcgtactagttttatacgtgacagactaatactatacgtccctcnctcgtacggttcgggacggacgggtaacccagggtcggaacgtacgtaaacgaaaccgtatcgggtacggtcctacgtaccaaccggttactacgttcggttaccctttacaaccgtttcccgttaccccgtacccaatttcccgtacgtacctaaccg

SEQ ID NO: 52496 - DNA, 557 bp, Homo sapiens
  misc_feature: GYAE6OF02H9UB3.18.11.A11.1.454.CMB.1.raw
  modified_base (210)..(210): a, c, t, g, unknown or other
  misc_feature (210)..(210): n is a, c, g, or t
  modified_base (288)..(288): a, c, t, g, unknown or other
  misc_feature (288)..(288): n is a, c, g, or t
  modified_base (477)..(477): a, c, t, g, unknown or other
  misc_feature (477)..(477): n is a, c, g, or t
  modified_base (508)..(508): a, c, t, g, unknown or other
  misc_feature (508)..(508): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagttgttttaanacagctccaaacaataacaactacttagcttggtaccagcaagaaaccaggacacgccccctaaggtcctcatttacngggcatcctacccgggagtcccggggtccctaggaccgattcagaggcaagcgggtctgggacagactttcgactctcaccatcaacctaacctgcacggctagaagatgtggctaagttttatactgtcacgactaattactactacgttcctcctctcaccgttcgggcgacgggaccgtagagggnaagtacaaacgtactcgtgctcgacaccgtnttcctttctctacttcccgtcccgctacttcgtacgacctagttacccg

SEQ ID NO: 52497 - DNA, 532 bp, Homo sapiens
  misc_feature: GYAE6OF02HR1Q0.18.11.A11.1.454.CMB.1.raw
  modified_base (285)..(285): a, c, t, g, unknown or other
  misc_feature (285)..(285): n is a, c, g, or t
  modified_base (353)..(353): a, c, t, g, unknown or other
  misc_feature (353)..(353): n is a, c, g, or t
  modified_base (496)..(496): a, c, t, g, unknown or other
  misc_feature (496)..(496): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagttgttttatacagctccaacaataacaactacttagcttggtaccagcagaaaccaggacacgccccctaaggtcctcatttacnggcatctacccgggagtccggggtcctgaccgatcagaggcagcgggtctgggacagactttcactcncacatcacaacctgcagctagaacgatggtgctaagttttatactgtacagtacaatactatacgttccctcttacctcgacggttcgggcggaacgggaccgtaagggtcggagactacgaaacgactgtaggctgcacgtntcctgtacttcacttccttccgcctatcctagacta

SEQ ID NO: 52498 - DNA, 789 bp, Homo sapiens
  misc_feature: GYAE6OF02I980E.18.11.A11.1.454.CMB.1.raw
  modified_base (210)..(210): a, c, t, g, unknown or other
  misc_feature (210)..(210): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctcgtgggcgagagggccaccatcaactgcaagtccagccagagttgttttanacagctaccaaacaataacaactacttagcttggtaccagacaagaaaccaggacacgacccccgtaaggtcctacgtactttacgtgggactatccgtaacccggggacggtccccggggtccctaggacccgtagttaccgaggtacggcgacggccggggtacgtacggggaacctaggtacttttccgaaccgtttcctaccgtaacccgtaacttacccgaaaccctaaacccgtcggaccgtaacggggtactacgggaaagtacgtgggtacgggtacttaacggtttttaagttacgtacgttacgaacggaacctaaagttaccgttaagttaccgttcccttcccgttaccttaccggtacggttaccggggtaccgggaacgggtaacccgtaagggttcgggaaaccgttaacgttaacccgaaaaaccgggttaaccggttacggtacgggtacctacgtacccgtaacccgtaacgttacccggttacggtttaccccttaccgttaccgttaccccgttttcccccggacctttaacggtaccctttacggaccctttaaccgg

SEQ ID NO: 52499 - DNA, 523 bp, Homo sapiens
  misc_feature: GYAE6OF02GWXRG.18.11.A11.1.454.CMB.1.raw
  modified_base (385)..(385): a, c, t, g, unknown or other
  misc_feature (385)..(385): n is a, c, g, or t
  modified_base (428)..(428): a, c, t, g, unknown or other
  misc_feature (428)..(428): n is a, c, g, or t
  modified_base (458)..(458): a, c, t, g, unknown or other
  misc_feature (458)..(458): n is a, c, g, or t
  modified_base (482)..(482): a, c, t, g, unknown or other
  misc_feature (482)..(482): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccgggtccctgaccgattcagaggcagcgggtctgggacagatttcactctcaccatcaaccaacctcgcaggctgaagatggnggtctagtttaattactgtcagacaatactaatcgtcctctcnctcgttcggcggacgggacagggtgagtanacaaacgactgtagctgccaccgntctgtacttcattcccttcccgcctactctacgtactaccg

SEQ ID NO: 52500 - DNA, 551 bp, Homo sapiens
  misc_feature: GYAE6OF02I7JOW.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcgagaggcagcgggtctgggacagatttcgactctcacctactcaacccaacctgacaggctagaagatggtcggactagttttatactgtccagcaaatctatacgtcctacctctctacgttcggcggagaccgtaggtggaagactacaaaacgactgggtagctgaccaccgattaccttgtcctttctaccttccttccccgacctactccttacgacttaacccg

SEQ ID NO: 52501 - DNA, 532 bp, Homo sapiens
  misc_feature: GYAE6OF02H1I2F.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataaacaactacttagcttggtaccagcagaaccaggacagccccctaaggtcctcatttactgggcatctacccgggagtccggggtcctgaccgattcagaggcagcgggtctgggacagatttcactctcaccatcaaccaactgcaggctgaagatgtgctaggttttatacgtgtacagcaatactaatacgtccttcctctcaccggttcggcggtaacgggacaagggtgagatcaaacgactggtgactgaccaccagtcctagtccttacgattccttccccggctacgtcctagacctaacg

SEQ ID NO: 52502 - DNA, 526 bp, Homo sapiens
  misc_feature: GYAE6OF02F5H2H.18.11.A11.1.454.CMB.1.raw
  modified_base (465)..(465): a, c, t, g, unknown or other
  misc_feature (465)..(465): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacacgccccctaaggtcctcatttactgggcatctacccgggagtccggggtccctgaccgattcagaggcaggcgggtctgggacagatttcactctcacatcaccaacctgcaggctagaagatgtgctagtttatactgtcagcaatactatagtcctcctctcacgttcggcggaggaccaagggtggagatacaaacgactgnggtctgacaccgtaatcgtacgtccttactacttcccttcccgcctactctacgactaacg

SEQ ID NO: 52503 - DNA, 519 bp, Homo sapiens
  misc_feature: GYAE6OF02H2DJJ.18.11.A11.1.454.CMB.1.raw
  modified_base (208)..(208): a, c, t, g, unknown or other
  misc_feature (208)..(208): n is a, c, g, or t
  modified_base (389)..(389): a, c, t, g, unknown or other
  misc_feature (389)..(389): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttanacagctccaacaataacaactacttagcttggtaccagcaagaaaccaggacacgccccctaaggtccctcatttactgggcatccgtacccgggaggtccggggtccctggaccgtattcagaggcaggcgggtctgggacagtatttcactctcaccatcaccaacctgcaggctgaantgtggctagtttatactgtcagcaatactatacgtcctctctcacgttcggacggaggaccaagggtgaagatacaaacgactgtgctgacacctatctgtcttcacttccttcccgctatctcgactac

SEQ ID NO: 52504 - DNA, 580 bp, Homo sapiens
  misc_feature: GYAE6OF02IU264.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctggcgagagggccaccatcaactgcaagtccagccagagtgtttatacagctccaacaataacaactacttagcttggtaccagcaagaaacaggacacgcccctaaggtcctcatttactgggctactccgtacccgggacgtccggggtcccctggaccgattcaggaggcgaggcgggtcgtgggacagtactttcactcctcaccatccaaccaacctcgcacggctagaagtagtcgtaggtccttaagttttaattcgtgttacaagtactaaatacttaattacgtccctccttctcccgtacggttccgggaggtacggaacgtagggtacgagtaacgttaacgaaacgtacgtgtcgatcgactaccgattcctgttctacttactccctccctactactactcataacg

SEQ ID NO: 52505 - DNA, 597 bp, Homo sapiens
  misc_feature: GYAE6OF02HWW69.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagttgttttatacagctccaaacaataacaactacttagcttggtaaccagcaagaaaccaggacacgccccctaaaggtcctcatttactgggactatccgtaccggggagttcccgggggtccctggaccgtattcaggaggcgagcgggtctgggaccaggtatttccactctacaccatcaaccaacctgcaggctagaagtctgtacggctagttttatactgtacagactaagtactatacgtcctctctacgtcgttcgggcggggtaccaaggtcggagtacgtacgaaacgtacgtgtacggtctacgacgtacctacttccgttcgttacttaccgtacgttcccttaccccggtacctactttccgtaggtaccctaagtttaacccg

SEQ ID NO: 52506 - DNA, 613 bp, Homo sapiens
  misc_feature: GYAE6OF02HVSVE.18.11.A11.1.454.CMB.1.raw
  modified_base (210)..(210): a, c, t, g, unknown or other
  misc_feature (210)..(210): n is a, c, g, or t
  modified_base (315)..(315): a, c, t, g, unknown or other
  misc_feature (315)..(315): n is a, c, g, or t
  modified_base (406)..(406): a, c, t, g, unknown or other
  misc_feature (406)..(406): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagacctccctggttgtgtctctgggcgagagggccaccatcaactgcaagtccagccagagttgttttanacagcctaccaaacaaataaaccaacttacttagcttaggtaccagcaagaaaccaggacacgccccctaaggtcctcatttactgggcatccgtaacccggggngtcccgggggtccctggacctattccgagaggcaggcgggtctgggacagtatttcactctacaccatcaaccaacctgcaggctagaagntgtgctaagtttattactgtacagactaattactaattacgtccctccttactaccgtaccggttccggagggacgggtaaccgtaaggggtggaagtacgtaacgaaacgtacgtagggtcgaccgtagaccgacctcgttaccttacggtctttaccgttacttccccgtttacccggacctacgtttcctacggtaacctaacg

SEQ ID NO: 52507 - DNA, 723 bp, Homo sapiens
  misc_feature: GYAE6OF02II9QU.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagttgttttatacagctaccaaacaaataacctaactacttagacttgtaccagacaagaaaaccacggacaacgcccccctaaaggtccctacaacttttacgtcgggcaatcccgtaacccggggacggttccggggtccctcggaccgaagttccaagacggcaggcgggtcgtacgggacaggtactttccgacttccgtaccacctaataccaaaccctaaaccgtgaccaagggctaggaaacgtagttggtacggtaccttaggtttttaacttacgttacgtactaaccgtactaaactttaacgttaattaaccgtttcccttaccccttcgttaccccgtaaccggggtttaccgggaacgggaaccggggttaaacccgtaaagggtacgggaaacgtaacgtaaaccgtaaaaaccggaacgttagggtacgcgttacgaccctaaacgcgttaccttacgttctttaccacgtttccccgttaccgccctaatccgttaccgtaactaaccg

SEQ ID NO: 52508 - DNA, 573 bp, Homo sapiens
  misc_feature: GYAE6OF02HCRZN.18.11.A11.1.454.CMB.1.raw
  modified_base (361)..(361): a, c, t, g, unknown or other
  misc_feature (361)..(361): n is a, c, g, or t
  modified_base (387)..(387): a, c, t, g, unknown or other
  misc_feature (387)..(387): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcaagaaaccaggacacgccccctaaggtccctcatttactgggcatcgtacccgggagtccgggtccctgaccgattcagagcagcgggtctgggacagatttcactctccacancaccaacctgcaggctagaagatggngctagtttatacgtgcagcaattactattacgtccctcctctcgtacgttcgggacggacgggtaccgaagggtggaatacgtaaccgaaaacgacgttggtacggtcgtacgacctaacctagttccttacgttaccttacctaacttccccttaccccgacctaacgtcctacgtacttaaccg

SEQ ID NO: 52509 - DNA, 510 bp, Homo sapiens
  misc_feature: GYAE6OF02GN8MK.18.11.A11.1.454.CMB.1.raw
  modified_base (387)..(387): a, c, t, g, unknown or other
  misc_feature (387)..(387): n is a, c, g, or t
  modified_base (472)..(472): a, c, t, g, unknown or other
  misc_feature (472)..(472): n is a, c, g, or t
  modified_base (480)..(480): a, c, t, g, unknown or other
  misc_feature (480)..(480): n is a, c, g, or t
  modified_base (505)..(505): a, c, t, g, unknown or other
  misc_feature (505)..(505): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcaagaaaccaggacagccccctaaggtcctcatttactgggcatccgtacccggggagtccggggtccctgaccgatcagaggcaggcggtcgtgggacagtatttcactctcaccatcaaccaactgacaggctagaagntgtgactagtttatactgtcagactaatactatacgtccctctctcacgttcggcggaggaccagggtgagtatacaaacgatgngctgcacntctgtctcattcctccgctatctanactac

SEQ ID NO: 52510 - DNA, 552 bp, Homo sapiens
  misc_feature: GYAE6OF02HDUWT.18.11.A11.1.454.CMB.1.raw
  modified_base (239)..(239): a, c, t, g, unknown or other
  misc_feature (239)..(239): n is a, c, g, or t
  modified_base (287)..(287): a, c, t, g, unknown or other
  misc_feature (287)..(287): n is a, c, g, or t
  modified_base (347)..(347): a, c, t, g, unknown or other
  misc_feature (347)..(347): n is a, c, g, or t
  modified_base (371)..(371): a, c, t, g, unknown or other
  misc_feature (371)..(371): n is a, c, g, or t
  modified_base (376)..(376): a, c, t, g, unknown or other
  misc_feature (376)..(376): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagttgttttatacagctaccaaacaaataacaactacttancttggtaccagcagaaaccaggacagccccctaaggtcctcatttacnggcatcctacccgggagtcccgggtccctgaccgattcagagcagcgggtctgggacagntttcactctcaccatcaaccactncagcngaagatgtggctagtttatactgtcagcaatactatacgttccctctctcacggttcggacggtacgggaaccctagggtacgagaacgttacaaaccggaattcggtaggccttagacctaacctaatccttcgttaccttcaacttcccttcccgcctactctacgacttaacg

SEQ ID NO: 52511 - DNA, 563 bp, Homo sapiens
  misc_feature: GYAE6OF02IMIJ6.18.11.A11.1.454.CMB.1.raw
  modified_base (211)..(211): a, c, t, g, unknown or other
  misc_feature (211)..(211): n is a, c, g, or t
  modified_base (356)..(356): a, c, t, g, unknown or other
  misc_feature (356)..(356): n is a, c, g, or t
  modified_base (513)..(513): a, c, t, g, unknown or other
  misc_feature (513)..(513): n is a, c, g, or t
  modified_base (524)..(524): a, c, t, g, unknown or other
  misc_feature (524)..(524): n is a, c, g, or t
tcagtacgagtatgcacgaccggtgctcgatttagctacgactgcagggggcagcaagatgggtgttgcagacccaggtcttcatttctctgttgctctggatctctggtgccgacggggacatcgtgatgacccagtctccagactccctggttgtgtctcgtgggcgagagggccaccatcaactgcaagtccagccagagtgttttanacagcctaccaaacaataacaactacttagcttggtaccagcagaaaccaggacacgcccccctaaggtccctcatttactgggcatcctaccccggggaggttcccggggtcccctggaccgtattcaggaggcaggcgggtcngggacagtatttcactctccaccatccaaccaacctgcaggctagaagatggtggactaggttttattacgtgtcagacaattactaattacgtccctccttctctacggttcgggcggagggaccgagggtggaagataccgaaacgactggtcgntcgacctaccntcctgtacttcattccttcccgcctatcctagacctacg

SEQ ID NO: 52512 - DNA, 773 bp, Homo sapiens
  misc_feature: GYAE6OF02HT041.18.11.A11.1.454.CMB.1.raw
  modified_base (221)..(221): a, c, t, g, unknown or other
  misc_feature (221)..(221): n is a, c, g, or t
  modified_base (327)..(327): a, c, t, g, unknown or other
  misc_feature (327)..(327): n is a, c, g, or t
tcagtacgagtatgcacgaccggtgctcgatttagctacgactgcaggggcgagacaagactggtgttgcacgacccaggtcttcatttctctgttgctctggatctctggtgccgacttgggacatcgtgatgacccagtctccagactccctggttgtgtctcgtgggcgagacgggccaccatcaactgacaacgtccagccgagtagttgttttaanacacgtcctaccaaacaaactaacctaacttacgttacgtcctttaggaaccagtacaacgaaaccgaggaaccacggaccccctaaggtcctactacgtttacgngggactacgttaccggtaccggggacggttcccggggtccctaggtaccgtattacgagggacggccgtaggtacggtacgtacgggaactagtacgtttaccacgttaccgtaccaacctaactaccaacccgtaaccgtgaaccgtacggtaccttaaggaaacgtacgttacgggtacggtaacctttaagttttaaccgttacgtacgtaaccgaacgtaaccttaaacttaaccgttaacgtacggttcccttacccgttaccgtaccgtaaccggggtttccgggaacgggtaacgggtaaccgaagggttacggaactaacgtaacccggaaacggtacgtttcggacggtaccgtacgacccgtaactagttccgttaaggttcctttaaccgtacctttccccggtacccgtactaaccgttcgtaccgtaacccgg

SEQ ID NO: 52513 - DNA, 534 bp, Homo sapiens
  misc_feature: GYAE6OF02G6PVI.18.11.A11.1.454.CMB.1.raw
  modified_base (490)..(490): a, c, t, g, unknown or other
  misc_feature (490)..(490): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctggaccgattcagaggcaggcgggtctggggacagatttcactctcaccatcaccaacctgacaggctagaagatgtggctagtttattactgtcagacaaatactattacgtcctcctctccacgttcggcggaggaccgaggtgagactacgaaacgtacgtgtagctagctaccgnttccgtgttccttctacttccgttcccgcctatcctagactaac

SEQ ID NO: 52514 - DNA, 521 bp, Homo sapiens
  misc_feature: GYAE6OF02FJLS1.18.11.A11.1.454.CMB.1.raw
  modified_base (470)..(470): a, c, t, g, unknown or other
  misc_feature (470)..(470): n is a, c, g, or t
  modified_base (515)..(515): a, c, t, g, unknown or other
  misc_feature (515)..(515): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccgggtccctgaccgattcagaggcagcgggtctgggacagatttcactctcaccatcaccaactgcaggctgaacgatgtggctagtttatactgtcagcaatactatagtcccttcctctcacgttcggcggagggaccgaaggtggaagataccgaaacgtactgngctagcaccgatctgtccttacattccttacccgcctactcgtanactacg

SEQ ID NO: 52515 - DNA, 539 bp, Homo sapiens
  misc_feature: GYAE6OF02GTM0I.18.11.A11.1.454.CMB.1.raw
  modified_base (283)..(283): a, c, t, g, unknown or other
  misc_feature (283)..(283): n is a, c, g, or t
  modified_base (337)..(337): a, c, t, g, unknown or other
  misc_feature (337)..(337): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagttgttttatacagctccaacaataacaactacttagcttggaccagcagaaaccaggacagccccctaaggtcctcatttacngggcatcctacccgggagtcccggggtccctgaccgattcagagcagcgggtcngggacagtatttcactctcaccatcaccaactgcaggctgaagatgtgctagttttatactgtcagcaatactatacgtcctcctctcgacgttcggcggaggaccaggtgagatacgaaacgtactgtacggctacgctaccattccttgttcctttaccgtaccttttccccgacctattcctagaccttacttaacccg

SEQ ID NO: 52516 - DNA, 554 bp, Homo sapiens
  misc_feature: GYAE6OF02H7BQ0.18.11.A11.1.454.CMB.1.raw
  modified_base (495)..(495): a, c, t, g, unknown or other
  misc_feature (495)..(495): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgtttttatacagctccaacaataacaactacttagcttggtaccagcaagaaaccaggaccacgaccccctaaggtcctcatttactgggcatccgtacccgggagtccggggtcctggaccgattcgagaggcaggcgggtctgggacagtatttccactctcaccatacacccaacctgaccaggctagaagatagtggactagttttatacgtgtacaagctaatactattactcctctctctacggttcggcggacggaccgtaggtggaagactacgaaacgacgtagngcagacacctgttcctagttccttacgattcccttcccgcctaactcctacgactaacg

SEQ ID NO: 52517 - DNA, 502 bp, Homo sapiens
  misc_feature: GYAE6OF02FL3FG.18.11.A11.1.454.CMB.1.raw
  modified_base (498)..(498): a, c, t, g, unknown or other
  misc_feature (498)..(498): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgtggcagtttatactgtcagcaatactatagtcctcctctcacgttcggacggaggaccaagggtgagactacaaacgaactgtgctgcaccatctgtcttcatcttcccgcatctnacta

SEQ ID NO: 52518 - DNA, 504 bp, Homo sapiens
  misc_feature: GYAE6OF02GPK17.18.11.A11.1.454.CMB.1.raw
  modified_base (380)..(380): a, c, t, g, unknown or other
  misc_feature (380)..(380): n is a, c, g, or t
  modified_base (462)..(462): a, c, t, g, unknown or other
  misc_feature (462)..(462): n is a, c, g, or t
  modified_base (471)..(471): a, c, t, g, unknown or other
  misc_feature (471)..(471): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtcccggggtccctgaccgattcagaggcagcgggtctgggacagatttcactctcaccatcaccaactgcaggctgaagntgtggctagttttatactgtcagcaatactatacgtcctctctcacgttcggcggaggaccaggtgagatacgaaagactgngctgcaccntcctgtccttcatccgttcccgcatctgactac

SEQ ID NO: 52519 - DNA, 724 bp, Homo sapiens
  misc_feature: GYAE6OF02F9UBV.18.11.A11.1.454.CMB.1.raw
  modified_base (302)..(302): a, c, t, g, unknown or other
  misc_feature (302)..(302): n is a, c, g, or t
tcagtacgagtatgcacgaccggtgctcgatttagctacgactgcaggggcgagcaagatggtgttgcagacccgaggtccttcatttctctgttgctctggatctctggtgccgacggggacatcgtgatgacccagtctccagactcccgttggttgtgtctctagggcgagagggccaccatcaactgcaagtccagccgagagttgttttacacgacggctaccaaacaaataaccaacttacttagcttaggaccagcaagaaaccaggacacgaccccctaaggtcctcatttacngggacagtccgtacccggggtagtcccggggtccctaggaccggtattcgaggaggcgacggtcgggtctacgggaacaggtactttaccgaactctaccacctaataccgaccgaacctgccacgggctaggaaagtcgtggtacggacttaagttttaacttccgtagtactaacgacgtaaagttattaagttcggaaactttcggttagggtaacccgtttccgggaacccgtaaagggggttacccaaacggggttagggaacctaacgttaacccgaaaacggtaaccgttgggtaccggtacgtaggtaccctaaccgtaagttcccgtacggttacccttaaccgtaccgtttaccccggtttaccccgaaccgtttacgttaccctttacggtaaccgttacgttaaccccgg

SEQ ID NO: 52520 - DNA, 613 bp, Homo sapiens
  misc_feature: GYAE6OF02JYWUC.18.11.A11.1.454.CMB.1.raw
  modified_base (208)..(208): a, c, t, g, unknown or other
  misc_feature (208)..(208): n is a, c, g, or t
tcagtacgagtatgcacgaccggtgctcgatttagctacgactgcaggggcgagcaagatggtgttgcagacccaggtcttcatttctctgttgctctggatctctggtgccgacgggacatcgtgatgacccagtctccagactccctggttgtgtctctgggcgagagggccaccatcaactgcaagtccagccagagtgttttanacagctccaacaataacaactactagcttggtaccagctagaaaccaggaccacgccccctaaggtccctactactttactgggacactccgtacccggggacgttcccggggtccctcggtaccgtattccgagaggtcacggcgggtctgggacagtactttccacgtctcgaccatccaaccaacctgctacggcgtagaagtactcggtcgtcgtaagttttatacgttcgtacagtacctaactacttacgtacgtcctacctctcgtacgttcggccggtaaggccctaagggtcgaacgtactaacgtaaccgtacgtcgtaggtctcgactaccgtcttcgtaccgttaccttcgtacgtacccttcccggaccttacgtaccttcgacctttaacg

SEQ ID NO: 52521 - DNA, 588 bp, Homo sapiens
  misc_feature: GYAE6OF02I357I.18.11.A11.1.454.CMB.1.raw
  modified_base (210)..(210): a, c, t, g, unknown or other
  misc_feature (210)..(210): n is a, c, g, or t
  modified_base (257)..(257): a, c, t, g, unknown or other
  misc_feature (257)..(257): n is a, c, g, or t
  modified_base (275)..(275): a, c, t, g, unknown or other
  misc_feature (275)..(275): n is a, c, g, or t
  modified_base (283)..(283): a, c, t, g, unknown or other
  misc_feature (283)..(283): n is a, c, g, or t
  modified_base (348)..(348): a, c, t, g, unknown or other
  misc_feature (348)..(348): n is a, c, g, or t
  modified_base (359)..(359): a, c, t, g, unknown or other
  misc_feature (359)..(359): n is a, c, g, or t
  modified_base (370)..(371): a, c, t, g, unknown or other
  misc_feature (370)..(371): n is a, c, g, or t
  modified_base (381)..(381): a, c, t, g, unknown or other
  misc_feature (381)..(381): n is a, c, g, or t
  modified_base (398)..(398): a, c, t, g, unknown or other
  misc_feature (398)..(398): n is a, c, g, or t
  modified_base (401)..(401): a, c, t, g, unknown or other
  misc_feature (401)..(401): n is a, c, g, or t
  modified_base (425)..(425): a, c, t, g, unknown or other
  misc_feature (425)..(425): n is a, c, g, or t
tcagtacgagtatgcacgaccggtgctcgatttagctacgactgcaagggcacgcaagatggtgttgcagacccaggtcttcatttctctgttgctctggatctctggttgccgacgggacatcgtgatgacccagtctccagactccctggttgtgtctcgtgggcgagaggccaccagtcaactgcaagtcagccagagttgttttanacagcctaccaacaaataacactactagctggtaccagcaagaaccngacacgccccaaggtccnctattacngggcattccaccgggtagtccggggtccctggaccgactcgagtacggcaggcgggtctgggacngatttcactcncacatcacacnncagctgaatngtgacgtgtttactacngtntgactaatactatacgtcctctcnctacgtcggtcggtaggaccgtaagggtcgaagacgtttacaaaacggttccgtaggtcgtacctaggtaccctacgtaaccgtttccgtacggttaccttaccgtaacgtttcccctttaaaccccggcctttaaccgtccgtttaacgacccgttaacccc

SEQ ID NO: 52522 - DNA, 586 bp, Homo sapiens
  misc_feature: GYAE6OF02I4XB5.18.11.A11.1.454.CMB.1.raw
  modified_base (352)..(352): a, c, t, g, unknown or other
  misc_feature (352)..(352): n is a, c, g, or t
  modified_base (384)..(384): a, c, t, g, unknown or other
  misc_feature (384)..(384): n is a, c, g, or t
  modified_base (395)..(395): a, c, t, g, unknown or other
  misc_feature (395)..(395): n is a, c, g, or t
  modified_base (400)..(400): a, c, t, g, unknown or other
  misc_feature (400)..(400): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctcgtgggcgagagggccaccatcaactgcaagtccagccagagttgtttatacagcctaccaaacaataacaactacttagcttggtaccagacaagaaaccaggacacgaccccctaaggtccctactattacctgggacatccgtacccgggagtcccggggtccctggaccgattcagaggcaggcggtcngggacagtacttcactctcaccatcaccactnacaggctgaanagtgngtctaagtttatactgtacaggtactaatactattactccgttcctaccttacacggttcggacggtacgggacccgtagggtagagtaactacgaaaacgtactaggtcggactacgacgacctactaccgttcgttacttaccagttacccttcccggtaccctagtccgtagtacccgttaac

SEQ ID NO: 52523 - DNA, 519 bp, Homo sapiens
  misc_feature: GYAE6OF02FG0YP.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaactgcaggctgaagatgtggctagtttattactgtcagacaatactatagtcctcctctctacgttcggacggtaggaccaaggtgagatacaaacgtactgtgctgacaccgaatctcgttccttcattccttccccgacactcctgacctacg

SEQ ID NO: 52524 - DNA, 740 bp, Homo sapiens
  misc_feature: GYAE6OF02JJQC3.18.11.A11.1.454.CMB.1.raw
  modified_base (208)..(208): a, c, t, g, unknown or other
  misc_feature (208)..(208): n is a, c, g, or t
tcagtacgagtatgcacgaccggtgctcgatttagctacgactgcaggggcgagcaagatggtgttgcagacccaggtcttcatttctctgttgctctggatctctggtgccgacggggacatcgtgatgacccagtctccagactccctggttgtgtctctgggcgagaggccaccatcaactgcaagtccagccagagtgttttanacagctccaacaaataacaactacttagcttggtaccagacagaaaccaggacacgccccctaaggtcctacgtatttactgggacacgttaccaccccggggacgtccccggggcccctggaccgattccgagacggcgaggtccgggtctacgggactagtactttccaacgtcctaccacctactaccgaaccaaacccgtgaccaacgggtcctaagggaaacgttacgtgtacgggtactaacggtttttaacgttacgtacgttaccaacggttacctaaaacgttaaccttaagttaacccgttttacccccttaacccgttccttaacccggttaccccgggtttaacggggtcccgggggaaaacggggtaaaccccgtaaaggggttacgggaaccgtttaacgaaccggtaaaacccggtaaacggttcgggtacgtccgttacgtaacccaccgtaactccgttcgttaccttcgtaacgttccccgtttaacccgccgtaacttcttaccggacttacg

SEQ ID NO: 52525 - DNA, 640 bp, Homo sapiens
  misc_feature: GYAE6OF02IG3R6.18.11.A11.1.454.CMB.1.raw
  modified_base (207)..(207): a, c, t, g, unknown or other
  misc_feature (207)..(207): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgtttanacagctcaacaataacaactacttagcttggtaccagcaagaaaccaggaacacgaccccctaaggtcctctaattttacgtgggaccatccgtaacccggggacgttcccgggggtccctacggaccgtattcgaggagcaggcgggtcgtgggacagtactttcaactctacaccactcaacctaactgacaacggtctagaacgtatggtaggacttagttttaactactgtacagtacaatactatacgttcctacctctacgtccggttcgggacggaacgggtaccaagggtcgaagtaacttaacgaaaaccggtaactgggtacgtaccgtcgaaccgtaccgtaacgttcgttacgttccgtttaaccaccgtttccccgtaacccccgtaccgttaacgttaccgttccgtaaaccttaacgg

SEQ ID NO: 52526 - DNA, 750 bp, Homo sapiens
  misc_feature: GYAE6OF02I8HB9.18.11.A11.1.454.CMB.1.raw
  modified_base (215)..(215): a, c, t, g, unknown or other
  misc_feature (215)..(215): n is a, c, g, or t
  modified_base (218)..(218): a, c, t, g, unknown or other
  misc_feature (218)..(218): n is a, c, g, or t
  modified_base (269)..(269): a, c, t, g, unknown or other
  misc_feature (269)..(269): n is a, c, g, or t
tcagtacgagtatgcacgaccggtgctcgatttagctacgactgcagggtcagcaagatggtgttgcagacccaggtcttcatttctctgttgctctggatctctggtgccgacgggacatcgtgatgacccagtctccagacctcccgtggtgtgtctcgtgggcgaggacggccaccataccaactgacaagtccagccagtagttgttttanacngtacctaccaaactaaactaactaacttacgttagacgtttaaggtaaccngacgaacgtaaaccgaacggaacgaccgtaagccccccctaaagggtaccctttacgaggtttacctagggtcctaaccggtacgtaccccggggtactaccggggtaccctaggtacccgaagttaccgacgacggtacgtacgtcggggtactaggggaaccttacggaacgtttccgaaccgtaccgtacgtacccgaacgtaccgtaaccgaaccgtaggaccctaaggtaacgtacggtaacggtagtacggtacggttaccgtaacgtttaacttaccgtagttacgaacgtacctaacgttacgtacgttaccgtaccttacctaaccgtaccgaaccggttacggaccgtaacgggtaccgaacggtacgtaacgaacgtaaccgtaaacgtaacgtacgtacggactacgaccgtaacgtacgtacgtacgtacgttacgtaccgtaccgtaccgtaccgtacgtacgtacg

SEQ ID NO: 52527 - DNA, 513 bp, Homo sapiens
  misc_feature: GYAE6OF02HJJUX.18.11.A11.1.454.CMB.1.raw
  modified_base (342)..(342): a, c, t, g, unknown or other
  misc_feature (342)..(342): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagcccccctaaggtcctcatttactgggcatctacccgggagtccgggtccctgaccgattcagaggcagcgggtctgggacngatttcactctcaccatcaccaactgcaggctgaagatgtggcagtttatactgtcagcaatactatagtcctcctctcacgttcggcgaggaccaaggtggaagattacaaacgactggtagctgcaccatctcgtcttctacttccttcccgcctacgtctcgactacg

SEQ ID NO: 52528 - DNA, 662 bp, Homo sapiens
  misc_feature: GYAE6OF02INR7L.18.11.A11.1.454.CMB.1.raw
  modified_base (208)..(208): a, c, t, g, unknown or other
  misc_feature (208)..(208): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttanacagctaccaaacaataacaactacttagcttaggtaccagcaagaaaaccaggaacacgacccccctaaaggtccctactaacttttactgggccatccgtaacccccggggagttccccgggggtaccctcggacccgtattcgaggaacgggcaggcggggttctggggaacagtactttcactcctaccacctactaccaacccaacctgaccagggctagaagatgtggctaagttttattacgtgtcagactaattactaattacgttccctccttctctaccggttccggacgggtaacgggaaccctaaggggtcgaacggtaactaaccgaaaaccggtaacgttaggtacgggtccttacggaccctaaccgtaacttccgttcgttaccttttaccacctttcccgttaccccgtactaccgttaccttacgaccttaacccg

SEQ ID NO: 52529 - DNA, 569 bp, Homo sapiens
  misc_feature: GYAE6OF02GGR39.18.11.A11.1.454.CMB.1.raw
  modified_base (209)..(209): a, c, t, g, unknown or other
  misc_feature (209)..(209): n is a, c, g, or t
  modified_base (301)..(301): a, c, t, g, unknown or other
  misc_feature (301)..(301): n is a, c, g, or t
  modified_base (386)..(386): a, c, t, g, unknown or other
  misc_feature (386)..(386): n is a, c, g, or t
  modified_base (504)..(504): a, c, t, g, unknown or other
  misc_feature (504)..(504): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagttgttttanacagctcaacaataacaactacttagcttggtaccagcagaaaccaggacacgccccctaaggtcctcatttactgggcatcgtacccgggngtccgggtccctgaccgattcagaggcagcgggtctggacagtacttcactctcaccatcaccaactgcgacggctagaagatgnggctagttttatatgtcagtacaagtactaatacgtccttacctctcgtacgttccggcggacgggtaccgagggtagagacgtacgaaacgtacgtgtacgacttcggacctaccgnttaccgtacgtcctttaccacgttttacccgttcccgtacctacgttcctacggtaccttaaccg

SEQ ID NO: 52530 - DNA, 652 bp, Homo sapiens
  misc_feature: GYAE6OF02GWEQ1.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctaccaacaataacaactacttagcttggtaccagcagaaaccaggacacgccccctaaggtcctacatttacgtgggcactccgtacccggggacgtcccggggtccctcggaaccgtattcgaggtacggcgaggcgggtcgtgggacaggtactttcgactctaccaccactccaaccctaacctgaccaggctagaacgtagtgtaggtacgttaagttttactttacgtgtacgaagtacctaaattacttaacgttaccgttacccttccttacctaccgtaccgggtttacggccgggtaacgggtaacccgtaagggtacggaacgtacgtaacgtaaaccggacgttgtacggctacgacctaaccgtagttccgttacgttccgttacctacgttcccgttcccgacctacttacgtacgtaccttaacg

SEQ ID NO: 52531 - DNA, 554 bp, Homo sapiens
  misc_feature: GYAE6OF02FIS6A.18.11.A11.1.454.CMB.1.raw
  modified_base (207)..(207): a, c, t, g, unknown or other
  misc_feature (207)..(207): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgtttanacagctccaacaataacaactacttagcttggtaccagcagaaaccaggacagccccctaaggtcctacactttactgggccagtctacccgggagtccgggtccctgaccgattcagagcagcgggtctagggactagatttcactctcacatcaccaactgcaggctagaagattgcgactagttattacgtgtcagtactaagtacctagtacgtccctctactctacggttcggacggtaacggacctaaggtcgaagtacgtaccgaaacgtacgtgacggtcctagccaccgtactcgtcgttaccttacacgttcccttcccgcctatcctagtactacg

SEQ ID NO: 52532 - DNA, 501 bp, Homo sapiens
  misc_feature: GYAE6OF02GQOGO.18.11.A11.1.454.CMB.1.raw
  modified_base (284)..(284): a, c, t, g, unknown or other
  misc_feature (284)..(284): n is a, c, g, or t
  modified_base (380)..(380): a, c, t, g, unknown or other
  misc_feature (380)..(380): n is a, c, g, or t
  modified_base (383)..(383): a, c, t, g, unknown or other
  misc_feature (383)..(383): n is a, c, g, or t
  modified_base (465)..(465): a, c, t, g, unknown or other
  misc_feature (465)..(465): n is a, c, g, or t
  modified_base (474)..(474): a, c, t, g, unknown or other
  misc_feature (474)..(474): n is a, c, g, or t
  modified_base (483)..(483): a, c, t, g, unknown or other
  misc_feature (483)..(483): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaaccaggacagccccctaaggtcctcatttacngggcatctacccgggagtccggggtccctgaccgattcagaggcagcgggtctgggacagatttcactctcaccatcaccaactgcaggctgaagntgnggctagtttattactgtcagcaaatactatacgtcctcctctcacgttcggcggaggaccagggtgagatagaaacgactgngctgccacntctgtcttnatctcccgcatctgatac

SEQ ID NO: 52533 - DNA, 647 bp, Homo sapiens
  misc_feature: GYAE6OF02I2PSL.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagttgtttttatacagctaccaaacaaataaccaacttacttagcttggtaccagacaagaaaccaggaccacgaccccccgtaaaggtcccctactaatttacgtcgggactacgtccgtaccccggggtacggtccccgggggttcccctggaacccgtattcgaagaggcacggcgggtctgggacagtacttccactctccaacctataccaaccaacctgaccgacggcgtagaagagtgtcggacttagttttattactgtcagtactaatactaattacgtcccttctcctacgtaccgttcgggacggtaacgggacctaagggtacggagtactaacgaaaccgtacgtgtacggctacgacctaaccgtattccgttacgttaccctttaccgttacccgttttccccgacccttattccgtacgtacctaattacccg

SEQ ID NO: 52534 - DNA, 543 bp, Homo sapiens
  misc_feature: GYAE6OF02J0UTH.18.11.A11.1.454.CMB.1.raw
  modified_base (381)..(381): a, c, t, g, unknown or other
  misc_feature (381)..(381): n is a, c, g, or t
  modified_base (429)..(429): a, c, t, g, unknown or other
  misc_feature (429)..(429): n is a, c, g, or t
tcagtacgagtatgcacgaccggtgctcgatttagctacgactgcaggggcagcaagatggtgttgcagacccaggtcttcatttctctgttgctctggatctctggtgccgacgggacatcgtgatgacccagtctccagactccctggttgtgtctctgggcgagagggccaccatcaactgcaagtccagccagagtgtttatacagctccaacaataacaactactagcttggtaccagcagaaaccaggacagccccctaaggtcctcatttactgggcatctacccgggacgtccgggtccctgaccgattcagaggcagcgggtctgggacagatttcactctcaccataccgaccaacctgcacggctagaanagtgtcgctagtttactactgtcacgactaagtactatagtcctctcnctacgttcggcggacggaccgagtggacgactaacgaacgtaactcgtgacgtcgacacccgagttcctgttccttacacttccttcccgactacttacgtacggacttaaccg

SEQ ID NO: 52535 - DNA, 622 bp, Homo sapiens
  misc_feature: GYAE6OF02HUD94.18.11.A11.1.454.CMB.1.raw
  modified_base (217)..(217): a, c, t, g, unknown or other
  misc_feature (217)..(217): n is a, c, g, or t
  modified_base (296)..(296): a, c, t, g, unknown or other
  misc_feature (296)..(296): n is a, c, g, or t
tcagtacgagtatgcacgaccggtgctcgatttagctacgactgcagggggcagcaagatggtgttgccagaccccaggtcttcatttcttctgttgctctggatctctggtgccgacggggacatcgtgatgaccctaggtctccagactcccgttggttgtgtcttctgggcgagagggccacatcaactgcaagtccagccaggagtgttttanacagcctccaacaataacaactacttagcttggtaccagcaagaaccaggacacgccccctaaggtccctacatttacngggacatccgtaacccgggaggttcccggggtcccctggacccgtattcgaggacggcgaggcgggtcgtgggacagtattcactctacacatcaccaacctgcaggctgaagagtgtgactagttttacttactgtcagactaattactaattacgtccctcctctaccgtcggttcgggacggaacgggtaaccgaacgggtaggaacgtaacgtaaccgaaacggtacgtaggtcggacttacggacctacccgtattaccgttacgttacgttacctacgttcccttacccggtccttacgttaccttacgaaccttaaccg

SEQ ID NO: 52536 - DNA, 675 bp, Homo sapiens
  misc_feature: GYAE6OF02GWTRT.18.11.A11.1.454.CMB.1.raw
  modified_base (211)..(211): a, c, t, g, unknown or other
  misc_feature (211)..(211): n is a, c, g, or t
  modified_base (297)..(297): a, c, t, g, unknown or other
  misc_feature (297)..(297): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgacaagtccagccagagttgttttaanacagctaccaaacaataacaacttacttagcttaggtaccagacaagaaaccaggacacgaccccctaaggtcctactatttacgngggctactccgtacccgggacgtcccggggtacctcggaccgtattccgaggacggcgaggtccgggtcgtagggactaggtactttccacgttctccaacctctaccaccaacctggaccacggtactaggaagtacgtggtacggtacttaagttttacttaacgtgttacagtactaaacttacttaagttaccgttcccttaccttacgttaccgtacggtttccgggaccgggtaacgggtaacccgtagggtacgaagtaactaaccgaaaacgtacgttggacggtcctacgacctaaccgtgttaccgttcggttaccttaccgtaccgttacccgttccccgacttacttaccgttacgaccttaaccg

SEQ ID NO: 52537 - DNA, 576 bp, Homo sapiens
  misc_feature: GYAE6OF02I7DPX.18.11.A11.1.454.CMB.1.raw
  modified_base (208)..(208): a, c, t, g, unknown or other
  misc_feature (208)..(208): n is a, c, g, or t
  modified_base (285)..(285): a, c, t, g, unknown or other
  misc_feature (285)..(285): n is a, c, g, or t
  modified_base (415)..(415): a, c, t, g, unknown or other
  misc_feature (415)..(415): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttanacagctaccaacaataacaactacttagcttggtaccagcagaaaccaggacagccccctaaggtccctcatttacngggcatctacccgggagtccggggtccctggaccgattcagaggcaggcgggtctgggacagatttcactctcaccatcaccaactgcaggctgaagatgtggctagtttatactgtcagcaatactatntcctctcacgtcgttcggacggacgggacctagggtcgagtactacgaaaacgtacgttcggtagtccgttagaccgtaaccctacgttccttacggttccctttaccgaccttttcccgttcccccggtaccttaacttacccgttacgaccttaacccg

SEQ ID NO: 52538 - DNA, 778 bp, Homo sapiens
  misc_feature: GYAE6OF02JJNZ3.18.11.A11.1.454.CMB.1.raw
  modified_base (219)..(219): a, c, t, g, unknown or other
  misc_feature (219)..(219): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatcgacccagtctccagacctccgtggttgtgtctcgtgggcgaggacgggcccaccatacaactgacaacgtccagccagtagttgttttanacagcctaccaaacaaataaccaacttacttagcgttacggtaccagacaacgaaaccacggacaccgacccccgtaaggttcctacttatttacggtcgggactactacccggtacccggggtacggtccccgggggttacccctacggaccgtacttacgacggtacgggcctacgggtccggggttaccgtacggggactaaggttacctttaccacccgtttcctaccgaacccctagttaccccaaacccgtaacccgtggtacccgaacgggtacctagggaaacgtacgttcgggtacggttacgttaacggttttttacctttcgttagtaccgaacggtacctaaacgtttacgtttttaggtacccttttaccggaacttcccgtaacccgttaccggaccgtaacgggaccacggtacgtagggtaaaccgtaaagtttaaacgacgttacggtacggtctaccggaccctaactcgtttcggtttcttaccttccttaacgtttacccttccccggacttacgtaccgtacggtacctagttacccg

SEQ ID NO: 52539 - DNA, 510 bp, Homo sapiens
  misc_feature: GYAE6OF02F0NJY.18.11.A11.1.454.CMB.1.raw
  modified_base (379)..(379): a, c, t, g, unknown or other
  misc_feature (379)..(379): n is a, c, g, or t
  modified_base (485)..(485): a, c, t, g, unknown or other
  misc_feature (485)..(485): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcagctgaagntgtgctagtttatactgtcagcaatactatagtcctctctctacgttcggcggaggaccaagggtgagatacgaaacgacgtgtgctgacacgtctctcgtccttnacttccttccgcctatctagactac

SEQ ID NO: 52540 - DNA, 813 bp, Homo sapiens
  misc_feature: GYAE6OF02HWVTF.18.11.A11.1.454.CMB.1.raw
  modified_base (211)..(211): a, c, t, g, unknown or other
  misc_feature (211)..(211): n is a, c, g, or t
tcagtacgagtatgcacgaccggtgctcgatttagctacgactgcaggggcagcaagatggtgttgcagacccaggtcttcatttctctgttgctctggatctctggtgccgacgggacatcgtgatgacccagtctccagacctccctggttgtgtctctgggcgagacgggccaccatcaactgacaagtccagccagagttgttttanacagcttaccaacaataaccaacttacttagtcttacggtaccagtccaagaaaccaggacacgacccccctaaggtccctactactttaacgtggggaccacgttccgtaacccccggggtaggttccccgggggtaccccttcggacccggtatttccgaacggacgggtccgacggtcggggtctggggaacctaggttaactttaccgaccgttaccttaccaaccctacgtacccaacccctaacccgtcgacccgtacgggcctaagggaacgtacgttggttacgggtaccgttaagtttttacttacttcgtaaccgtaacgtacctaaaacgttacttaaccttaaccggtttccccttacccgttacctttcccgggtaacccgtttaccggggtaccgggtaaccgggtaacccgtaaggggttaggggtaacgtaacgttaacccgaaaaaccgtaccggttacgggttaacggaccgtttaccgacccgtaacccgttagttacccgttacgttcccgttttaaccgaccgttttacccgttacccccggtaccctaaccgtttccgttaccggtaacctttaacccgg

SEQ ID NO: 52541 - DNA, 544 bp, Homo sapiens
  misc_feature: GYAE6OF02GW5MS.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacacgccccctaaggtcctcatttactgggcatctacccggggacgtcccggggtccctgaccgattcaggacggcaggcgggtctgggacagtactttcactctcaccactcaaccaacctgcaggctgaagatggtgctagtttattactgtcagcaatactatacgtcctcctctcgtacgttcggcggaggaccgagggtcggagatacgaaacgacgtgtcgctcgcaccgtattccttcgttccttactaccttccttccccgcctacttctacgactacg

SEQ ID NO: 52542 - DNA, 510 bp, Homo sapiens
  misc_feature: GYAE6OF02G7731.18.11.A11.1.454.CMB.1.raw
  modified_base (487)..(487): a, c, t, g, unknown or other
  misc_feature (487)..(487): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcaggcgggtctgggacagatttcactctcaccatcaccaacctgcaggctgaagatgtggctagttttattactgtcagcaatactatagtcctcctctcacgttcggcggagggacctaggtggagatacaaacgatgtggctgcacctatctgtcttcnttccttcccgcctatctgactac

SEQ ID NO: 52543 - DNA, 530 bp, Homo sapiens
  misc_feature: GYAE6OF02FN22T.18.11.A11.1.454.CMB.1.raw
  modified_base (519)..(519): a, c, t, g, unknown or other
  misc_feature (519)..(519): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagttgttttatacagctccaacaataacaactacttagcttggtaccagcagaaaccaggacagcccccctaaggtccctcatttactgggcatcgtacccgggagtccggggtccctgaccgattccagaggcaggcgggtcgtgggacagatttcactctcaccatccaccaacctgcaggctgaagatgtggctagttttatactgtcagcaatactatacgtcccttcctctctacgtcggcggaggaccgaggtggagacgtacaaaaccgctagtcgctgccacctatctgtccttacacttccttcccgacctntctagactaac

SEQ ID NO: 52544 - DNA, 606 bp, Homo sapiens
  misc_feature: GYAE6OF02H071K.18.11.A11.1.454.CMB.1.raw
  modified_base (214)..(214): a, c, t, g, unknown or other
  misc_feature (214)..(214): n is a, c, g, or t
  modified_base (344)..(344): a, c, t, g, unknown or other
  misc_feature (344)..(344): n is a, c, g, or t
  modified_base (551)..(551): a, c, t, g, unknown or other
  misc_feature (551)..(551): n is a, c, g, or t
  modified_base (562)..(562): a, c, t, g, unknown or other
  misc_feature (562)..(562): n is a, c, g, or t
  modified_base (578)..(578): a, c, t, g, unknown or other
  misc_feature (578)..(578): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctcgtgggcgaggagggccaccatcaactgcaagtccagccagtagttgtttttaanacagcctaccaaacaataaacaacttacttagtcttacggtaccagacaacgaaaccaggacacgaccccctaaggtcctctatttacgtgggcacgtacccgtacccggggacggtcccgggggtcccnggacccgtattccgaaggacggcaggcgggtctgggacagtattcactctacaccataccaacctaacctgaccgtagccgtaagaacgtatcgtggtactagtttttactacgtgtacaagtactaattacttatacgttccctcctctcgtacggtccggacggaacgggacgaagggtgaagtacgtaacaaacgtagtgtcgntcgaccacgtntacgttctacttaccncttccctcccgacttactctgacttacg

SEQ ID NO: 52545 - DNA, 658 bp, Homo sapiens
  misc_feature: GYAE6OF02H96GL.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagacctccctggttgtgtctctgggcgagagggccaccatcaactgcaagtccagccagagttgtttatacagcctaccaacaaataacaactacttagcttggtaccagcaagaaaccaggacacgaccccctaaggtcctcatttacgtgggacatccgtacccgggtacggtcccggggtccctgaccgattacaggaggcaggcgggtcgtgggacagtactttcactctcaccatccaacccactgcacggctaggaagtagtggtggtacgttaaggttttaattaccgttaggtaccaaggtacctaaattaacttaattaccgttcccttcccgttcttaccgtaccggtttcgggagggtaaccgggtaaccgtaagggtagggaactaacgtaaaccgaaaaccggtacgttacgggtacgtcctacggaccctaccgtaacgtttccgttacgttacctttacctacgttcccgttccccgaccttacgttcctacggacttaaccg

SEQ ID NO: 52546 - DNA, 695 bp, Homo sapiens
  misc_feature: GYAE6OF02I5PBS.18.11.A11.1.454.CMB.1.raw
  modified_base (229)..(229): a, c, t, g, unknown or other
  misc_feature (229)..(229): n is a, c, g, or t
  modified_base (321)..(321): a, c, t, g, unknown or other
  misc_feature (321)..(321): n is a, c, g, or t
tcagtacgagtatgcacgaccggtgctcgatttagctacgactgcgaggggtcagcaagatggtgttgcagacccaggtcttcatttctctgttgctctggatctctggtgccggacggggacactcgtgatggacccagtctccaggtaccttccctggttgtgttcttcgtggggccgaggagggccaccagtccaactgcgaagtccagccgaggagttgttttanacagtccgtaccaacaataaccaacttaccttagcttacggtaccagtcagaaaccaggactacgtacccctaaggtcctactagtttacgngggcatccgtacccgggacggtcccgggtaccgtgaccgagttcgaggtacggcaggtcggtcgtaggacagtacttcacgttactaccgaactactaccgaacctaacgtcgtacgacgggactaggacgtacgtcggtcgtaccgttaaggttttactacgtacgtacaacgtactaacttactaaggttaccctaccttcctactaacgtaccggttacggacgggtacggtaacccgtagggtagaaccgtaacgtaaccgtaaacggacgttacgggtacgtaccttcggacctaaccggtacgttccgtaacggttccttaccgtacgttacccgttccggaccgtaccggttcttacgaccttaacg

SEQ ID NO: 52547 - DNA, 593 bp, Homo sapiens
  misc_feature: GYAE6OF02IKPZ6.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagttgttttatacagctaccaaacaataacaactacttagcttgtaccagcaagaaaccaggaacagccccctaaggtcctcatttactgggcatccgtacccgggagtccggggtccctgacccgattcagaggcaggcgggtctgggacagtatttccgactctcaccatccaaccaacctgacaggctagaagatgtggacctagttttatacgtgttacagactaatacttaatacgttcccctacttcctctaccggttacgggcggaacgggaacctaaggggtaggaacgtaacgtacgaaaacgtaaccgtgtacggctacgcctaccgaacgttcctcggttacctttcgaacgttcccttcccgacctaactcgtacgactaacg

SEQ ID NO: 52548 - DNA, 555 bp, Homo sapiens
  misc_feature: GYAE6OF02F0CE2.18.11.A11.1.454.CMB.1.raw
  modified_base (210)..(210): a, c, t, g, unknown or other
  misc_feature (210)..(210): n is a, c, g, or t
tcagtacgagtatgcacgaccggtgctcgatttagctacgactgcagggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagttgttttanacagctaccaacaataacaactacttagcttggtaccagcagaaaccaggacacgaccccctaaaggtccctactatttacgtcgggcactccgtacccggggacggtcccgggggtccctggaccgacttcgagaggcacggcgggtctgggacagatttcactctcaccatcaccaactgcaggctagaagtatgtggactagtttatacgtgtcagacaatactatacgtcctctctacgtcgtcggcggaggaccagggtagagactacgaaacgtagtgtcgctcgacctacgtatcgtgtaccttcgtacttccttcccgacctatcctacgtactacg

SEQ ID NO: 52549 - DNA, 560 bp, Homo sapiens
  misc_feature: GYAE6OF02HRVY0.18.11.A11.1.454.CMB.1.raw
  modified_base (208)..(208): a, c, t, g, unknown or other
  misc_feature (208)..(208): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttanacagctaccaacaataacaactacttagcttggtaccagcagaaaccaggacacgaccccctaaggtcctcatttactgggcatcctacccgggagtcccggggtcctgaccgattcaggaggcgagcgggtctgggacagtactttcactcctcaccgatccaacccacctcgcaggctagaagtatggtggctaggttttatactgtcacgactaatactaatcgtcctctctctacgtcggcggaggaccagggtgacgatcgaaacgtactggtcgactgctacccgattccttacgtcttaccacgttcccgtttaccccgccttaccttacttcggaaccttaccg

SEQ ID NO: 52550 - DNA, 743 bp, Homo sapiens
  misc_feature: GYAE6OF02J17WM.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtgccggacgggacatcgtgatgacccagtctccagacctccctggttgtgtctcgtgggcgagagggccaccatcaactgacaagtccagccagtagttgttttatacagcctaccaaacaaactaaaccaaccgttaacttaacggtctttacgggtaacccacgacaacgtaaaaccaggaaccaccgtacccccctaaaggtcctactatttaccgtgggacacttaccggacccgggacggtccggggtccctaggaccgtattcgaaggacggcgaacggtccgggtcgtacgggacctagtacttcgacctctacgacctactaccacctaacctgcgacggactaggacgtaacgtggtacgctttaacgtttattacctggtaccacggtactaacgttaactacgtttaaccgttccctactttccgttaccgaccggtttccggggaacggtaacccggggtaacgtacggggtaacgggtacgaaaaccgtttaccggttaaaacgaaaccgggttcgttacgggttacccacgggtaaccctaccgtaacgtttccggcggtttaacctttcccgaactttcccgtttaccccggaccttaacgttccgtacgtaaccgttacc

SEQ ID NO: 52551 - DNA, 521 bp, Homo sapiens
  misc_feature: GYAE6OF02JDFJ2.18.11.A11.1.454.CMB.1.raw
  modified_base (208)..(208): a, c, t, g, unknown or other
  misc_feature (208)..(208): n is a, c, g, or t
  modified_base (379)..(379): a, c, t, g, unknown or other
  misc_feature (379)..(379): n is a, c, g, or t
  modified_base (427)..(427): a, c, t, g, unknown or other
  misc_feature (427)..(427): n is a, c, g, or t
  modified_base (478)..(478): a, c, t, g, unknown or other
  misc_feature (478)..(478): n is a, c, g, or t
  modified_base (489)..(489): a, c, t, g, unknown or other
  misc_feature (489)..(489): n is a, c, g, or t
  modified_base (498)..(498): a, c, t, g, unknown or other
  misc_feature (498)..(498): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagaggccaccatcaactgcaagtccagccagagttgttttanacagctaccaacaataacaactacttagcttggtaccagcagaaaccaggacagccccctaaggtcctcatttactgggcatctacccggggagtcccggggtccctggaccgattcgagaggcaggcggtcgtgggacagatttcactctcaccatcaccaactgcagcngaacatgtggctagtttatactgtcagacaatactatacgtcctctcncgtaccgttcgggacggcggaaccgaaggtcggagactacaaacgtactgngctgaccactntctgtctcnttcctcccgctactctacatacc

SEQ ID NO: 52552 - DNA, 668 bp, Homo sapiens
  misc_feature: GYAE6OF02GHHUR.18.11.A11.1.454.CMB.1.raw
  modified_base (211)..(211): a, c, t, g, unknown or other
  misc_feature (211)..(211): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatcgacccagtctccagactccctggttgtgtctcgtgggcgagcgggccaccatcaactgcaagtccagccagagttgttttanacagcctaccaaacaataacaacttacttagcgttggtaccagacagaaaccaggacacgacccctaaggtcctactatttacgtgggactacgtaccgtacccggggacggttcccggggtccctacggaccggtattccgaacggtacgggacgacgggtcgggtcgtcggggaacaggtactttacgacttccgtcaacctacgtaccaacccaaccgtcgaccgtacgggactaggaaacgtacgtggtcggacttaagttttactacgttgtacgtagactaaacttaccttagttacgttccctccgttccgttaccgtacgggtttccggacgggtaaggtaccgaagggttcgaagtactaacgaaacgtacgtggtacggctacgaccaccgtattcgtacgtccttacgtacgttccgttacccgacctacgtcgtacgtacctacg

SEQ ID NO: 52553 - DNA, 720 bp, Homo sapiens
  misc_feature: GYAE6OF02HFVH5.18.11.A11.1.454.CMB.1.raw
  modified_base (208)..(208): a, c, t, g, unknown or other
  misc_feature (208)..(208): n is a, c, g, or t
  modified_base (219)..(219): a, c, t, g, unknown or other
  misc_feature (219)..(219): n is a, c, g, or t
  modified_base (267)..(267): a, c, t, g, unknown or other
  misc_feature (267)..(267): n is a, c, g, or t
  modified_base (274)..(274): a, c, t, g, unknown or other
  misc_feature (274)..(274): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttanacagctccaanaataacaactacttagcttgtacagcagaacagacagcccctagtctnatttacnggcatctacccgggagtccgggtcctgaccgtattcaggacgcaggtcggtctagggacaggtactttcgacctcgtccaaccataccaacctaaccttggaccaacgggtcctaggaaacgagttacgggtacggtactaacgtttttaacttaaaccgtggttaccgaacggtaccctaaaattaaccgttaacgttaaccgggttccctttacctaccgttaccgttaaccggtttccgggtaaccggggaacggggtaaaccccgtaaagggtacgggaaacgtaaccgttaaccgtaaaaacggtaacgttacgggtacggtacccgtagtaacccgtaacccgtcggtttaccgtaccgggtttaacctttaccccgtattttcccccggttacccccggacttaacccggttaccgtttacggaaaccctttaacccgg

SEQ ID NO: 52554 - DNA, 509 bp, Homo sapiens
  misc_feature: GYAE6OF02G2AI0.18.11.A11.1.454.CMB.1.raw
  modified_base (341)..(341): a, c, t, g, unknown or other
  misc_feature (341)..(341): n is a, c, g, or t
  modified_base (347)..(347): a, c, t, g, unknown or other
  misc_feature (347)..(347): n is a, c, g, or t
  modified_base (357)..(357): a, c, t, g, unknown or other
  misc_feature (357)..(357): n is a, c, g, or t
  modified_base (370)..(370): a, c, t, g, unknown or other
  misc_feature (370)..(370): n is a, c, g, or t
  modified_base (380)..(380): a, c, t, g, unknown or other
  misc_feature (380)..(380): n is a, c, g, or t
  modified_base (487)..(487): a, c, t, g, unknown or other
  misc_feature (487)..(487): n is a, c, g, or t
  modified_base (497)..(497): a, c, t, g, unknown or other
  misc_feature (497)..(497): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaaacaaataacaactacttagcttggtaccagcagaaaccaggacagccccctaaggtccctcatttactgggacatctacccgggagtcccggggtccctgaccgattcagaggcagcgggtcngggacngattcactcncacatcaccactncagctgaagntgtggctagtttatactgtcagacaatactattactcctctctcgtacgtcggcggacggaccagggtgagactacaaacgactgcgctgcacattcgtagtctacncttccgtccnccatctgactac

SEQ ID NO: 52555 - DNA, 538 bp, Homo sapiens
  misc_feature: GYAE6OF02IJOUC.18.11.A11.1.454.CMB.1.raw
  modified_base (209)..(209): a, c, t, g, unknown or other
  misc_feature (209)..(209): n is a, c, g, or t
  modified_base (285)..(285): a, c, t, g, unknown or other
  misc_feature (285)..(285): n is a, c, g, or t
  modified_base (302)..(302): a, c, t, g, unknown or other
  misc_feature (302)..(302): n is a, c, g, or t
  modified_base (492)..(492): a, c, t, g, unknown or other
  misc_feature (492)..(492): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagttgttttanacagctccaaacaataacaactacttagcttggtaccagcagaaaccaggacacgccccctaagtcctcatttacnggcatccgtacccgggngtcccggggtccctgaccgattcagagcaggcgggtctgggacagtatttcactctcaccatccaccaactgcagctgagatgtgactagtttatactgtcagcaaattactattacgtccctcctctcgtcggttcggcgggacggaccgaggtggatacgtacgaaacgtactgtgctgccaaccgtntcctagtccttcacgttcccgtacccgtcctattccgtacgactac

SEQ ID NO: 52556 - DNA, 514 bp, Homo sapiens
  misc_feature: GYAE6OF02HHAKJ.18.11.A11.1.454.CMB.1.raw
  modified_base (339)..(339): a, c, t, g, unknown or other
  misc_feature (339)..(339): n is a, c, g, or t
  modified_base (472)..(472): a, c, t, g, unknown or other
  misc_feature (472)..(472): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctggcgagagggccaccatcaactgcaagtccagccagagtgttttatacagctccaacaataacaactacttagcttggtaccagcagaaaccaggacacgcccctaagtcctcatttactggcatctaccgggagtccggggtccctggaccgattcagaggcagcgggtctgggacngactttcgactctcaccatcacctaactgacaggctgaagatggtggactaggttttactactgtacagctaatacctatacgtcctcctctcacgttcggcggaggaccgaggtgagtatacgaaacgatgngctgcacatctgtcttcatccttcccgactactctgacctac

SEQ ID NO: 52557 - DNA, 620 bp, Homo sapiens
  misc_feature: GYAE6OF02IEJPD.18.11.A11.1.454.CMB.1.raw
  modified_base (207)..(207): a, c, t, g, unknown or other
  misc_feature (207)..(207): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctggcgagagggccaccatcaactgcaagtccagccagagtgttttanacagctccaacaataacaactacttagcttggtaccagcaagaaaacaggaacacgacccctaaggtcctactaatttacctgggcaatcccgtaaccgggacgtcccggggtccctagaccgtacttacgaagagcaggtcgggactgggacagtactttcgaactcctacaccataccaacctaaccgtgacccgagggctaggaatacgtgtacggtactaagttttaactacgtgtacagtacgtaatacgttataacgtccttcctactctacggttcggacggagggaaccgaaggtcggagtaactaccgtaaaacgacttaggtggactacgtacaacccgtataccttacggttctttaccctacttccgtttacccccgcttacttacgtacgtaacttaacc

SEQ ID NO: 52558 - DNA, 525 bp, Homo sapiens
  misc_feature: GYAE6OF02GV9A4.18.11.A11.1.454.CMB.1.raw
  modified_base (444)..(444): a, c, t, g, unknown or other
  misc_feature (444)..(444): n is a, c, g, or t
  modified_base (460)..(460): a, c, t, g, unknown or other
  misc_feature (460)..(460): n is a, c, g, or t
  modified_base (475)..(475): a, c, t, g, unknown or other
  misc_feature (475)..(475): n is a, c, g, or t
  modified_base (492)..(492): a, c, t, g, unknown or other
  misc_feature (492)..(492): n is a, c, g, or t
  modified_base (505)..(505): a, c, t, g, unknown or other
  misc_feature (505)..(505): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagcctccaaacaataacaactacttagcttggtaccagcagaaaccaggaccacgccccctaaggtcctcatttactggcatcgtacccgggagtcccgggtccctgaccgattcgagagcagcgggtcgtgggacagtattcactctcacatcaccaactgacaggctgaacgtatggtacgctagtttattacgtagtcagactaatactatacgtcctctctctcgtcggngagggacctaggtganagtacaaacgactgngctgactacgtatcgtntcttcgactcccnctactctacgactatacccg

SEQ ID NO: 52559 - DNA, 622 bp, Homo sapiens
  misc_feature: GYAE6OF02J05UO.18.11.A11.1.454.CMB.1.raw
  modified_base (205)..(205): a, c, t, g, unknown or other
  misc_feature (205)..(205): n is a, c, g, or t
  modified_base (268)..(268): a, c, t, g, unknown or other
  misc_feature (268)..(268): n is a, c, g, or t
  modified_base (275)..(275): a, c, t, g, unknown or other
  misc_feature (275)..(275): n is a, c, g, or t
  modified_base (562)..(562): a, c, t, g, unknown or other
  misc_feature (562)..(562): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcagagggccacatcaactgcaagtccagccagagtgtttanacagctcaacaatacaatacttagcttgaccagcagaaaccaggacagccccctaaggtcctnatttacngggcatccacccggggagttcccgggtaccctgaccgtattccgagaggcaggcgggtctggactagactttcacctctaccacgtactaccaaccgaaccgtgaccgacggtcctaagggaaatacgttggcggactttaggttttaaactcgttagtacacgaactaaacgtactaacgttcgtcccttaccgtcttacgtaaccgggttcgggaccggtaacgggtaccaaagggttgaacgtaactaccgaaaacgtacctgggttacgcgtacacgtaaccncttcttctaccgttcaacctttcccgtaccccggacttaagtccgtacgtaaccttaacg

SEQ ID NO: 52560 - DNA, 634 bp, Homo sapiens
  misc_feature: GYAE6OF02I14VK.18.11.A11.1.454.CMB.1.raw
  modified_base (208)..(208): a, c, t, g, unknown or other
  misc_feature (208)..(208): n is a, c, g, or t
  modified_base (304)..(304): a, c, t, g, unknown or other
  misc_feature (304)..(304): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttanacagctccaacaataacaactacttagcttggtaccagcagaaaccaggaccacgccccctaaggtcctacatttacgtggcatccgtacccgggngtccggggtcctgaccgattcgagagcaggcgggtctgggacagtatttccactctcaccatccaccaacctgcaggctagaagagtgtggctagtttacttactgtcagactaatacttatacgtcccttaccttctaccgtacggttccgggacgggtaacgggtacccgaaagggttggggaacttaacgtaaccgtaaaacggtaacgttacgggtacgggaccgttcgaccgtaacccgtagtttacccttcggtttaccctttaccgtacctttaccccgtttaccccggtacccttacgttacccgttacggaaccttaaccg

SEQ ID NO: 52561 - DNA, 523 bp, Homo sapiens
  misc_feature: GYAE6OF02JETQH.18.11.A11.1.454.CMB.1.raw
  modified_base (209)..(209): a, c, t, g, unknown or other
  misc_feature (209)..(209): n is a, c, g, or t
  modified_base (278)..(278): a, c, t, g, unknown or other
  misc_feature (278)..(278): n is a, c, g, or t
  modified_base (285)..(285): a, c, t, g, unknown or other
  misc_feature (285)..(285): n is a, c, g, or t
  modified_base (391)..(391): a, c, t, g, unknown or other
  misc_feature (391)..(391): n is a, c, g, or t
  modified_base (394)..(394): a, c, t, g, unknown or other
  misc_feature (394)..(394): n is a, c, g, or t
tcagtacgagtatgcacgaccggtgctcgatttagctacgactgcaggggcgagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttanacagctccaacaataacaactacttagcttggtaccagcagaaaccaggacacgccccctaaggtcctnatttacngggcatccgtacccgggagtcccggggtccctgacccgtattccagacggcaggcgggtctgggacagtatttccacgtctcaccatcaccaacctgcagctgaantgnggactagttttatactgtcagcaatactatacgtccctcctctcgacgttcgggcggtagggaccagggtgaagatacgaaacgatgtgctgaccacatctgtcttcatccttcccgctatctgactac

SEQ ID NO: 52562 - DNA, 581 bp, Homo sapiens
  misc_feature: GYAE6OF02HZYL6.18.11.A11.1.454.CMB.1.raw
  modified_base (211)..(211): a, c, t, g, unknown or other
  misc_feature (211)..(211): n is a, c, g, or t
  modified_base (214)..(214): a, c, t, g, unknown or other
  misc_feature (214)..(214): n is a, c, g, or t
  modified_base (381)..(381): a, c, t, g, unknown or other
  misc_feature (381)..(381): n is a, c, g, or t
  modified_base (503)..(503): a, c, t, g, unknown or other
  misc_feature (503)..(503): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtcctccagacctccctggttgtgtctctgggcgagagggccaccatcaactgcaagtccagccagagttgttttanacngcctccaacaataacaactacttagcttggtaccagcagaaaccaggacacgccccctaaaggtcctacatttactgggctatcctacccggagtccggggtcctgaccgattcagagcagcggtctgggacagattcactctcacatcaccactgcaggctagagntgtgctagtttatactgtcagcatactatcgtccctactctctaccgttcgggcggtacgggacctaagggtggaacgtataccgaaacgtacttacgggtggtcctacggacctaaccgtnttaccggttacgtttacccttacgtacctttacccggttccccgaccttaccgtttacgttaccgaaccgttaacccg

SEQ ID NO: 52563 - DNA, 521 bp, Homo sapiens
  misc_feature: GYAE6OF02FPZTX.18.11.A11.1.454.CMB.1.raw
  modified_base (283)..(283): a, c, t, g, unknown or other
  misc_feature (283)..(283): n is a, c, g, or t
  modified_base (497)..(497): a, c, t, g, unknown or other
  misc_feature (497)..(497): n is a, c, g, or t
  modified_base (512)..(512): a, c, t, g, unknown or other
  misc_feature (512)..(512): n is a, c, g, or t
  modified_base (516)..(516): a, c, t, g, unknown or other
  misc_feature (516)..(516): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgtttatacagctaccaacaataacaactacttagcttggtaccagcagaaaccaggacagccccctaaggtcctcatttacnggcatcgtacccgggagtccggggtccctgaccgattcgagaggcaggcgggtctgggacagtatttcactctcaccatccaccaacctgcaggctagaagatggtggactagtttattactgtcagacaatactattacgtccctcctctcacgttcggacggaggaccaagggtgagatacaaacgtagtgtcgctgcactatctgtccttnactccttcccgcctntctnactac

SEQ ID NO: 52564 - DNA, 782 bp, Homo sapiens
  misc_feature: GYAE6OF02F5V3H.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtgccggacggggacatcgtgatgacccagtctccagactccctggttgtgtctctgggcgagagggccaccatcaactgcaagtccagccagagttgttttatacagctaccaacaataacaacttacttagcttggtaccagacagaaaccaggaccacgcccccctaaagggtccctacgtattttacgtcgggactactccgtaaccccggggtagtccccgggggttcccctcggaccggtattcgagtacggcaggccggggttcagggacaggtactttccgactcctccaacctacgtaccaacctaaccgttcgacccgaacgggtccgttacggaaacggtagttggtacggtaccttaggttttaattaccggtagttacaacggtactaaacgttaccttaagttacggtaccccttccgttaccgttcccgtaaacgggttttcccgggaccggggttaacggggtaacccaagggggtttcggaaacggtacgttaaccgtaaaaccggttaacgttaggggttaccggacgttaccgggtaacccgaccctttaaacggttcccggtttaaggtttccccgttttaaccgtaaccgttttcccgttaccccccggtaccgtttaacccgttaccgttacccgggtaaccctttaaacccgg

SEQ ID NO: 52565 - DNA, 547 bp, Homo sapiens
  misc_feature: GYAE6OF02HE2H0.18.11.A11.1.454.CMB.1.raw
  modified_base (350)..(350): a, c, t, g, unknown or other
  misc_feature (350)..(350): n is a, c, g, or t
  modified_base (493)..(493): a, c, t, g, unknown or other
  misc_feature (493)..(493): n is a, c, g, or t
  modified_base (507)..(507): a, c, t, g, unknown or other
  misc_feature (507)..(507): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagcctaccaacaataacaactacttagcttggtaccagcagaaaccaggaccacgccccctaaggtcctcatttactgggcactcgtaccccgggtagtcccggggtccctcgaccgtattcgaggaggcaggccgggtntgggacagtatttcactctcaccatcaccactgcaggctagaagatgtggctagtttatactgctagcaatacgtatacgtcctcctctctacggttcgggcggacgggaccaagggtggaacacgtacgaaaacgcttacgnggcctagacctacnttcctagtcttacattcctacccgctactctacgactacg

SEQ ID NO: 52566 - DNA, 608 bp, Homo sapiens
  misc_feature: GYAE6OF02HHHQQ.18.11.A11.1.454.CMB.1.raw
  modified_base (209)..(209): a, c, t, g, unknown or other
  misc_feature (209)..(209): n is a, c, g, or t
  modified_base (288)..(288): a, c, t, g, unknown or other
  misc_feature (288)..(288): n is a, c, g, or t
  modified_base (375)..(375): a, c, t, g, unknown or other
  misc_feature (375)..(375): n is a, c, g, or t
  modified_base (401)..(401): a, c, t, g, unknown or other
  misc_feature (401)..(401): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagttgttttanacagctaccaacaataacaactacttagcttggtaccagcagaaaccaggacacgccccctaaggtcctctatttacgngggacataccgtacccggggacgtcccgggggtccctacggaccgtattccgaggaggcgaggcgggtctgggacagatttcactcncacatcaccaactgcaggctagaatntgtgctagtttatactgtacgagactaagtactattacgttccctaccttctacgtacggttcgggacggtacgggtaaccgagggtcggagtacttacgaaacggtactggtacggctacggacctaccgtacgttccgttacggttaccttaccgtacgtttcccgttaccccggtaccttacgttaccgttacgtaccttaacg

SEQ ID NO: 52567 - DNA, 601 bp, Homo sapiens
  misc_feature: GYAE6OF02I3BC2.18.11.A11.1.454.CMB.1.raw
  modified_base (209)..(209): a, c, t, g, unknown or other
  misc_feature (209)..(209): n is a, c, g, or t
  modified_base (300)..(300): a, c, t, g, unknown or other
  misc_feature (300)..(300): n is a, c, g, or t
  modified_base (565)..(565): a, c, t, g, unknown or other
  misc_feature (565)..(565): n is a, c, g, or t
  modified_base (570)..(570): a, c, t, g, unknown or other
  misc_feature (570)..(570): n is a, c, g, or t
  modified_base (579)..(579): a, c, t, g, unknown or other
  misc_feature (579)..(579): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagttgttttanacagcctaccaaacaagtaaccaacttacttagcttagggtacccagcaagaaaccaggacacgccccctaaggtccctactactttacgnggactactccgtaccccggggagtcccgggtccctggacccgtattccgagacggcaggtcggtactgggacagtatttccactctacgaccctataccaacctaacctgacctaccgggacttagggaactagtcgggttacgacgttaaggttttacctagcgttacacgtactaacgttactattccgtaccctcgttacctacgtcggtccggacggacggtacagggtgactacgtaccaagtactgtgctgacctaccnttacncgtctaccngttcctcccactgtcacagtac

SEQ ID NO: 52568 - DNA, 577 bp, Homo sapiens
  misc_feature: GYAE6OF02IUGC3.18.11.A11.1.454.CMB.1.raw
  modified_base (209)..(209): a, c, t, g, unknown or other
  misc_feature (209)..(209): n is a, c, g, or t
  modified_base (365)..(365): a, c, t, g, unknown or other
  misc_feature (365)..(365): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagttgttttanacagctaccaaacaataaccaactacttagcttggtaccagcaagaaaccagacacgaccccctaaggtcctcatttacgtgggctatcgtacccggggagtcccggggtccctgaccgattcagaggcagcgggtcgtgggacagatttcactcncaccatcaccaactcgacacggctagaagatggtgtacttagtttatactgtacagtacaatactatacgtcccttctactcgtacggtccggcgggaacgggaccgagggtagaacgacgtaacgaaacgaacgtgtacggtcctagacctaccgtattccgtcgttccttacctacttcccgttacccgacctacttctacgtacctaac

SEQ ID NO: 52569 - DNA, 513 bp, Homo sapiens
  misc_feature: GYAE6OF02FYW82.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgtttatacagctccaacaataacaactacttagcttggtaccagcagaaaccaggacagccccctaaggtcctcattactgggcatctacccgggagtccggggtcctgaccgattcagaggcagcgggtctgggacagatttcactctcaccatcaccaacctgcaggctgaagatgtgctagtttattactgtcagcaatactatagtcctctctcacgttcggcggagggaccagggtgagatacgaaacgactgtgctgcaccgattcctgtaccttcacttccttcccgcctactctacgactaacg

SEQ ID NO: 52570 - DNA, 606 bp, Homo sapiens
  misc_feature: GYAE6OF02F2EEW.18.11.A11.1.454.CMB.1.raw
  modified_base (371)..(371): a, c, t, g, unknown or other
  misc_feature (371)..(371): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctaccaacaataacaactacttagcttggtaccagcagaaaccaggacacgccccctaaggtcctcatttactgggcatctacccgggagtcccggggtcctgaccgattcgagagcgagcgggtctgggacagatttcactctcaccatcaccacctncaggctagaagatgtgctagttttattactgtcagcaatactaatcgtacctctctcgtaccgttcgggacggtagggaacccagggtacggaagtacgtaacccgaaaacgtaacgttggtacggtaccgtagaccctaacccgtagttacccggtttacgttaccctttacgtaacctttaccccgtttaccccccggaccttaaccggtttaccttacggaccctttaaccg

SEQ ID NO: 52571 - DNA, 512 bp, Homo sapiens
  misc_feature: GYAE6OF02FTIEM.18.11.A11.1.454.CMB.1.raw
  modified_base (380)..(380): a, c, t, g, unknown or other
  misc_feature (380)..(380): n is a, c, g, or t
  modified_base (478)..(478): a, c, t, g, unknown or other
  misc_feature (478)..(478): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagttgttttatacagctaccaacaataacaactacttagcttggtaccagcagaaaccaggacagccccctaaggtcctcatttactgggcatctacccgggagtccggggtccctgaccgattcagaggcagcgggtctggacagatttcactctcacatcaccaacctgcaggctgaagntgtgctagtttattactgtcagtcaaatactattacgtcctcctctcacgttcggcggaggaccaagggtgagtatacaaacgactgtacgctgcacntctgtcttcatccttcccgcctatctagactacg

SEQ ID NO: 52572 - DNA, 534 bp, Homo sapiens
  misc_feature: GYAE6OF02JDF1E.18.11.A11.1.454.CMB.1.raw
  modified_base (353)..(353): a, c, t, g, unknown or other
  misc_feature (353)..(353): n is a, c, g, or t
  modified_base (363)..(363): a, c, t, g, unknown or other
  misc_feature (363)..(363): n is a, c, g, or t
  modified_base (489)..(489): a, c, t, g, unknown or other
  misc_feature (489)..(489): n is a, c, g, or t
  modified_base (497)..(497): a, c, t, g, unknown or other
  misc_feature (497)..(497): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaacttacttagcttggtaccagcagaaaccaggacacgccccctaaggtcctcatttactgggcatccgtacccgggagtcccggggtccctgaccgattcgagaggcaggcgggtcgtgggacagtntttacactcncaccatcaccaactgcaggctgaacgtatgtgactagtttacttatgtcagactaatacttatacgtccctctctcgaccgttcggcggacggaccaagggtagagatacgaaacgactgtcgtcncgacacgntcgtcgtcttcacttcttcccgctactctagctaacg

SEQ ID NO: 52573 - DNA, 523 bp, Homo sapiens
  misc_feature: GYAE6OF02HOYDJ.18.11.A11.1.454.CMB.1.raw
  modified_base (358)..(358): a, c, t, g, unknown or other
  misc_feature (358)..(358): n is a, c, g, or t
  modified_base (436)..(436): a, c, t, g, unknown or other
  misc_feature (436)..(436): n is a, c, g, or t
  modified_base (498)..(498): a, c, t, g, unknown or other
  misc_feature (498)..(498): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagttgttttatacagctaccaacaataacaactacttagcttggtaccagcagaaaccaggacagccccctaaggtcctcattactggcatccgtacccgggagtccggggtccctggaccgattcgagaggcagccgggtctgggacagtattcactcncaccatcaccaactgcagctagaagagtgtggtctagtttattacgtgtacagtacaatactatagtccctactctcncgttcggacggaggaccgaggtgagagtacaacgtactgtgctgccacgtactctgtctacncttcctcccgtcactctacgactac

SEQ ID NO: 52574 - DNA, 659 bp, Homo sapiens
  misc_feature: GYAE6OF02HTCHD.18.11.A11.1.454.CMB.1.raw
  modified_base (211)..(211): a, c, t, g, unknown or other
  misc_feature (211)..(211): n is a, c, g, or t
  modified_base (584)..(584): a, c, t, g, unknown or other
  misc_feature (584)..(584): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagacctccctggttgtgtctctgggcgagagggccaccatcaactgacaagtccagccagagttgttttanacagctaccaaacaataacaactacttagcttaggtaccagacagaaaccaggacacgccccctaaggtcctactattactgggactatcccgtaacccggggacggtcccggggtccctacggaacccgtattccgaaggacggcaagggtccgggtactacggggacaaggtactttaccgacttcctaccacctaactaccaaccaacccgtgaccgacggtcttaggaagtatggtcggtacttaagttttaacttacgtgtacagacctaaatactaattccgtacctccttactcgtacggttcgggacgggacggtacccgtaaggtacgtagaacgtaacgtaaaacggactggtaggaccgtanaccgaacctcgttccgttacgttcccttacaccgtttcccgtaccccgtaccttaagtcccgtaggaccttaacg

SEQ ID NO: 52575 - DNA, 512 bp, Homo sapiens
  misc_feature: GYAE6OF02FNG32.18.11.A11.1.454.CMB.1.raw
  modified_base (380)..(380): a, c, t, g, unknown or other
  misc_feature (380)..(380): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcgactctcacatcaccaactgcaggctagaagntgtggcagtttatactgtcagacaatactaatacgtcctctctcacgttcggcgagggaccaagggtcgagtatacgaaacgactgtcgctgccacgatcctagtcttcattctccgcctatctacgatacg

SEQ ID NO: 52576 - DNA, 517 bp, Homo sapiens
  misc_feature: GYAE6OF02GLYH5.18.11.A11.1.454.CMB.1.raw
  modified_base (487)..(487): a, c, t, g, unknown or other
  misc_feature (487)..(487): n is a, c, g, or t
  modified_base (496)..(496): a, c, t, g, unknown or other
  misc_feature (496)..(496): n is a, c, g, or t
  modified_base (512)..(512): a, c, t, g, unknown or other
  misc_feature (512)..(512): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagttgttttatacagcctccaaacaataacaacttacttagcttggtaccagcagaaaccaggacagcccccctaaggtcctcatttactgggcatctacccggggagtccggggtcccctgaccgattccagaggcagcgggtctgggacagatttcactctcacatcaccaactgcaggctgaagatgtggctagttttatactgtcagtacaatactagttacgtccttcctctcgtaccgttcgggcggaggaccgaggtgagatacgaaacgatgtgctgcacntctgtctcncttctcccgctatctnactac

SEQ ID NO: 52577 - DNA, 582 bp, Homo sapiens
  misc_feature: GYAE6OF02IT1X8.18.11.A11.1.454.CMB.1.raw
  modified_base (209)..(209): a, c, t, g, unknown or other
  misc_feature (209)..(209): n is a, c, g, or t
  modified_base (288)..(288): a, c, t, g, unknown or other
  misc_feature (288)..(288): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgtttttanacagctaccaacaataacaactacttagcttaggtaccagacagaaaccaggacacgccccctaaggtcctcatttacnggcatcgtaccgggagtccggggtccctgaccgattccagacggcaggtcggtctgggacaggtactttcacttctaccaccatccacctactgcgaggctagaagtagtgtacggactagttttaatacgtgtcagtacaagtactattacgtcctccttctcgtacgtcgggcggtaggaccgaaggtgagtactacgaaaccgagtacgtcgactagacctaaccgtagttcctacgttccttacgtaccgttacccgttcccgacctacttaccgtacgaccttaacccg

SEQ ID NO: 52578 - DNA, 526 bp, Homo sapiens
  misc_feature: GYAE6OF02GBQ4Z.18.11.A11.1.454.CMB.1.raw
  modified_base (384)..(384): a, c, t, g, unknown or other
  misc_feature (384)..(384): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctaccaaacaataaacaactacttagcttggtaccagcagaaaaccaggacagcccctaaggtcctcattactgggcatctacccgggagtccggggtccctgaccgattcagaggcagcgggtctgggacagatttcactctcaccatcacaacctgcaggctgaagatgngcagtttatactgtcagcaatactatagtccctcctctcacgttcggcgagggaccaaggtgagatcaaaacgtagtgtaggctgacaaccgtatcttagtcctttacacgttcttccccggcctattctacggtactaacg

SEQ ID NO: 52579 - DNA, 599 bp, Homo sapiens
  misc_feature: GYAE6OF02HAALQ.18.11.A11.1.454.CMB.1.raw
  modified_base (210)..(210): a, c, t, g, unknown or other
  misc_feature (210)..(210): n is a, c, g, or t
  modified_base (373)..(373): a, c, t, g, unknown or other
  misc_feature (373)..(373): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgaggagggccaccatcaactgcaagtccagccagagttgttttanacagcctaccaaacaaataacaactacttagcttggtaccagcaagaaaccaggacacgccccctaaggtcctctattactggcactcgtacccgggagtcccggggtcctgaccgtattcagaggcaggcgggtctagggacagtatttcactctacactancaacctactgcaggctagaagtagtggtaggtctagttttaactacgtgtacagtactaaatactaattacgtcccttacctctaccgtacggttcgggacgggtaacgggtaccgtaagggtcggaagaacgttacgaaaacgtacgtggtacgtcgtacgaccaccgtataccgttcgtctttaccgacttcccgttcccgaccttactccgtagaccctaacg

SEQ ID NO: 52580 - DNA, 549 bp, Homo sapiens
  misc_feature: GYAE6OF02FQ3P2.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgtttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgtggactagttttaactactgtcagcaaatactattacgtccctctcctctacgttcgggacggacgggaccgaaggtggaagagtaaccgaaaacgaacgtgtagcgtagctaaccgattctcgtaccttacgacttcccttcccggaccttactcttccgactaacc

SEQ ID NO: 52581 - DNA, 595 bp, Homo sapiens
  misc_feature: GYAE6OF02HVINX.18.11.A11.1.454.CMB.1.raw
  modified_base (199)..(199): a, c, t, g, unknown or other
  misc_feature (199)..(199): n is a, c, g, or t
  modified_base (208)..(208): a, c, t, g, unknown or other
  misc_feature (208)..(208): n is a, c, g, or t
  modified_base (281)..(281): a, c, t, g, unknown or other
  misc_feature (281)..(281): n is a, c, g, or t
  modified_base (288)..(288): a, c, t, g, unknown or other
  misc_feature (288)..(288): n is a, c, g, or t
  modified_base (396)..(396): a, c, t, g, unknown or other
  misc_feature (396)..(396): n is a, c, g, or t
tcagtacgagtatgcacgaccggtgctcgatttagctacgactgcaggggcagcaagatggtgttgcagacccagggtcttcatttctctgttgctctggatctctggtgccgacggggacatcgtgatgacccagtctccagactccctggttgtgtctcgtgggcgagaggccaccatcaactgcaagtccagcagngtgttttanacagctacaacaataacaactacttagcttaggtaccagcaaggaaaccagacacgtccccctaaggtcctanatttacnggcatccgtaccgggtagtcccggggtacctggaccgtattcgagacggacagcgggtcgtagggacagacttcactctcactatcaccacgtgacaggctagaacgngtgtaggactaggttttatacgtgtacacgtactaactactattaaccgttcctacctctaccgtacggttaccggacgggtaacgggaccctaagggtcgaacgtactaccgaaacgtactggtacgctacggacctacgtaattctcgttacctacgtaccttcccgttacccgacttcgtacgtacaccttaaccg

SEQ ID NO: 52582 - DNA, 524 bp, Homo sapiens
  misc_feature: GYAE6OF02I0SCJ.18.11.A11.1.454.CMB.1.raw
  modified_base (381)..(381): a, c, t, g, unknown or other
  misc_feature (381)..(381): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactggcatctacccgggagtccggggtccctgaccgattcagaggcagcgggtctgggacagatttcactctcaccatcaccaactgcaggctgaacatgnggctagtttactactgtcagcaatactatagtcctcctctcacgttcggcggacggaccaaggtggagtactacaaacgacgtgtcgctgcacctagtccttgtcctttcaacttccgtcccgaccctatcctagacctaacg

SEQ ID NO: 52583 - DNA, 557 bp, Homo sapiens
  misc_feature: GYAE6OF02I452R.18.11.A11.1.454.CMB.1.raw
  modified_base (306)..(306): a, c, t, g, unknown or other
  misc_feature (306)..(306): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctaccaacaataacaactacttagcttaggtaccagcaagaaaccaggacacgccccctaaggtcctactatttacgtggcatccgtaccgggngtccgggtcctgaccgtattcagaggcaggcggtctgggacagtacttcactctcaccatacaccaactgcaggctagaacagtgtggctaagttttatacgtgtacagactaatactattacgtcctcctctctacgttcggacggaggaccaaggttggataactacgaaacgacttcgaggtcctagacctaccgagttcctcgttccttactacttccgttcccgacctattccgtacgtactaacg

SEQ ID NO: 52584 - DNA, 527 bp, Homo sapiens
  misc_feature: GYAE6OF02H8WZX.18.11.A11.1.454.CMB.1.raw
  modified_base (207)..(207): a, c, t, g, unknown or other
  misc_feature (207)..(207): n is a, c, g, or t
  modified_base (373)..(373): a, c, t, g, unknown or other
  misc_feature (373)..(373): n is a, c, g, or t
  modified_base (378)..(378): a, c, t, g, unknown or other
  misc_feature (378)..(378): n is a, c, g, or t
tcagtacgagtatgcacgaccggtgctcgatttagctacgactgcaggggcagcaagatggtgttgcagacccaggtcttcatttctctgttgctctggatctctggtgccgacgggacatcgtgatgacccagtctccagactccctggttgtgtctctgggcgagagggccaccatcaactgcaagtccagccagagtgttttanacagctccaacaataacaactacttagcttggtaccagcagaaaccaggacagccccctaaggtcctcattactggcatctacccggagtccggggtccctgaccgattccagagcagcggtctgggacagattcactctcacatcaccaacctgcaggctgaagntgtgntagttatactgtcagactaatacttaatacgtccttacctctccacgtttccggcggaggaccgaggtggagtagtacaaacgactagtgactgcactcgtctcgtacttcgaacttcccttcccgccgttactccttacgacctaacg

SEQ ID NO: 52585 - DNA, 763 bp, Homo sapiens
  misc_feature: GYAE6OF02IAK2Z.18.11.A11.1.454.CMB.1.raw
  modified_base (289)..(289): a, c, t, g, unknown or other
  misc_feature (289)..(289): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctaccaaacaataacaactacttagcttggtaccagacagaaaccaggacacgacccctaaggtcctacatttacgnggacataccgtacccgggacgtcccggggtccctggaccgtattccagacggcgacggcgggtctagggacagtacgtttaccactctaccaccaactaccaacctaacctcgacctagggacctaggaacgtagtacggtcggtaccgtttaagttttaacgttaaccgttcgtacgaagtaacctaaaattaacccgttaagttaccgttaccccttaccgttacccgttaccgtaaccggttttacccggggacggggtaacggggttaaaccccggtaaaggggttacggtaaacggtacttaaaccggtaaaaaccggtaacgttacgggttcgggtaaccttacgggtaacccgtaaccgttaacgtttaccgtttaccggtttaccgttttaccgttaacccgtttccccgttttacccccggaccctttaacggtttaacccgttaccggttaacccttaaaccgg

SEQ ID NO: 52586 - DNA, 610 bp, Homo sapiens
  misc_feature: GYAE6OF02HQ7EY.18.11.A11.1.454.CMB.1.raw
  modified_base (212)..(212): a, c, t, g, unknown or other
  misc_feature (212)..(212): n is a, c, g, or t
  modified_base (278)..(278): a, c, t, g, unknown or other
  misc_feature (278)..(278): n is a, c, g, or t
  modified_base (332)..(332): a, c, t, g, unknown or other
  misc_feature (332)..(332): n is a, c, g, or t
  modified_base (337)..(337): a, c, t, g, unknown or other
  misc_feature (337)..(337): n is a, c, g, or t
  modified_base (398)..(398): a, c, t, g, unknown or other
  misc_feature (398)..(398): n is a, c, g, or t
  modified_base (521)..(521): a, c, t, g, unknown or other
  misc_feature (521)..(521): n is a, c, g, or t
  modified_base (531)..(531): a, c, t, g, unknown or other
  misc_feature (531)..(531): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctcgtgggcgagagggccaccatcaactgcaacgtccagccagtagttgttttanacagctaccaaacaataacaactacttagcttgtacagcaagaaccagacacgcccctaagtcctntacttacgcggacactccgtacccggaggtcccgggtcctagaccgtatcaggngacgnggcggtcgtagggacagtacttcactactccacactaccaaccactgcaggtctagaacgntggtcgtactaagttttatactgtcagtactaacttactaactcgtttccctacttccgtacgttacggtccgggacgggtaaccgggaacctaagggtaggtacgaactaaccgaaacggtntacgggtacncgtcgactaccgtacgttcgtcgttaaccttcctaccttccccggtacccgtccgtaactttcgtaccgaccttaaccg

SEQ ID NO: 52587 - DNA, 781 bp, Homo sapiens
  misc_feature: GYAE6OF02IMUE5.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtgccgacgggacatcgtgatgacccagtctccagactccctggttgtgtctctgggcgagagggccaccatcaactgcaagtccagccagagtgtttttatacagctaccaaacaataacaactacttagcttaggtaccagacaagaaaccaggaccacgaccccctaaggtccctacatttactgggcctagttccgtaaccccggggtacggttcccgggggttaccccctcggaacccgtaagtttccgaaggacggccgaaggtccggggttccgtcggggacagtactttccgacttccgtaccaacccactaccaaacccgtaaaccctgaccgtaagggtccgtacggaaacgtaatcgggtacgggactaaggtttttaacttacttagttaccgaacgtacgtaaacttaaccgttaagttaaccgttacccttccccttaaccgttacccgtaacccgggttttaccgggaccggggtaaaccgggtaaccgtaaacggggtacggaacgtaacgtaaaccgttaaaaaccggtaacgttacgggtacggtaccgtacgtaaccgtaacccgtaatttccgttacgtttccgtttaccgtaaccgtttacccgttacccccggtaaccgttaccgtttacccgttacggtaaccttaaacccg

SEQ ID NO: 52588 - DNA, 555 bp, Homo sapiens
  misc_feature: GYAE6OF02F7TI7.18.11.A11.1.454.CMB.1.raw
  modified_base (288)..(288): a, c, t, g, unknown or other
  misc_feature (288)..(288): n is a, c, g, or t
  modified_base (322)..(322): a, c, t, g, unknown or other
  misc_feature (322)..(322): n is a, c, g, or t
  modified_base (373)..(373): a, c, t, g, unknown or other
  misc_feature (373)..(373): n is a, c, g, or t
  modified_base (509)..(509): a, c, t, g, unknown or other
  misc_feature (509)..(509): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagttgttttaatacagcttaccaacaataacaactacttagcttaggtaccagcagaaaccaggacagccccctaagtcctcatttacgnggcatcgtacccgggagtccgggtccctgaccgnttcagaggcagcggtctaggacagatttcactctcacatcacaacctgacngctagaagatgtgctagtttattacgtagtcaagctaaatacttaatacgtccttcctctacgtaccgttcgggacggaggaacccgaaggtacggagtacgttacaaacgtacgtagtacgcttacgcaaccgtntcctgtcctttacacttccttcccgacctacgtacgtacactaacg

SEQ ID NO: 52589 - DNA, 590 bp, Homo sapiens
  misc_feature: GYAE6OF02HIJ7C.18.11.A11.1.454.CMB.1.raw
  modified_base (209)..(209): a, c, t, g, unknown or other
  misc_feature (209)..(209): n is a, c, g, or t
  modified_base (221)..(221): a, c, t, g, unknown or other
  misc_feature (221)..(221): n is a, c, g, or t
tcagtacgagtatgcacgaccggtgctcgatttagctacgactgcaggggcagcaagatggtgttgcagacccacggtcttcatttctctgttgctctggatctctggtgccgacggggacatcgtgatgacccagtctccagactccctggttgtgtctctgggcgagagggccaccatcaactgcaagtccagccagagtgttttanacagctaccaanaataacaactacttagcttggtaccagcaagaaaccaggacacgaccccctaaggtcctctatttactgggctataccgtacccgggagtccgggtccctgaccgtattcagaggcagcggtctgggacagtatttcactctcacatcacctaactgacagctagaagatgtgactagtttactacgtgtacagctaactactaattacgttccctccttactcgtaccggttcgggacggtaaggtaccgtaagggtagaacgacttaccgaaaacgtacgtaggtcgactcgaccaccgtacgttccttacgttaccttactacttcccgttacccgacccttaacgttcccttacgaccttaaccg

SEQ ID NO: 52590 - DNA, 514 bp, Homo sapiens
  misc_feature: GYAE6OF02FLA1Q.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgtggctagtttatactgtcagcaatactatagtcctcctctcacgtttcggcggagggaccaagggtggaagatacgaaaacgactgtcgctgacacctaatctagtcttcattcttcccgccatctgactac

SEQ ID NO: 52591 - DNA, 673 bp, Homo sapiens
  misc_feature: GYAE6OF02F9QWY.18.11.A11.1.454.CMB.1.raw
  modified_base (213)..(213): a, c, t, g, unknown or other
  misc_feature (213)..(213): n is a, c, g, or t
tcagtacgagtatgcacgaccggtgctcgatttagctacgactgcaggggcagcaagatggtgttgcagacccagggtcttcatttctctgttgctctggatctctggtgccgacggggacatcgtgatgacccagtctccagactccctggttgtgtctcgtgggcgaggagggccaccatcaactggcaagtccagccagagttgttttanacagcctaccaaacaataacaactacttagcttaggaccagacaagaaaccaggacacgaccccctaaggtcctactatttacgtgggactacgtaccgtacccgggacggtcccggggtaccctagaccgtattacgacgacggcgacggtcgggtcgtagggacaggtactttcactctacaccactaccaacctaaccgtgaccgaggtctacgaacgtacgttggtacggtacttagttttaacgttacgtaggtaccacgtactaactacttattacgttacccttaccttccgtaccgtaccggtaccgggacgggtaacgggtaccgtaacgggtacggtaagtaaccttaaccgaaacgtacgtacggtcggtactaccggactaccgtacgtacgttcgttaccttcctaccgttccctacccgtacctacgtccgtaccgacttaacccg

SEQ ID NO: 52592 - DNA, 574 bp, Homo sapiens
  misc_feature: GYAE6OF02HW7CG.18.11.A11.1.454.CMB.1.raw
  modified_base (210)..(210): a, c, t, g, unknown or other
  misc_feature (210)..(210): n is a, c, g, or t
  modified_base (282)..(282): a, c, t, g, unknown or other
  misc_feature (282)..(282): n is a, c, g, or t
  modified_base (289)..(289): a, c, t, g, unknown or other
  misc_feature (289)..(289): n is a, c, g, or t
  modified_base (371)..(371): a, c, t, g, unknown or other
  misc_feature (371)..(371): n is a, c, g, or t
  modified_base (460)..(460): a, c, t, g, unknown or other
  misc_feature (460)..(460): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgacaagtccagccagagttgttttanacagctaccaacaataacaactacttagcttaggtaccagcaagaaaccaggacacgacccctaaggtcctnatttacngggcactccgtacccgggaggtcccggggtccctcgaccgtattccgagcggcgaggcgggtctgggacagtacttcactcncacactcaccacctgacaggctagaagtatgtgtactagtttatacgtgtcagactaatactattacgtcctcctctcgtcggttcggnggacgggtaccagggtgagactaacgaaacggtactggtcgactcgacctaccgtattccgtcgttccttacgtacgttcccgtcccgtacctacgttccgtacgacttaaccg

SEQ ID NO: 52593 - DNA, 685 bp, Homo sapiens
  misc_feature: GYAE6OF02I1XMH.18.11.A11.1.454.CMB.1.raw
  modified_base (296)..(296): a, c, t, g, unknown or other
  misc_feature (296)..(296): n is a, c, g, or t
  modified_base (376)..(376): a, c, t, g, unknown or other
  misc_feature (376)..(376): n is a, c, g, or t
  modified_base (407)..(407): a, c, t, g, unknown or other
  misc_feature (407)..(407): n is a, c, g, or t
tcagtacgagtatgcacgaccggtgctcgatttagctacgactgcagggggcagcaagatggtgttgcagacccaggtcttcatttctctgttgctctggatcgtctggtgccgacggggacatcgtgatgacccagtctccagactccctggttgtgtctctgggcgagagggcccaccatcaactgcaagtccagccagagttgtttttatacagcctaccaacaaataacaactacttagcttaggtaccagacaagaaaccaggacacgaccccctaaggtcctcatttacngggacatccgacccgggagtcccggggtcctcgaccgtattcgagaggcaggcgggtcgtagggacagtatttcacttcnccacatccaccaactgacaggtctagaacgngtgtcggacttaagtttactacgtagtacacgtactaaagttactaacgttacgttccccttacctaccttacgtaaccggttccgggaacgggtaaacggggtaacccgtaaagggggttacgggtaaacgtaacgttaaacccgaaaaccggtaacgttacgggtacggtaccgtacggtaccctaaccggtaacgtttccgttacggttacctttacgtaaaccctttccccgttaccccggtaccttaacgttccgttaccgaaccgttaaccg

SEQ ID NO: 52594 - DNA, 512 bp, Homo sapiens
  misc_feature: GYAE6OF02FN0OK.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcagctagaagatgtgctagtttatactgtcagcaatactatagtcctctctctacgttcggcggaggaccaaggtgagatacgaaacgtactgtcggctgaccacgatctcgtcttacattccttcccgcctatctagactac

SEQ ID NO: 52595 - DNA, 701 bp, Homo sapiens
  misc_feature: GYAE6OF02IXLRI.18.11.A11.1.454.CMB.1.raw
  modified_base (206)..(206): a, c, t, g, unknown or other
  misc_feature (206)..(206): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagaggccaccatcaactgcaagtccagccagagtgtttanacagctaccaacaataacaactacttagcttggtaccagcagaaaccaggacacgacccctaaggtcctactatttacgtggacacgtcgtacccgggacggtcccggggtaccctgaaccgtattcgaagaggcgacggcgggtcgtagggaacagtaacgtttcacttctccacctacgtcacctaaacctgaccgacggactacggaaagtgtacggtacggacgttaagtttttagtttaaccgtgttactaacgtactaaacgttaacgttataaaccggttccctttaccttaccgttaccgttaaccggtacggggaaccgggttaaccggaaccggttaagggttacgggaacgttaaccgttaaccgtaaaaccggtaacgttggtacgggttacctacggaacctaaccgtcttaaccgttcgttacccttttacgacctttacccgttccccgaacctaccgtacggttacgtaccttaaccgg

SEQ ID NO: 52596 - DNA, 587 bp, Homo sapiens
  misc_feature: GYAE6OF02JJAFQ.18.11.A11.1.454.CMB.1.raw
  modified_base (207)..(207): a, c, t, g, unknown or other
  misc_feature (207)..(207): n is a, c, g, or t
  modified_base (325)..(325): a, c, t, g, unknown or other
  misc_feature (325)..(325): n is a, c, g, or t
  modified_base (529)..(529): a, c, t, g, unknown or other
  misc_feature (529)..(529): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgtttanacagctaccaacaataacaactacttagcttggtaccagcagaaaccaggacagcccctaaggtcctcattactgggacatctaccgggagtccgggtccctgaccgattcagaggcngacgggtctgggacagactttacacttcgtcaccgatccgacctaaacgtcgacacggacgttagaagactgtggctaagttttactacgtgtactagactaatactaagtacgtacctcgtctctcgttacgggcggtaacgaccgtaagggtcgaacgtacgtaacgaaacgtacgtacgtacggtactacgacgtaaccgngttacgtcttacttaccgtagttcccgtacccgtcgtaacttccgtactaccgtaacg

SEQ ID NO: 52597 - DNA, 592 bp, Homo sapiens
  misc_feature: GYAE6OF02GFOYZ.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtgccggacggggacatcgtgatgacccagtctccagactccctggttgtgtctctgggcgagagggccaccatcaactgcaagtccagccagagtgttttatacagctaccaacaataacaactacttagcttggtaccagcagaaaccaggaccacgccccctaaggtcctcactttacgtgggcatcgtacccgggagtccggggtccctgaccgattcagaggcagcgggtctgggacagatttcactctcaccatcaccaacctgcaggctagaagagtgtggactaggttttacttacgtgtacagacaaacgttacttaatacgtccctccttcctacgtaccggtttcggacgggaacgggaccgaagggtggaagattaccgaaaacgtacgtggtacgctacgacaccgtagttccgttacgttacctttaccgaacgtttcccgttcccgtaacctactccgtacgtactaaccg

SEQ ID NO: 52598 - DNA, 607 bp, Homo sapiens
  misc_feature: GYAE6OF02F0R4O.18.11.A11.1.454.CMB.1.raw
  modified_base (405)..(405): a, c, t, g, unknown or other
  misc_feature (405)..(405): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagacctccctggttgtgtctcgtgggcgaggagggcccaccatcaactgcaagtccagccagagttgttttatacagctaccaacaataacaactacttagcttggaccagcaagaaaccaggacacgccccctaaggtccctctatttactgggacatccgtacccggggaggtcccggggtccctacgaccgattcgaggaggcgaggcgggtctggggaccagtactttcactctcaccatcaccaactgcaggctagaagntgtcggacttagtttattactcgtacagactaagttactaattccgtacccttcctacctcttaccgggttcggacggtaacgggaacctaagggtacgaagtacgtaacgaaaacgtactggtacggtacctcggaccacgtactccgttcgttccttactacgttcccgttaccccgattaccgtctacgtaccttaccg

SEQ ID NO: 52599 - DNA, 532 bp, Homo sapiens
  misc_feature: GYAE6OF02G4OLH.18.11.A11.1.454.CMB.1.raw
  modified_base (462)..(462): a, c, t, g, unknown or other
  misc_feature (462)..(462): n is a, c, g, or t
  modified_base (502)..(502): a, c, t, g, unknown or other
  misc_feature (502)..(502): n is a, c, g, or t
  modified_base (509)..(509): a, c, t, g, unknown or other
  misc_feature (509)..(509): n is a, c, g, or t
  modified_base (519)..(519): a, c, t, g, unknown or other
  misc_feature (519)..(519): n is a, c, g, or t
  modified_base (524)..(524): a, c, t, g, unknown or other
  misc_feature (524)..(524): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacacgccccctaaggtcctcaatttctgggcatcgtacccgggagtccggggtccctgaccgattcagaggcagcgggtctgggacagtatttcactctcaccactcaaccaactgcacggctacgaagatggtgctaggtttactacgtgtcagtacaattactatatccctctctctacgtcggcggaggaccgaaggtgganagacgaaacgtacgtggtcgtcgtacgcaccgtactcttntcttacncttcctcccnctacnctcactac

SEQ ID NO: 52600 - DNA, 561 bp, Homo sapiens
  misc_feature: GYAE6OF02H2792.18.11.A11.1.454.CMB.1.raw
  modified_base (293)..(293): a, c, t, g, unknown or other
  misc_feature (293)..(293): n is a, c, g, or t
  modified_base (330)..(330): a, c, t, g, unknown or other
  misc_feature (330)..(330): n is a, c, g, or t
  modified_base (334)..(334): a, c, t, g, unknown or other
  misc_feature (334)..(334): n is a, c, g, or t
  modified_base (390)..(390): a, c, t, g, unknown or other
  misc_feature (390)..(390): n is a, c, g, or t
  modified_base (405)..(405): a, c, t, g, unknown or other
  misc_feature (405)..(405): n is a, c, g, or t
  modified_base (411)..(411): a, c, t, g, unknown or other
  misc_feature (411)..(411): n is a, c, g, or t
tcagtacgagtatgcacgaccggtgctcgatttagctacgactgcaggggcagcaagatggtgttgcagacccaggtcttcatttctctgttgctctggatctctggtgcccggaggggacatcggtgaatgacccagtctccaagacttccctgggttgtgtcctctggggcgaagacgggcccacatcaactgcaagccagccagatgtttatacagctcaacaataacaaactacttaagactggtaccagcaagaaaccaggacagccccaacggtctcattaactggnatcaccggacgtcggtccgcgaccgatcagagcgacncggngtcgagagaattctactctcacacacaacaccaagccaggacgagaagagtagtgngtagttattatcgtntacganactatataactcctctactcacgttacgacggacgaaccgaggtaggagacgttaacaaacgaacgtacgtaggctacctaccgtacgtaccttcgttactacgttacctcgttacccgtccaccttacgtaacgtactacttaacccgg

SEQ ID NO: 52601 - DNA, 737 bp, Homo sapiens
  misc_feature: GYAE6OF02JLL42.18.11.A11.1.454.CMB.1.raw
  modified_base (211)..(211): a, c, t, g, unknown or other
  misc_feature (211)..(211): n is a, c, g, or t
tcagtacgagtatgcacgaccggtgctcgatttagctacgactgcaggggcagcaagatggtgttgcagacccaggtcttcatttctctgttgctctggatctctggtgccggacggggacatcgtgatgacccagtctccagactccctggttgtgtctctgggcgagagggccaccatcaactgcaagtccagccaggagttgttttanacagcctccaaacaaataaccaactacttagctttggtaccagcaagaaaccaggaccacgaccccctaaggtcctactatttacgtgggctactccgtaacccgggacggttcccgggggtccctcggaccgatttaccgagacggcgacggtccggggtctagggacgtagtactttcacgttctcgacctatacccaaccaacctcggaccaggtacctagggaacagtttcggtacggtactttaagttttaacgtttactacggttacgaacgtctaaaacttacgttaacgttacgttcccctttaccgtccttacgtacccgggtttacgggaccggggtaacgggaaccggtaagggttacgggaacggtaacttacccggtaaaaacggtaccggtaggttcgggaccttacgggccctaaaccgtacgtttccgtttacggttaccctttacggttaacctttccccggttttaccccggacccttacgttaccgttacggtaccctttaaaccgg

SEQ ID NO: 52602 - DNA, 703 bp, Homo sapiens
  misc_feature: GYAE6OF02HICPA.18.11.A11.1.454.CMB.1.raw
  modified_base (209)..(209): a, c, t, g, unknown or other
  misc_feature (209)..(209): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagttgttttanacagcctaccaacaataacaactacttagcttggtaccagcaacgaaaccaggacaaccgacccctaaaggtcctactattacgtgggactatccgtaacccgggacggtcccggggtaccctggaccgtattccgagacggcgacggtcgggtcgtagggacaggtactttccgacttctacaccactccaaccctaacgtgaccgaaggaccgtagtaacgagttacggtacggtacttaaaggtttttacttaacgttcgttacgtaagtactaaacttaacgttacttacgttccccttaccgttcctacgttaccggtttccggaacgggtaaccgggtaaccgtaagggacgggtaaacgaacttaaccgaaaacggtaacgtagggtacggtacctacggtaccctaaccgtacgttccgttacgtttacccttcctaccgttacccctttcccccggacttaccgttaccgtacgtacccttaacg

SEQ ID NO: 52603 - DNA, 802 bp, Homo sapiens
  misc_feature: GYAE6OF02HNXDC.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgacacgtccacgccagtagtttgttttaactacacgtcctaccaaactaaactaaacctaaccttacgttacgtacgttacggtaaccagaccgaaacgaaaccgaggaccaccggtacccccgttaacggtcctacttaactttacggtcgggactacgttcccggtaacccggggtacggttccccggggtacctacggtaccgtacgttaccggaaggtacggcgtacgggtcgggttaccgtaggggacctaggttactttaccgaccttactaccgaacctacttaacccgaaccctaaaccgtcgaccggtacggtccgtaaggaacgtacgttagggtacggtaccgtttaaggtttttaaccttacggttacgtaccgtaacgtaaccttaaacgtttaaccttaacgtttacccgttccccttaccgttaccttaccgggttaaccgggttcccggggaacgggtaaccgggtaaccgtagggtacggtaacgtaacgttaacccgaaaacggtacgtgggtaccgtcgttaccgacctaaccgttgtccgtttacgtaccttacgtccgttaccccgttcccgacttaccgtacgtaccaacttaccg

SEQ ID NO: 52604 - DNA, 541 bp, Homo sapiens
  misc_feature: GYAE6OF02H5D6X.18.11.A11.1.454.CMB.1.raw
  modified_base (377)..(377): a, c, t, g, unknown or other
  misc_feature (377)..(377): n is a, c, g, or t
  modified_base (494)..(494): a, c, t, g, unknown or other
  misc_feature (494)..(494): n is a, c, g, or t
tcagtacgagtatgcacgaccggtgctcgatttagctacgactgcagggggcagcaagatggtgttgcagacccaggtcttcatttctctgttgctctggatctctggtgccggacggggacatcgtgatgacccagtctccagactccctggttgtgtctctgggcgagagggccaccatcaactgcaagtccagccagagttgttttaatacagctaccaacaataaacaactacttagcttggaccagcagaaaccaggacacgaccccctaaggtccctcatttactgggacatccgtacccgggagtccggggtccctgaccgattcagaggcagcgggtctgggacagtattcactctcacatcaccactncagcagaagatgtggctagttttatactgtcagactatactatacgtcctctctcgtacgtcggacggaggaacctagggtagagataccgtaaacgactggtggactgaccgtacntactgttccttcctattccttaccccgcctacttctaccgacttacg

SEQ ID NO: 52605 - DNA, 755 bp, Homo sapiens
  misc_feature: GYAE6OF02GOEDA.18.11.A11.1.454.CMB.1.raw
  modified_base (208)..(208): a, c, t, g, unknown or other
  misc_feature (208)..(208): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttanacagctccaacaataacaacttacttagcttggtaccagcagaaaccaggacacgaccccctaaggtccctacatttacgtcgggacacttccgtaaccccggggaggttcccggggtcccctaggacccgtatttccgaggacggacgaggtccggggtctacggggacaggtactttacgacctctaccgaacctactccaacccgtaaaccctgaccgtaacggaccttagggaaacgtgttacgggtacgggtacttaacggttttactttaaccgttggtactaacggtaccttaaaacggttaacctttaagttacccggtttcccctttaccctttaccgttaaccgtacccgggttttacccgggacggggtaaccggggtaacccgtaaggggtacggaacgtaacgttaacgaaaaccggtacgttcggtacgggtccttagggaccctaacgtacgttcccgttacggttaccctttacgtaaccgtttccccgttaccccggtacttaccgttacccgtagtaaccctttaaccg

SEQ ID NO: 52606 - DNA, 683 bp, Homo sapiens
  misc_feature: GYAE6OF02G3RHY.18.11.A11.1.454.CMB.1.raw
  modified_base (214)..(214): a, c, t, g, unknown or other
  misc_feature (214)..(214): n is a, c, g, or t
  modified_base (620)..(620): a, c, t, g, unknown or other
  misc_feature (620)..(620): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactcccgtggttgtgtctcgtgggcgaggagggccaccagtcaacgtgcaagtccaagccagagtgttttanacagcctaccaaactaagtaaaccaacttacgttagcctttggaaccagacaagaaaacccaggaccaacgaccccctaaggtcctacacgttttaccgtgggcctaacttcccgtaaccccggggtacggtccccggggttacccctacggacccggtatttaccgaggaacggcctagggtccggggtccgtaggggaacctagtaacgtttccacttcgtaccaaccattaccaaccgaactgaccgaggtctagaaacgtgtaggtacggtacttaggttttactacgtgtacagtacaattacctagttacgtcctacctctacgtcggtcgggacgagggtaacctaggggacgaagtactaacgaaaccggagtacgtggtactccggacctaaccgtntttacgacgttcttaacgttccgtttacccggaactctttacccggattacccgaattacccg

SEQ ID NO: 52607 - DNA, 608 bp, Homo sapiens
  misc_feature: GYAE6OF02GXFQA.18.11.A11.1.454.CMB.1.raw
  modified_base (130)..(130): a, c, t, g, unknown or other
  misc_feature (130)..(130): n is a, c, g, or t
  modified_base (141)..(141): a, c, t, g, unknown or other
  misc_feature (141)..(141): n is a, c, g, or t
  modified_base (211)..(211): a, c, t, g, unknown or other
  misc_feature (211)..(211): n is a, c, g, or t
  modified_base (229)..(229): a, c, t, g, unknown or other
  misc_feature (229)..(229): n is a, c, g, or t
  modified_base (251)..(251): a, c, t, g, unknown or other
  misc_feature (251)..(251): n is a, c, g, or t
  modified_base (385)..(385): a, c, t, g, unknown or other
  misc_feature (385)..(385): n is a, c, g, or t
  modified_base (387)..(387): a, c, t, g, unknown or other
  misc_feature (387)..(387): n is a, c, g, or t
tcagtacgagtatgcacgaccggtgctcgatttagctacgactgcaggggcagcaagatggtgttgcagacccaggtcttcatttctctgttgctctggatctctggtgccggacggggacatcgtgaangacccagttcnccacgactcctggttggtcttctcgtgggacgaggagggcccactatccgaatgactagccagcagtgtntttacatggcctaccaanaactacacgtactgtctagacncgagtaacgaaccagtacaccgtacccgtagtcctacgtagttacgcgactacgtaccgtaccgggcgtcccggtcctaacgtaccgacttagacgacgcgtacggtggtccaagggactacgtacttacgccncncgtactactactacaccacgacgacgacgtacgacgtgtagtcgtgtatacgtctacgtacgacgacgtactacgtacgtacgtacgtctaccgtacgtcgacggtacgtaccggacgtacgtacgtagtacgtacgtacgacgtacgtacgtacgtacgtacgacgtgtacgtacgtctacgtcgtaccgtaccgtaccgtacgtacgtacgtacgtacg

SEQ ID NO: 52608 - DNA, 675 bp, Homo sapiens
  misc_feature: GYAE6OF02JA7GD.18.11.A11.1.454.CMB.1.raw
  modified_base (211)..(211): a, c, t, g, unknown or other
  misc_feature (211)..(211): n is a, c, g, or t
tcagtacgagtatgcacgaccggtgctcgatttagctacgactgcaggggcagcaagatggtgttgcagacccaggtcttcatttctctgttgctctggatctctggtgccggacggggacatcgtgatgacccagtctccagacctcctggttgtgtctcgtggcgagacggccacatcaatgacaagtccagccagtagtttgtttaanacagcctaccaaacaagtaacaacttacttagcttaggaccagacaacgaaaccagacaccgtacccctaaggtcctactacgtttacgcggacctagtcccgtaccgggtacggtcccgggtcctagaccgtactcgacggtagcgacggtccgggtgtacgggaactagtacttccgaacgttccaccacgtactaccaaccgtaactcgaccgtaggtactagaaggtactggtacggtacttaacgttttactacgttacgtacgaacgtactaacgttaactagttaccgtccccttcacgttccgaccggttacgggaccggtagtaaccgggtagtaggtaactaacgtaaccgtaaacggctacggcgtaccgctacccgaagtttcccgtaagttcttacccgttagtaccgttcccggtcccctacttaaccgtccgttacgaacccgttaacg

SEQ ID NO: 52609 - DNA, 512 bp, Homo sapiens
  misc_feature: GYAE6OF02G620P.18.11.A11.1.454.CMB.1.raw
  modified_base (382)..(382): a, c, t, g, unknown or other
  misc_feature (382)..(382): n is a, c, g, or t
  modified_base (480)..(480): a, c, t, g, unknown or other
  misc_feature (480)..(480): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaaacaataacaactacttagcttggtaccagcagaaaccaggacagccccctaaggtcctcatttactgggcatcctacccgggagtccggggtccctgaccgattcagaggcaggcgggtctgggacagatttcactctcaccatcaccaactgcaggctgaagntgtgctagtttatactgtcagcaatactattagtcctcctctccaggtttcggcggagggaccgaaggtggagactacgaaacgactgtgctgcaccntctgtcttcattcctcccgctactctgactac

SEQ ID NO: 52610 - DNA, 505 bp, Homo sapiens
  misc_feature: GYAE6OF02FIXM5.18.11.A11.1.454.CMB.1.raw
  modified_base (420)..(420): a, c, t, g, unknown or other
  misc_feature (420)..(420): n is a, c, g, or t
  modified_base (425)..(425): a, c, t, g, unknown or other
  misc_feature (425)..(425): n is a, c, g, or t
  modified_base (463)..(463): a, c, t, g, unknown or other
  misc_feature (463)..(463): n is a, c, g, or t
  modified_base (472)..(472): a, c, t, g, unknown or other
  misc_feature (472)..(472): n is a, c, g, or t
tcagtacgagtatgcacgaccggtgctcgatttagctacgactgcaggggcagcaagatggtgttgcagacccaggtcttcatttctctgttgctctggatctctggtgccgacggggacattgtgatgacccagtctccagactccctggttgtgtctctgggcgagagggccaccatcaactgcaagtccagcccagagtgttttatacagctcccaacaataacaactacttagccttggtaccagcagaaaccaggacagccccctaaggtcctcatttactgggcatctaccggagtccgggtcctgaccgattcagaggcagcgggtctgggacagatttcactctcaccatccaccaacctgcaggctagaagatgtggctagtttattactgtcagcaatactattagtccncttcncacgtcggcggaggaccgaagtgagatcaaacgactgngctgcacgntctcgtctcgacttctcccgccatctgactacg

SEQ ID NO: 52611 - DNA, 568 bp, Homo sapiens
  misc_feature: GYAE6OF02F1OYW.18.11.A11.1.454.CMB.1.raw
  modified_base (412)..(412): a, c, t, g, unknown or other
  misc_feature (412)..(412): n is a, c, g, or t
  modified_base (561)..(561): a, c, t, g, unknown or other
  misc_feature (561)..(561): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctaccaaacaataacaactacttagcttaggtaccagcagaaaccaggacagccccctaaggtcctcatttactgggacatccgtacccgggagtcccggggtccctgaccgattcagaggcaggcgggtctgggacagtactttcactctacaccatccaaccaacctgcaggctgaagatgtggctagttttatcgtntcagctaatacttattacgtcccttcctctcgtaccggttcggacgggtacgggacgtaagggtggagactaccgaaacgtacgtgtacggcttacggactaccgtaattcctcgttcttacacttcccttacccgaccctattcccgntactacg

SEQ ID NO: 52612 - DNA, 597 bp, Homo sapiens
  misc_feature: GYAE6OF02FU683.18.11.A11.1.454.CMB.1.raw
  modified_base (385)..(385): a, c, t, g, unknown or other
  misc_feature (385)..(385): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaaacaataacaactacttagcttggtaccagcagaaaccaggacacgccccctaaggtcctactatttactgggcatccgtacccgggagtccgggtccctgaccgattcgagaggcagcgggtctgggacagtattcactctcaccatcaccaactgcagctgaagtntgtgctagttatacgtgtacagcaatactatacgtcccttctctacgtacgttccgggacggtaacggaccgagggtacggaacgacgttaaccgaaaacgtaacgtcgtacgggtccttacggacctaaccgtaattccgtttacggtaccctttaccgtacccgtttccgttaccccggtaccttacttccgttacggtaacttaaccgg

SEQ ID NO: 52613 - DNA, 679 bp, Homo sapiens
  misc_feature: GYAE6OF02FWXAS.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctcgtgggcgagagggccaccatcaactgacaacgtccacgccaggagttgtttttataacagtctaccaaacaaactaaacaacttacttacgtacgttcgtaccagacaacgaaaccaggacacgaccccctaacggtcctactatttacgtcggacactaccgtaccggggacggtccggggtccctcgacgacttacgacgaggcgacggcgggtcgcggacagtattcactctcaccactaccaccacctcgacacggctacgaagatcggtcggtcttaagtttactttacgtcgtacgagactaaactacttacgtacgttcccttccgtacttccgtaccgggtcgggtaccgggaacgggtaacgtacgggtacggaacgtacgtaacgaaaccgtacgttgggaccggtactcggtaccctaccgttacgtccgttttaccgttaccgtttaccttaccgttcccggtttcccccgtaactttaccgtacccgtttacgacctttaacccgg

SEQ ID NO: 52614 - DNA, 554 bp, Homo sapiens
  misc_feature: GYAE6OF02IC4T7.18.11.A11.1.454.CMB.1.raw
  modified_base (516)..(516): a, c, t, g, unknown or other
  misc_feature (516)..(516): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcaagaaaccaggaccacgacccccctaaggtccctctatttacgtgggcatccgtacccggggaggttcccggggtccctggacccgattccaggaggccaggcgggtcgtgggacaggactttcactctccaccatcaccaacctgcaggctgaagatgtgactagtttattactgtacagacaatactatacgttccctcctctctacggttcgggcggacggaccaagggtcgagtactaccgaaacgacgtagtcgctgaccacgnttcctgtcttacacttccttccgcctatctagactacg

SEQ ID NO: 52615 - DNA, 561 bp, Homo sapiens
  misc_feature: GYAE6OF02JXYJU.18.11.A11.1.454.CMB.1.raw
  modified_base (210)..(210): a, c, t, g, unknown or other
  misc_feature (210)..(210): n is a, c, g, or t
  modified_base (291)..(291): a, c, t, g, unknown or other
  misc_feature (291)..(291): n is a, c, g, or t
  modified_base (359)..(359): a, c, t, g, unknown or other
  misc_feature (359)..(359): n is a, c, g, or t
  modified_base (393)..(393): a, c, t, g, unknown or other
  misc_feature (393)..(393): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctcgtgggcgagagggccaccatcaactgcaagtccagccagagttgttttanacagctaccaacaataacaacttacttagcttaggtaccagacaacgaaaccaggacacgacccctaaggtcctcattacngggacactccgtaccgggacgtcccgggtcctcgaccgattacgagaggcagcgggtcgaggacagtnttcactcacacatcacactgacgagactagagtntgtgtactagtttactactgtacgacgtataactactatacgtcctctactacgtacggtacggacgggtacggaccgaggtggacgactacgaaacgacgtgtagctacgactacctgtcttcgtacttcgtacttcccgttacccgacctatacgtacgacttacg

SEQ ID NO: 52616 - DNA, 660 bp, Homo sapiens
  misc_feature: GYAE6OF02HMMHN.18.11.A11.1.454.CMB.1.raw
  modified_base (211)..(211): a, c, t, g, unknown or other
  misc_feature (211)..(211): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctcgtggcgagagggccaccatcaactgcaacgtccagccagagttgttttaanacagcctaccaacaataacaacttactagcttggaccagcagaaaccagacacgcccctaagtcctctatttactggacactcgtacccgggtacggtcccgggtccctgaccgtatcgagaggcagcgggtcgtggacagtacgtttcacctctcacctactccaccaaccctgaccgaggtctaggaacgtacgtaggtcgggtacttaggttttacttaccgttacggtacctacggtacctaaattacctacgtttaccgtaccccgttcccttaccgttaccgtaccgggttaccgggaccgggtaaggggaaccccgtaaggggtacggaacggtacgttaacccgaaaacggttcgtacggtcggtacctcggacctaccgtcttaccgttcgtcctttaccgaacttcccttaccccgcctagttcccgtacgtactaccg

SEQ ID NO: 52617 - DNA, 773 bp, Homo sapiens
  misc_feature: GYAE6OF02JVEAS.18.11.A11.1.454.CMB.1.raw
  modified_base (205)..(205): a, c, t, g, unknown or other
  misc_feature (205)..(205): n is a, c, g, or t
tcagtacgagtatgcacgaccggtgctcgatttagctacgactgcagggcgagctaagatggtgttgcagacccaggtcttcatttctctgttgctctggatcgtctggtgccgacgggacatcgtgatgaccagtctcagtctcctggttgtgtctctggcagaggcctaccagtcaactgcagtccagccagtacgtgtttanacagctaccaactaataacgaactacgttagcgttagaccagcaagaaccaggaaccacgtaccccctaaggtcctctaacgtttacgcggtactactacgtaccccgggagttcccgggtacccttacggaccgtattcgaggacggcacgggtaccgggtcgtacgggactaagtctttacgacctttcgacctaaccgtattcccgaacctaaccgtcgacccgtaaggtacctagaagtacgtcgtacggtaccttagtttttacgtacgtagtactacgtaacttaaacgtcttaacgttaccggttcccttacccggttacctacggtttaacccgggtttaccggggaaccgggtaacggttaacccgggtaaggttaaccggggtaaccgttaacgttaaaccgggaaaaacccgtttccggaaggtttaccggtaggttacccgtaacgggttaaacccttgggtttaaaccccgttgtttaacccccgttaacgtaccccgtttacccggtttaccccaaccgggttaattccccggttaacgaacctttaaccccgg

SEQ ID NO: 52618 - DNA, 527 bp, Homo sapiens
  misc_feature: GYAE6OF02IWXOM.18.11.A11.1.454.CMB.1.raw
  modified_base (405)..(405): a, c, t, g, unknown or other
  misc_feature (405)..(405): n is a, c, g, or t
  modified_base (472)..(472): a, c, t, g, unknown or other
  misc_feature (472)..(472): n is a, c, g, or t
  modified_base (477)..(477): a, c, t, g, unknown or other
  misc_feature (477)..(477): n is a, c, g, or t
  modified_base (484)..(484): a, c, t, g, unknown or other
  misc_feature (484)..(484): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagttgttttatacagctccaacaataacaactacttagcttggtaccagcaagaaaccaggacacgccccctaaggtcctcatttactgggcatctacccgggagtccggggtccctggaccgattcagaggcaggcgggtctgggacagtactttcactctcaccatcaccaactgcaggctgaagatgtgctagtttacttagtntcagctaatactatcgtcctcctctctacgtcggcggaggacgaaggtgagatacgaaacgacgtgngtcgngacactntccgtgtcttctacgttcccttccgtacctatcctagactacg

SEQ ID NO: 52619 - DNA, 711 bp, Homo sapiens
  misc_feature: GYAE6OF02I11HU.18.11.A11.1.454.CMB.1.raw
  modified_base (214)..(214): a, c, t, g, unknown or other
  misc_feature (214)..(214): n is a, c, g, or t
  modified_base (218)..(218): a, c, t, g, unknown or other
  misc_feature (218)..(218): n is a, c, g, or t
  modified_base (229)..(229): a, c, t, g, unknown or other
  misc_feature (229)..(229): n is a, c, g, or t
  modified_base (319)..(319): a, c, t, g, unknown or other
  misc_feature (319)..(319): n is a, c, g, or t
tcagtacgagtatgcacgaccggtgctcgatttagctacgactgcaggggcagcaagatggtgttgcagacccaggtcttcatttctctgttgctctggatctctggtgccggacggggacatcgtgatcgacccagtctccagactcccgtggttgtgtctcgtgggcgagaggccacatcaactgacaacgtccagccagtagttgttttanacanacctaccaaanaaactaaccaacttaaccttagcgttacggaaccagacaacgaaaccgaggaaccaccgtacccccgtaaggtccctactaagtttacgnggactacgttcccgtacccggggtacggttccccggggtaccctcggaaccgtattaccgaggacggtaccgagggtccgggtcgtagggaactaaggttctttaccactcctaccactaactaccaaccctaaccgtgacgtaacggtactaaggaacgtacgtgtacggtacttaagttttacttacgtcgttacaacgtactaaacttaacgtaacttacggttccccttccgttactcccggtacggttccgggaacgggtaacgggaaccgtagggtacgaagtaacctaaaccgtaaaacgtacgtcgtacgtacgtaccgactaccgttagttacctgttacctactaccgtacccttaccgacctactaccgtacgtcgtaacg

SEQ ID NO: 52620 - DNA, 560 bp, Homo sapiens
  misc_feature: GYAE6OF02FPOM9.18.11.A11.1.454.CMB.1.raw
  modified_base (290)..(290): a, c, t, g, unknown or other
  misc_feature (290)..(290): n is a, c, g, or t
  modified_base (383)..(383): a, c, t, g, unknown or other
  misc_feature (383)..(383): n is a, c, g, or t
  modified_base (393)..(393): a, c, t, g, unknown or other
  misc_feature (393)..(393): n is a, c, g, or t
  modified_base (474)..(474): a, c, t, g, unknown or other
  misc_feature (474)..(474): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagttgttttatacagcctaccaacaataacaactacttagcttggtaccagcaagaaaccaggacacgaccccctaaggtcctcatttacgngggcatcgacccgggagtcccgggtccctgaccgattcagaggcaggcggtcgtggacagtactttcactctcaccataccacccaactgacnggctagaagngtgtggactagttttatctgtcagacaatactattacgtcctcctctctacggttcggacgggacggaccgtaggtggaanacgtaacgaaacgtacgttggtcgtcgtacgccgacctgttcctagtccttctacgttccctcccgacctatccgtacgactaccg

SEQ ID NO: 52621 - DNA, 603 bp, Homo sapiens
  misc_feature: GYAE6OF02IJWH6.18.11.A11.1.454.CMB.1.raw
  modified_base (210)..(210): a, c, t, g, unknown or other
  misc_feature (210)..(210): n is a, c, g, or t
  modified_base (213)..(213): a, c, t, g, unknown or other
  misc_feature (213)..(213): n is a, c, g, or t
  modified_base (223)..(223): a, c, t, g, unknown or other
  misc_feature (223)..(223): n is a, c, g, or t
  modified_base (451)..(451): a, c, t, g, unknown or other
  misc_feature (451)..(451): n is a, c, g, or t
  modified_base (593)..(593): a, c, t, g, unknown or other
  misc_feature (593)..(593): n is a, c, g, or t
tcagtacgagtatgcacgaccggtgctcgatttagctacgactgcaggggcagcaagatggtgttgcagacccaggtcttcatttctctgttgctctggatctctggtgccggacggggacatcgtgatgacccagtctccagactccctggttgtgtctctgggcgagcgggccacctatcaactgacaagtccagcagagttgtttanacngctaccaaanaaataacaacttacttagcttggaccagacaagaaacaggacacgcccctaaggtcctactactttacgtcgggctactacgttaccggacggtcccggggttaccctcgaaccgtacgttacgaacggaggctaacggcgggtcgtagggaccagtctttacactctacgaccataccaacctacgtgactcggctacggatagtcgtagcgtagttatactgtcanactaatacaactacgtcctctctacgtcggtaccggcggaaacggtactaagggacgtacgtaacgacgtaaaccgaagtggtcgaccgtcgacgtactaacttgtacgttcctacgtacttcggaccctaccagttacccngtaacctacg

SEQ ID NO: 52622 - DNA, 646 bp, Homo sapiens
  misc_feature: GYAE6OF02J0IB7.18.11.A11.1.454.CMB.1.raw
  modified_base (214)..(214): a, c, t, g, unknown or other
  misc_feature (214)..(214): n is a, c, g, or t
  modified_base (296)..(296): a, c, t, g, unknown or other
  misc_feature (296)..(296): n is a, c, g, or t
  modified_base (328)..(328): a, c, t, g, unknown or other
  misc_feature (328)..(328): n is a, c, g, or t
  modified_base (565)..(565): a, c, t, g, unknown or other
  misc_feature (565)..(565): n is a, c, g, or t
tcagtacgagtatgcacgaccggtgctcgatttagctacgactgcaggggcagcaagatggtgttgcagacccaggtcttcatttctctgttgctctggatctctggtgccgacgggacatcgtgatgacccagtctccagacctcccgtggttgtgtctcgtgggcgaggagggcccaccatcaactgacaagtccagccagagttgttttanacagcctaccaacaataacaactacttagcttaggtaccagacaagaaaccaggaccacgacccctaagtcctctattacgnggctagtccgtaccgggacgtccggggtaccnggaccgattcgagagcgaggcgggtcagggactagtacttcactctacacatcaacacgtgacgtaggctagaacgtagtggtcgattaagtttactaacgtgtacacgactaagttactaacgttctccgtacctagttacgacggttccgggacgggtaaacggaccggaaggttaccgggaagtacgtaaacgtaaaccgggtagtcgggtacgtccgtacgaccgttaaccgnggttccctttaggttccctttaacgaccggttttaccccttaccccggtaccgtaccgtttacgaaccgtccttaaacccg

SEQ ID NO: 52623 - DNA, 688 bp, Homo sapiens
  misc_feature: GYAE6OF02H56RO.18.11.A11.1.454.CMB.1.raw
  modified_base (248)..(248): a, c, t, g, unknown or other
  misc_feature (248)..(248): n is a, c, g, or t
tcagtacgagtatgcacgaccggtgctcgatttagctacgactgcaggggcagcaagatggtgttgcagacccaggtcttcatttctctgttgctctggatctctggtgccgacgggacatcgtgatgacccagtctccagactccctggttgtgtctctgggcgagagggccaccatcaactgcaagtccagccagagttgttttatacagcctaccaacaataaacaactacttagcttggtaccngcagaaaccaggacacgccccctaaggtcctactatttacgcgggcactccgtacccggggagtcccgggggtccctggaccgattccgaagacggcaggcgggttacgtggggacagtactttccgacttctccaccataccaaccctaaccgtgaccagggtacctaggtaaacgagttggtacggtactaaggttttttaactaccgttgtactacgactaattaaccttaatacgttcccttacctccgttccgtaccggtttccgggaccggtaacgggaaacccgtaaggggtcgggaacgaacgttaccgaaaccggtaaacgtggtaccggtcctacggacctaacccgtaagttacccgttacgttaccctttaccgtaacctttccccgttcccccgtaccttaacgttccctacggtaacttaacccgg

SEQ ID NO: 52624 - DNA, 650 bp, Homo sapiens
  misc_feature: GYAE6OF02ICM04.18.11.A11.1.454.CMB.1.raw
  modified_base (211)..(211): a, c, t, g, unknown or other
  misc_feature (211)..(211): n is a, c, g, or t
  modified_base (294)..(294): a, c, t, g, unknown or other
  misc_feature (294)..(294): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctcgtgggcgaggagggccaccatcaactgcaagtccagccagagttgttttanacagctaccaaacaaataaacaactacttagcttcggtacagcaacgaaacaggacacgacccctaaggtcctacatttacgnggctatccgtacccggggtacggtcccggggtcctacgaccgtattcgaggtaggcgaggtcgggtctgggacagtattcactcctacaccactaccaaccacctgacctaggctagaacgtagtgtacggtacgttagtttacttacgtagtacgacgactaactacttacttactccttccttcctacgtacggttcgggtacggacgggaaccggtaacggtacggacgacgtaacgaaacgtaacgtacggtacgtacgtacgacgtccgtaaaaaaaaacgttccgttacgttccttacctaccgttacccgttcccgtacccttaccgttaccgttaccgtacgtaaccg

SEQ ID NO: 52625 - DNA, 691 bp, Homo sapiens
  misc_feature: GYAE6OF02IB8XI.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagttgttttatacagctccaaacaataaccaacttacttagcttggtaccagcaagaaaccaggacacgccccctaaggtcctactatttactgggctatccgtacccggggacggttcccggggtccctaggaccgtattcgaggacggcgaggtcgggtcctagggacaggtactttcgaccttcgtaccacctagtaccaacctaaccgtgaccgagggtacctaggaacggtacgttggtacgggtacttaaggtttttaacttaaccgtgttacgaacggtactaaactttaaccgttagttaaccgtttccctaccttaccgtaccgttaaccggggtttccgggacgggtaaacgggaacccgtaagggttcgggaaatacgaaaccgtaaaacgtacgttgtacggcttacgacctaccgtacttccgtcgttaccttccaacgtttcccgttcccggacctacgttaccttacgaccttaaccg

SEQ ID NO: 52626 - DNA, 655 bp, Homo sapiens
  misc_feature: GYAE6OF02GEH1Q.18.11.A11.1.454.CMB.1.raw
  modified_base (286)..(286): a, c, t, g, unknown or other
  misc_feature (286)..(286): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctaccaacaataacaactacttagcttaggaccagcagaaaccagacacgaccccctaaggtcctcatttacgnggacactcgtacccgggagtcccgggtcctgaccgattcgagacggcaggcgggtcgtgggacagtacttcactctacacctatccacctacctgacgacggctagaacgatggtacggactttaagtttacttacgtagtactagtactaaattactagttaccgtcccttacctctaccggtaccggtttcgggaccgggtaacgggaaccggtaagggtacgggaacgtaacgttaacgaaaaccgtacgttcggtacggcgttacgacctaacccgtactttaccgttacggtttacccttacgtacccgttaccccgtttaccccggtaccttaaccgttccggttaccgaaccgtttaacccg

SEQ ID NO: 52627 - DNA, 641 bp, Homo sapiens
  misc_feature: GYAE6OF02I4V6F.18.11.A11.1.454.CMB.1.raw
  modified_base (201)..(201): a, c, t, g, unknown or other
  misc_feature (201)..(201): n is a, c, g, or t
  modified_base (209)..(209): a, c, t, g, unknown or other
  misc_feature (209)..(209): n is a, c, g, or t
  modified_base (289)..(289): a, c, t, g, unknown or other
  misc_feature (289)..(289): n is a, c, g, or t
  modified_base (469)..(469): a, c, t, g, unknown or other
  misc_feature (469)..(469): n is a, c, g, or t
  modified_base (474)..(474): a, c, t, g, unknown or other
  misc_feature (474)..(474): n is a, c, g, or t
tcagtacgagtatgcacgaccggtgctcgatttagctacgactgcaggggcagcaagatggtgttgcagacccaggtcttcatttctctgttgctctggatcgtctggtgccgacggggacatcgtgatgacccgagtctccagactccctggttgtgtctctgggcgagagggccaccatcaactgcaagtccagccagngtgtttanacagctcaacaatacaactacttagcttggtaccagacagaaaccaggacacggaccccctaaggtcctacaatttacgngggcactcgtacccggggtagtcccggggtccctggaaccgtacttccaggtacggcctacggcgggttctaggacacgtatttcaactcgtacaccatcaaccgaactggacacgggactaggaacgtctgggtacgctaaggtttactatcggtcagactaactactagtacttcccnctacnctacgttcggacggtaggactaacggtgaactactacgtaaaccgacgttagggacgtaccgtcgaaccggtaaccctacgggtttaacctcgggtttaacccttacgaaccgttttacccccggtccccggtacaaccgttttccgggttacgaaccctttaaccg

SEQ ID NO: 52628 - DNA, 559 bp, Homo sapiens
  misc_feature: GYAE6OF02JXJ58.18.11.A11.1.454.CMB.1.raw
  modified_base (223)..(223): a, c, t, g, unknown or other
  misc_feature (223)..(223): n is a, c, g, or t
  modified_base (260)..(260): a, c, t, g, unknown or other
  misc_feature (260)..(260): n is a, c, g, or t
  modified_base (264)..(264): a, c, t, g, unknown or other
  misc_feature (264)..(264): n is a, c, g, or t
  modified_base (286)..(286): a, c, t, g, unknown or other
  misc_feature (286)..(286): n is a, c, g, or t
  modified_base (373)..(373): a, c, t, g, unknown or other
  misc_feature (373)..(373): n is a, c, g, or t
  modified_base (457)..(457): a, c, t, g, unknown or other
  misc_feature (457)..(457): n is a, c, g, or t
  modified_base (493)..(493): a, c, t, g, unknown or other
  misc_feature (493)..(493): n is a, c, g, or t
  modified_base (519)..(519): a, c, t, g, unknown or other
  misc_feature (519)..(519): n is a, c, g, or t
tcagtacgagtatgcacgaccggtgctcgatttagctacgactgcaggggcagcaagatggtgttgcagacccaggtcttcatttctctgttgctctggatctctggtgccgacgggacagtcgtgatgacccagtctccagacctcccgtggttcgtcgtctcgtgggcgagacgggcccaccgatccaacgtcgccaacgtccagccagagtgtttacacngcctaccaacaataaccactacttgcttgaccagcanaacngacacgccctagcctcattcgnggcagtccgacccgggacgtcccgggtcctcggaccgtagtccgagcggcaggtccgggtcgtacgggactaggctttccacgttcnccgaccactccaaccaccgtgccacgggtccaggaacgtgtgtacggacttaacgtttactacgttacgctacgactataactntacgtcctcctctcgtcgtcggcgacggacgtaggngacacgtacgtaacgagtcgtcgtcncgcaccgtatcgtctcttcctctctcctcatctatactac

SEQ ID NO: 52629 - DNA, 749 bp, Homo sapiens
  misc_feature: GYAE6OF02G26PX.18.11.A11.1.454.CMB.1.raw
  modified_base (227)..(227): a, c, t, g, unknown or other
  misc_feature (227)..(227): n is a, c, g, or t
  modified_base (458)..(458): a, c, t, g, unknown or other
  misc_feature (458)..(458): n is a, c, g, or t
tcagtacgagtatgcacgaccggtgctcgatttagctacgactgcagggggtcgagcaagatgggttgttgcagaccctaggtcttcatttctctgttgctctggatctctggtgccggacggggacagtcgtgatggacccagtctccagacctccctggttgtgtctcgtgggcgacgagggaccaccatcgaactgcaagtccgacgccaggagttgttttaanacgacggcctaccgaacgaaataacaaccttaacttacgcttcggtaccagcaacgaaaccgaaggaccaacgtaccccctaaggtccctactatttaccgtacgggactaccgtacccgtaacccgggacggttcccggggtccctacggacccgtacttacgaacggacgcgacggtcgggtcgtaggacgagtacgttcacgtcactaccgactaccaaccgtaaccncgacgtacggtctaagtaagtacgtggtacggtaccttaaggttttactaacgttcgtacaacggtactaaacgtttacgttaacggttaaccgttacccgttaccttaccgttaccggttaaccggttccggggtaccggggaaccggggtaacccggttaagggtacggtaacgtaacgtaaccgtaaaccggtacgtccggtacgttaccgaccgacgacctacgttccgttacgttccttcgtaccttcccgttccccgtaccttacgaccgttacgtacctaaccg

SEQ ID NO: 52630 - DNA, 520 bp, Homo sapiens
  misc_feature: GYAE6OF02FF15T.18.11.A11.1.454.CMB.1.raw
  modified_base (283)..(283): a, c, t, g, unknown or other
  misc_feature (283)..(283): n is a, c, g, or t
tcagtacgagtatgcacgaccggtgctcgatttagctacgactgcagggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagcccctaaggtcctcatttacngggcatctaccggagtccggggtccctgaccgattcgagaggcaggcgggtctgggacagatttcactctcaccatcacaactgcaggctagaagatgtgctagttatactgtcagacaatatatcgtcctctctctacgttcggacggtacggacagggtgagatacgaaacgtagtcgtgtactgaccacctatctacgttcttacagttcctacccggcctatcctagactacg

SEQ ID NO: 52631 - DNA, 719 bp, Homo sapiens
  misc_feature: GYAE6OF02HAGF6.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctcgtgggcgagagggccaccatcaactgcaagtccagccagagttgttttatacagcctaccaaacaataacaactacttagcttggtaccagcaagaaaccaggacacgaccccctaaggtcctctatttacgtggacacgtccgtacccgggacggttcccggggtccctcggaccgtattcgaggaggcgaggtcgggtcgtagggacagtactttaccacgttcctaccgacctactacccaaccctaacctcgaccgaaggtcgtaggtaaacgtacgttcggtacggtacctttaaggttttaacttacgttagtacctaaggtacttaaacgttacctttaacgttaccgtttccccttacccgtttaccgttaccgttaaccggttaccgggaacgggtaaccgggaaccggttaagggtacggaacgtaacgttaaaccgaaacgtacgtagggtaccgtcctacggtccctaacgtaccgttcgttaccggttacttaccgtaccgttccccgttacccgtaccttacctttaccgacgtaaccctaaccg

SEQ ID NO: 52632 - DNA, 550 bp, Homo sapiens
  misc_feature: GYAE6OF02GPBMP.18.11.A11.1.454.CMB.1.raw
  modified_base (291)..(291): a, c, t, g, unknown or other
  misc_feature (291)..(291): n is a, c, g, or t
  modified_base (498)..(498): a, c, t, g, unknown or other
  misc_feature (498)..(498): n is a, c, g, or t
  modified_base (511)..(511): a, c, t, g, unknown or other
  misc_feature (511)..(511): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctaccaacaaataacaactacttagcttggtaccagcaagaaaaccaggaccacgccccctaaggtcctcattttacgnggcatccgtacccgggagtcccggggtccctgaccgattcagacggcagcgggtcgtgggacagtatttcactctcaccatcaccactgcaggcagaagatggtcggctagttttatactgtacagactaatactatacgtcccttcctctccgtacgttcgggcggaacgggaccaggggtgaacgataaccgaaacgtacgtcgngactgccaccgtntctcgtccttctacttcctcccgcctactctacactacg

SEQ ID NO: 52633 - DNA, 553 bp, Homo sapiens
  misc_feature: GYAE6OF02GAHO8.18.11.A11.1.454.CMB.1.raw
  modified_base (508)..(508): a, c, t, g, unknown or other
  misc_feature (508)..(508): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacacgccccctaaggtcctcatttactgggcatcctacccggggagtcccggggtccctgaccgtattcagaggcacggcgggtcgtgggacagtactttcactctccaccatcaccaacctcgcaggctagaagtatgtggctagtttattacctgtcagactaatactatactccctctctctacgttcggcggacggacgtaggtggagtataccgaaacgtacgtgtcgctcgcctacgtatcgttnttccttacacctttcccgttacccgcctacttcgttcgacctacg

SEQ ID NO: 52634 - DNA, 543 bp, Homo sapiens
  misc_feature: GYAE6OF02INCIA.18.11.A11.1.454.CMB.1.raw
  modified_base (282)..(282): a, c, t, g, unknown or other
  misc_feature (282)..(282): n is a, c, g, or t
  modified_base (422)..(422): a, c, t, g, unknown or other
  misc_feature (422)..(422): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccagacacgcccctaaggtcctcatttacngggcatcgtacccgggagtcccggggtcctgaccgtattcagaggcagcgggtctgggacagtattcactctcacatcaccaactgacaggctagaagatgtgctagtttatactgtcagacaatactatacgtcctctntctacggtcggacggaggtaacagggtgaagtatacgaaacgtactggtagctgtaccaccgacttccgtcgttccttacctagttcccgttccccgacctagttcctacggacttaaccg

SEQ ID NO: 52635 - DNA, 562 bp, Homo sapiens
  misc_feature: GYAE6OF02IPNQM.18.11.A11.1.454.CMB.1.raw
  modified_base (253)..(253): a, c, t, g, unknown or other
  misc_feature (253)..(253): n is a, c, g, or t
tcagtacgagtatgcacgaccggtgctcgatttagctacgactgcaggggcagcaagatggtgttgcagacccaggtcttcatttctctgttgctctggatctctggtgccgacgggacatcgtgatgacccagtctccagactccctggttgtgtctctgggcgagagggccaccatcaactgcaagtccagccagagtgttttatacagctccaacaataacaactacttagcttggtaccagcagaaccnggacagccccctaaggtcctcattactggcatctaccgggagtccggggtcctgaccgattcagaggcagcgggtctgggtaccaggtatttacacttacgtcacctatccaaccaaccgtgcgaggctgaagtacgttgtgggactagttttagttactggtcaggactaatacgtatagtccctctctcacgtttcggcggacggaccgaagggtcgagacttacgaaacgtacgtagtcgcttggccacccgtagttcctacgttcttaccgattccctttacccgcctacgtctacgaccgtaac

SEQ ID NO: 52636 - DNA, 607 bp, Homo sapiens
  misc_feature: GYAE6OF02G0WY0.18.11.A11.1.454.CMB.1.raw
  modified_base (421)..(421): a, c, t, g, unknown or other
  misc_feature (421)..(421): n is a, c, g, or t
tcagtacgagtatgcacgaccggtgctcgatttagctacgactgcaggggcagcaagatggtgttgcagacccaggtcttcatttctctgttgctctggatctctggtgccgacgggacatcgtgatgacccagtctccagactccctggttgtgtctctgggcgagagggccaccatcaactgcaagtccagccagagtgttttatacagctccaacaataacaacttactagcttggtaccagcagaaaccaggacacgcccctaaggtcctcatttactgggcatccgtacccgggaggttcccggggtccctggacccgattcagagcagcgggtctgggacagtattcacttcaccacatccacaacctgacaggtcacgaagtactggtagtacttaagtttattacgtcgttanaacggtataaactacttaagttacgtcccttactacctccgtacggtttcgggacggtacgggaccctaagggtcgggaataactaccgtaaaacgtacgtagggtacgtactacgacctacgtacttccgttcgttaccttacctacttcccggttccctacctacgttcgtacgaccttaaccg

SEQ ID NO: 52637 - DNA, 839 bp, Homo sapiens
  misc_feature: GYAE6OF02HQE2W.18.11.A11.1.454.CMB.1.raw
  modified_base (209)..(209): a, c, t, g, unknown or other
  misc_feature (209)..(209): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagttgttttanacagctaccaaacaaataaacaacttacttagcttcggtaaccagcaagaaaccaggacacgacccctaacggtcctacatttacgtggctacgtccgtaacccgggtaggtcccgggggttccctacggaccgtacttcgaggtacggacgaggtccggggtacgtacggggacaggtactttaccgaccgtcctaccaaccctaacttacccaaacccgtaacccgtacgaccgtaacgggtccgttaacgggaaacggtaacggtttcgggtacggggtaccgttttaaacgggttttttaactttaaccgttggtttaaccgtacggtaaacctaaacgtttaacgttaaactttaaccggtttacccccgttacccgtttacccgtaccgtttaaccgggtttacccggggtaaccgggggtaaccgggggtaaccgggtaaacgggtacgggtaaacggtaacgttaaacgtaaaaacccggtaaacggttcggtaacgggtacgtaccggaaccctaacccgtaagttcccgtttaacgttcccgtttaacccgtaaccgtttaccccggttacccccgtaacccgttaaccgtttcccgttacccggtaacctttaacccgg

SEQ ID NO: 52638 - DNA, 650 bp, Homo sapiens
  misc_feature: GYAE6OF02GWEVQ.18.11.A11.1.454.CMB.1.raw
  modified_base (212)..(212): a, c, t, g, unknown or other
  misc_feature (212)..(212): n is a, c, g, or t
  modified_base (293)..(293): a, c, t, g, unknown or other
  misc_feature (293)..(293): n is a, c, g, or t
  modified_base (357)..(357): a, c, t, g, unknown or other
  misc_feature (357)..(357): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctcgtgggcgaggagggccaccatcaactgacaagtccagccagagttgttttanacagctaccaaacaataacaactacttagctaggtaccagcaagaaaccaggacacgaccccctaaggtcctacatttacngggacatacgtacccggggacgtcccggggtccctggaccgattcagacggcacggcgggtcgngggacagtattcactctcaccatcaaccactcgacacggtctagaagagtcgtggtactaaggttttactacgtcgtacagtactaattactaattacggtacccttccttccgtcgtaccggtttacgggaccgggtaacgggtaaccgaagggtaggtacgaacgtaaccgaaaacgtacgtggtacggtaccttacggacctaacccgtagttaccgttacgttaccctttaccgtaacgttcccccgtttacccgacccttaactttccgtaccggtaaccttaacccg

SEQ ID NO: 52639 - DNA, 518 bp, Homo sapiens
  misc_feature: GYAE6OF02G33DW.18.11.A11.1.454.CMB.1.raw
  modified_base (389)..(389): a, c, t, g, unknown or other
  misc_feature (389)..(389): n is a, c, g, or t
  modified_base (408)..(408): a, c, t, g, unknown or other
  misc_feature (408)..(408): n is a, c, g, or t
  modified_base (413)..(413): a, c, t, g, unknown or other
  misc_feature (413)..(413): n is a, c, g, or t
  modified_base (458)..(458): a, c, t, g, unknown or other
  misc_feature (458)..(458): n is a, c, g, or t
  modified_base (484)..(484): a, c, t, g, unknown or other
  misc_feature (484)..(484): n is a, c, g, or t
  modified_base (512)..(512): a, c, t, g, unknown or other
  misc_feature (512)..(512): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagttgttttatacagctccaacaataacaactacttagcttggtaccagcaagaaaccaggacacgccccctaaggtccctcatttactgggcatcctaccccgggagtcccggggtccctgaccgattcagaggcagcgggtctgggacagactttcgactctcaccatcaccaacctgcaggctgaagntgtcggctagtttatactntacanacaatctatagtcctcctctctacgttcgcggaggacagggtganacgtaacaacgtatggtgctgcactntctcgttctctactcctccgactctctnactacg

SEQ ID NO: 52640 - DNA, 656 bp, Homo sapiens
  misc_feature: GYAE6OF02IFLRH.18.11.A11.1.454.CMB.1.raw
  modified_base (222)..(222): a, c, t, g, unknown or other
  misc_feature (222)..(222): n is a, c, g, or t
  modified_base (319)..(319): a, c, t, g, unknown or other
  misc_feature (319)..(319): n is a, c, g, or t
  modified_base (419)..(419): a, c, t, g, unknown or other
  misc_feature (419)..(419): n is a, c, g, or t
  modified_base (464)..(464): a, c, t, g, unknown or other
  misc_feature (464)..(464): n is a, c, g, or t
  modified_base (487)..(487): a, c, t, g, unknown or other
  misc_feature (487)..(487): n is a, c, g, or t
  modified_base (493)..(493): a, c, t, g, unknown or other
  misc_feature (493)..(493): n is a, c, g, or t
  modified_base (582)..(582): a, c, t, g, unknown or other
  misc_feature (582)..(582): n is a, c, g, or t
  modified_base (604)..(604): a, c, t, g, unknown or other
  misc_feature (604)..(604): n is a, c, g, or t
  modified_base (642)..(642): a, c, t, g, unknown or other
  misc_feature (642)..(642): n is a, c, g, or t
tcagtacgagtatgcacgaccggtgctcgatttagctacgactgcaggggcagcaagatggtgttgcagacccaggtcttcatttctctgttgctctggatctctggtgccggacggggacatcgtgatgacccagtcctccagactccctggttgtgtctcgtggggcgaggacgggcccaccatacaactgacaacgtccacgccagagttgtttttaanacacgcctaccaaacaaataaccaaacttacttagtcttacggtaccagacaaacgaaaaccaggaccacgaccccctaaggtcctactattaccgngggactacgtccgtaacccggggacggtccccggggtcccacgacctacttacgacggacggcgacggcgggtacgtagggactagtacttacacttccncaacctagtaccaaccctaaccgtgaccgacggtcgagtaaacgngttggacggtcttaagtttttanaccgtntacgaagacttaacgtatacgtacgtcccctacttcgtacgtaccggtcggtacggaacgggacaaggtgaacgtaaccacgtaaacgngtggcgtactgacctaaccgtnttccgtgttcctacctacgttcccttcccgacgttacnccttagaccttacg

SEQ ID NO: 52641 - DNA, 860 bp, Homo sapiens
  misc_feature: GYAE6OF02JFWY4.18.11.A11.1.454.CMB.1.raw
  modified_base (204)..(204): a, c, t, g, unknown or other
  misc_feature (204)..(204): n is a, c, g, or t
  modified_base (210)..(210): a, c, t, g, unknown or other
  misc_feature (210)..(210): n is a, c, g, or t
  modified_base (289)..(289): a, c, t, g, unknown or other
  misc_feature (289)..(289): n is a, c, g, or t
  modified_base (326)..(326): a, c, t, g, unknown or other
  misc_feature (326)..(326): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatcgacccagtctccagactccctggttgtgtctcgtgggcagagggccacatcaactgacaagtccagccagtagtnttttanactagctacaacaataacaactacttagcttaggaccagacaagaaaccgagacacgacccctaaggtcctctattacncggcactaccggtacccgggacgttcccgggtacccngtaccgtagttccgaggacgacaagggtcgggtcgtaggggtaacctagtaacgtttacccgaaccttcctaccgaaccctacgtaaccctaaacccgtaaacccgttcggaaccgaacgggtaccgttaggaaacggtacggtttggtaacggtttaccttaacggtttttaactttacggttaccggttaacgtaacggtaaccttaaacgttttaaacctttaacgttaaccgtttcccccgtttaacccgtttcccgttaaaccggttacccgggttttaacccggggaaccggggtttaaaaccgggtaaccgggtttaaagggggttaaccgggtaaggttaaacccgttaaaacgggtaaaacccggttaaacggtttaccgggtttacgggttacccgttacccggacgttaaaccccggtactttaacccggtttcggtttaaccccttttaccggtttaacccgttccccggttttaaccccggtacccttaacggtttcccctaacggtaacccgtttacccg

SEQ ID NO: 52642 - DNA, 672 bp, Homo sapiens
  misc_feature: GYAE6OF02HUDHD.18.11.A11.1.454.CMB.1.raw
  modified_base (219)..(219): a, c, t, g, unknown or other
  misc_feature (219)..(219): n is a, c, g, or t
tcagtacgagtatgcacgaccggtgctcgatttagctacgactgcaggggcagcaagatggtgttgcagacccaggtccttcatttctctgttgctctggatctctggtgccggacggggacatcgtgatgacccagtctccagactccctggttgtgtctcgtgggcgaggagggcccaccatacaactgacaacgtccagccagagttagtttttanacagcctaccaaacaaataaccaacttacttagtcttacggtaccagaccaacgaaaaccaggaaccaccgaccccctaaggtcctactatttacgtggacactccgtaccgggacgttcccggggtaccctgaccgtatacgaggacgacgagcgggtcgtggactagtacttccactctacactacaccaaccacctgacacgggtctaggaagtataggtgggtaaccttaaggttttaacttacgtacgtaacaagtacctaaagttactagttacccgtccctccgtacttacgtaccggtaccgggcgggtaacgggaacctaaggggtacgaaacggtactaaaccgaaaacggtactggtacgacctacggacctaccgtaacttcgtaaccgttcttaacctaccgttccccgttcccgaaccttactccgttagtacctaacg

SEQ ID NO: 52643 - DNA, 562 bp, Homo sapiens
  misc_feature: GYAE6OF02GH1F2.18.11.A11.1.454.CMB.1.raw
  modified_base (503)..(503): a, c, t, g, unknown or other
  misc_feature (503)..(503): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagttgttttatacagctccaacaataacaactactagcttggtaccagcagaaaccaggacacgccccctaaggtcctcatttactgggcatcctacccgggagtccggggtccctggaccgattcagaggcaggcgggtctgggacaggattcactctcaccatcaccaacctgcaggctaggaacgagtggtggtactagttttattacgttgtctaagactaatactaagttacgtcccttcctcctcgtaccgtttcgggacgggacgggtaccgaagggtggagactacaaacggactgnggctgacacctatctacgtcttactacgttccttaccccgctacgtcctacgacttacc

SEQ ID NO: 52644 - DNA, 640 bp, Homo sapiens
  misc_feature: GYAE6OF02HTO68.18.11.A11.1.454.CMB.1.raw
  modified_base (210)..(210): a, c, t, g, unknown or other
  misc_feature (210)..(210): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagttgtttttanacagctccaacaataaacaactacttagcttaggtaccagcaagaaaccaggacacgaccccctaaggtcctctatttacgtgggcatccgtacccggggaggttcccggggtccctggacccgtattcgagacggcgaggcgggtcgtgggacaggtatttcactctccactactcaacctaccgtgacgacggcgtagaagagtggtacggtactagttttaactacgtgttcagtactaattactaattacgtccctccgttcctaccgtacggtttccgggacgggtacgggaccctaagggacggtagtaactacgaaaaccggtacgtacggttacggccgtacgtcctaaccgtacttccgttacgtccgtttacctaccgtttcccgttccccggacctacgttacctaccggacttaaccg

SEQ ID NO: 52645 - DNA, 693 bp, Homo sapiens
  misc_feature: GYAE6OF02HYZ8K.18.11.A11.1.454.CMB.1.raw
  modified_base (210)..(210): a, c, t, g, unknown or other
  misc_feature (210)..(210): n is a, c, g, or t
  modified_base (216)..(216): a, c, t, g, unknown or other
  misc_feature (216)..(216): n is a, c, g, or t
  modified_base (229)..(229): a, c, t, g, unknown or other
  misc_feature (229)..(229): n is a, c, g, or t
  modified_base (247)..(247): a, c, t, g, unknown or other
  misc_feature (247)..(247): n is a, c, g, or t
  modified_base (304)..(304): a, c, t, g, unknown or other
  misc_feature (304)..(304): n is a, c, g, or t
  modified_base (393)..(393): a, c, t, g, unknown or other
  misc_feature (393)..(393): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtcctccagacctccctggttgtgtctcgtgggacgagacgggcccaccatcaactgacaagtccagccagagttnttttanacagcctacaaanaataacaacgtattacgnttacggaccagctaaagaaaccaggaactacggacccctaaggtcctacatttacgnggacactaccgtacccggagtcccggtacctacgacgtactcgagagctaggtcgggtctagggacagtaacttcacgtctacacgtanccaacctacctgacctagggacctaggaaacgtgtgtacggtactaagttttaatactggttaacaacggtaactaaattaaccaagttaaccggtttccctccttaaccgttccgtacgggtttaccgggaccgggaaacgggttaaccgaaacggtggaacgtaacgttaaacgaaaacccggtattacggtacgggaccttaaccccgacttaacgtcccggtttaggtaccctttacttaacccgttccgtttcccccggacctaggttacccgtacggtaaccctattaacccgg

SEQ ID NO: 52646 - DNA, 758 bp, Homo sapiens
  misc_feature: GYAE6OF02JMMIK.18.11.A11.1.454.CMB.1.raw
  modified_base (209)..(209): a, c, t, g, unknown or other
  misc_feature (209)..(209): n is a, c, g, or t
tcagtacgagtatgcacgaccggtgctcgatttagctacgactgcaggggcagcaagatggtgttgcagacccaggtcttcatttctctgttgctctggatctctggtgccgacgggacatcgtgatgacccagtctccagactccctggttgtgtctcgtgggcgagaggaccaccatcaactgcaagtccagcagtagttgttttanacagctaccaacaataacaacttacttagcttacggaaccagaccaagaaaccaggtaccaccgtaccccctaaggtccctgtaacttacgtgggacctactaccggtaacccgggtacggtaccccgggtccctacggaccgtacttaccgaggacggtcagggtcggtacggtagggacgtaacgtcgtttacgaccttctaccgtacctacgtaccctaacccgtaaccgtacgaccggtaacgggtaccgttaaggaaccgtagtacgggtacggttacgttaacgtttttaaacgttacgttacggtacgtaacggttaactaaaccttattaacgttaccgttacccttccgttaaccgtaccggttaccggtccggggtaacggaccggaaccgggttaacggtacggaagtacgttaaccggaaacgttaccgtacgggtcgtactacggacttacccgaagtttccctcgggttaccttaccgttaaccggttccccgttaccgtaccgttaacgtaccgttaccgtaaccgttaacccg

SEQ ID NO: 52647 - DNA, 790 bp, Homo sapiens
  misc_feature: GYAE6OF02GUCF7.18.11.A11.1.454.CMB.1.raw
  modified_base (211)..(211): a, c, t, g, unknown or other
  misc_feature (211)..(211): n is a, c, g, or t
  modified_base (298)..(298): a, c, t, g, unknown or other
  misc_feature (298)..(298): n is a, c, g, or t
  modified_base (713)..(713): a, c, t, g, unknown or other
  misc_feature (713)..(713): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctcgtgggcgagagggccaccatcaactgcaagtccagccagtagttgttttanacagcctaccaaacaataacaactacttagcttacggtaccagcaagaaaccaggaccacgaccccctaaggtcctactatttacgngggactacgtccggtacccgggtacggttcccggggtaccctaggtacccgtacgttaccgacggacggtccgagggtccggggtacgtcggggaactaggtacctttaccgaaccgttcctacctaaccgtaacgttacccaaacccgtaaccgttcgaccgtaacgggtccgttaaggaacgtacgttgggtaccgggtacctttaacgggtttttaatttacccggtcggttaaccgtaaggtaccttaaaacgttaccgtttaacgttaccgtttccccgttaacccttccgttaccggttaccgggtttccgggaacggggtaaccgggtaacccgtaaggggttccgggaagttaaccgtaaccggtaaaaccgtacgtacgggttcgggtacctgaccctaaccggtnttacccggtcgttaccgtttacccgtacgtttaccccgtcccggaccttacgtttacccggtacgttaacctaaccg

SEQ ID NO: 52648 - DNA, 730 bp, Homo sapiens
  misc_feature: GYAE6OF02FP409.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagttgttttatacagccctacaaactaaactaactaacttactacgtcgttacgtacgacacaacgaacgacgacgacccgtacccgtacgtcctattacttacggcggactacgtacccgggtaccgggtaccgggtccccggtccgtaccgaccgtacttacggaggcggacgacgggtccggttcggtacggacgtagttacttacgtacctccgtaccaactactaacccaacccgtacgtcgacgacgtacgtaacgaagtacgtggtacggacttttaacgttttaactcggtcaacgtacgtaacttaaacttaccttaggttacccttcccgttacttccgttaccgggttacgggtaccggggaacgggttaacggaaccggttaggggtacgaaacgttacgtaaaaccgaaaccggttaggttagggtcccgtagtaccggaccctaacggttccttacggtctttaaccctaccgtaccgtttcccgtcccgtactacgtttaccgacgtacttaacccg

SEQ ID NO: 52649 - DNA, 726 bp, Homo sapiens
  misc_feature: GYAE6OF02G8RJT.18.11.A11.1.454.CMB.1.raw
  modified_base (221)..(221): a, c, t, g, unknown or other
  misc_feature (221)..(221): n is a, c, g, or t
  modified_base (620)..(620): a, c, t, g, unknown or other
  misc_feature (620)..(620): n is a, c, g, or t
  modified_base (684)..(684): a, c, t, g, unknown or other
  misc_feature (684)..(684): n is a, c, g, or t
tcagtacgagtatgcacgaccggtgctcgatttagctacgactgcaggggcagcaagatggtgttgcagacccaggtcttcatttctctgttgctctggatctctggtgccggacggggacatcgtgatgacccagtcctccagacctccctggttgtgtctcgtgggacgaggacgggcccaaccataccaactgacaagtccagccagtagttgtttanacagtcctaccaaacaaataaacaacttacttagtcgttaggaccagacaacgaaaccaggacacgacccctaagtcctactacttacgtcggactacgttacccggaacccggggtacggttccccggggtacccctaggaacccgtacttcggaaggacgggactacgggtccgggttcgacggggtaacaggttacttccaacctcctaaccaacctactaccctaaaccgtactcgaccgtaacggtcctaggaaacgtcgtagggtacgtacgtttaaggttttaacttacgtcggtaaactaacggtaccttaaacgttacgttaacgttaccgttccccttaccgttacgttaccgtacggttccgggacggtaaccgggtacgtaacgggngtaacgaactaaccgaaacggtcgtgacgtcaggacctaccgtaattcgtacgttaccgttacnccgttcccgttacccgtactaccgtaccgtcgaccttaaccg

SEQ ID NO: 52650 - DNA, 639 bp, Homo sapiens
  misc_feature: GYAE6OF02FT9K1.18.11.A11.1.454.CMB.1.raw
  modified_base (391)..(391): a, c, t, g, unknown or other
  misc_feature (391)..(391): n is a, c, g, or t
tcagtacgagtatgcacgaccggtgctcgatttagctacgactgcaggggcagcaagatggtgttgcagacccaggtcttcatttctctgttgctctggatctctggtgccggacggggacatcgtgatgacccagtctccagactccctggttgtgtctctgggcgagagggcccaccatcaactgcaagtccagccagagttgttttacacagctccaaacaataacaacttacttagcttaggaccagcaagaaaccaggacacgccccctaagtcctactatttactggcactccgtacccgggagtccgggtcctagaccgattcgaggacgcagcgggtctggacagtattcgactcacacactcaccactcgcgagctagaagntagtggactaagttttaacttacgtacgtacgagtactaagttaacttagttaacgttccttaccctcgtccgttaccgggtttaccgggcgggtaaccgggaaccgtaagggttggaacggtacgtaaccgaaaaccgtacgttacgtacggaccgttcgaaccgaacctaacgttcctcggtttacccgttaccgtaaccgtttcccgttaccccggaccttacgtaccgtacggtaaccttaacg

SEQ ID NO: 52651 - DNA, 791 bp, Homo sapiens
  misc_feature: GYAE6OF02F96NE.18.11.A11.1.454.CMB.1.raw
  modified_base (297)..(297): a, c, t, g, unknown or other
  misc_feature (297)..(297): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctcgtgggcgagacgggccaccatacaactgcaagtccagccagagttgttttatacagcctaccaaacaataacaactacttagcttggtaccagacaagaaaccaggacacgaccccctaaggtcctactatttacgngggactactaccgtacccggggtacggttcccgggggtaccctacggaacccggtattaccgaagggacggccgacgggtccggggttacggtagggaaccgtagtaacttttaccacttccgtaccaaccctaactacccaaccctaaacccgtgaccgacgggtctaggtaaacgtacgttacggttacggtacgttaaggtttttaacttacgttacggttaccaagtaaccgtaaacgttaaccgttaagttaccgttacccctttacccttaccgttaccgtacccgggtttaccgggaccggggtaaacggggtaacccggtaaggggtacggggtaaggtaaccgttaacccgtaaaaccggtaacgtttcgggtacgtaccgtaccggtacctaacccggtagtttacctttacggttcccgttaccttaccgtttaccccgttccccgtaacccgttacttaccggttaccgtaaccttaacccg

SEQ ID NO: 52652 - DNA, 639 bp, Homo sapiens
  misc_feature: GYAE6OF02I9OHE.18.11.A11.1.454.CMB.1.raw
  modified_base (220)..(220): a, c, t, g, unknown or other
  misc_feature (220)..(220): n is a, c, g, or t
  modified_base (632)..(639): a, c, t, g, unknown or other
  misc_feature (632)..(639): n is a, c, g, or t
tcagtacgagtatgcacgaccggtgctcgatttagctacgactgcaggggcagcaagatggtgttgcagacccaggtcttcatttctctgttgctctggatctctggtgccggacggggacatcgtgatgacccagtctccagactcccgtgttgtgtctctgggcgaggacggccaaccatctaaactgacaagtccagccaaggtacgttgttttaanacagcctaccaaacaaactaaacaacgttacttaagcttgtaccagcaagaaacagacacgaccccctaaggtcctacatttacgtggactagtaccgtacccggggacggtacccggggtcccaggtacccgagttacgaacggacggtacgacgggtaccgggtacggtacggggacagtaactttccgaacttctaccaacctactacgaaccaaccgtcgacgaccggtcgtaagaagtagtgtacggacgttagtttaacgttaacgttgtactagtacaaacgtactaacttaccgtacctcctctaccgtaccggtacggtacggaggaccgtaaggtcgaagtactaacgtaaacgtacggtagtagcgtacacaccgtagtacctacgttccgttaaccctannnnnnnn

SEQ ID NO: 52653 - DNA, 606 bp, Homo sapiens
  misc_feature: GYAE6OF02II2X5.18.11.A11.1.454.CMB.1.raw
  modified_base (402)..(402): a, c, t, g, unknown or other
  misc_feature (402)..(402): n is a, c, g, or t
  modified_base (428)..(428): a, c, t, g, unknown or other
  misc_feature (428)..(428): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgacaagtccagccagagttgtttatacagctaccaaacaataacaactacttagcttggaccagcagaaaccaggaccacgaccccctaaggtcctctatttacgtgggctatccgtacccggggaggtcccggggtcccctgaccgtattcgagaggcaggtcgggtctgggacagtattccactctcaccatcaacccacctgcaggctagaagtntgtggtactacgtttatactgtacanactaattatatacgttcctcccttctccgacggttcgggacggtacggaccgaggtacggagtactacgaaacgtacgtggtcgtacgtacgccgtaactcgttccggttacttacctttccgtacgtttcccccgttacccgtacccgttaactcccgttaccgtaaccgttaaccg

SEQ ID NO: 52654 - DNA, 627 bp, Homo sapiens
  misc_feature: GYAE6OF02HEG95.18.11.A11.1.454.CMB.1.raw
  modified_base (211)..(211): a, c, t, g, unknown or other
  misc_feature (211)..(211): n is a, c, g, or t
  modified_base (287)..(287): a, c, t, g, unknown or other
  misc_feature (287)..(287): n is a, c, g, or t
  modified_base (296)..(296): a, c, t, g, unknown or other
  misc_feature (296)..(296): n is a, c, g, or t
  modified_base (409)..(409): a, c, t, g, unknown or other
  misc_feature (409)..(409): n is a, c, g, or t
tcagtacgagtatgcacgaccggtgctcgatttagctacgactgcaggggcagcaagatggtgttgcagacccaggtcttcatttctctgttgctctggatctctggtgccgacgggacatcgtgatgacccagtctccagactccctggttgtgtctcgtgggcgaggacgggccaccatcaactgcaagtccagccagagttgttttanacagctaccaaacaataacaactacttagcttggaccagacaacgaaaccaggaccacgaccccctaaggtccctntatttacgngggcacgtccgtaccccgggacgttcccggggtccctcggaccgtagttcgacggaggcgacggcgggtctgggactagactttcactctcacctactcaccaactcgcacgntagagtagtgcggtactagttttactacgtagtacagactaactacgtacttcgtccctctctctacggtcgggacgtacgggacctagggtcgaacgacgtaacgaaaccgtagtcggtaggtacctacgacccgtaacgtacgtccgtttactacccgttactaaccgtttccccgttaccctaccgttaaccgttcgttactacccgttaaaccg

SEQ ID NO: 52655 - DNA, 673 bp, Homo sapiens
  misc_feature: GYAE6OF02JAWH3.18.11.A11.1.454.CMB.1.raw
  modified_base (211)..(211): a, c, t, g, unknown or other
  misc_feature (211)..(211): n is a, c, g, or t
  modified_base (422)..(422): a, c, t, g, unknown or other
  misc_feature (422)..(422): n is a, c, g, or t
tcagtacgagtatgcacgaccggtgctcgatttagctacgactgcaggggcagcaagatggtgttgcagacccaggtcttcatttctctgttgctctggatctctggtgccgacgggacatcgtgatgacccagtctccagtactccctggttgtgtctcgtgggcgaggacgggccaccatccaatgcaagtccagccagagttgtttanacagcctaccaaacaataacaactacttagcttggaccagcaagaaaccaggacacgtccccctaaggtcctactatttacgtgggctactccgtacccgggtcggtcccggggtccctggaaccgattcgacgaggcgtaggcgggtcgtgggacagtacgtttcaacgttctacgaccatccgaaccaacctgactaggctaggaagtntgtcgtacgttaagtttattacgtgttacgaatacgtaattacttaacgttacgtcccttaccgttaccttacgtaccgtttacgggacgggtaaggtaacccgtaagggttacggacgtaaacgtaaccgtaaaccgtacgttacggtacggtaccgtacgtacccgtaaccgttacgttaccgttcgttaaccttccgttaacctttccccgttacccgtaccttacgttccgtaccgtacgttaaccg

SEQ ID NO: 52656 - DNA, 676 bp, Homo sapiens
  misc_feature: GYAE6OF02I8O62.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagacctccctggttgtgtctcgtgggcgagagggccaccatcaactgcaagtccagccagagttgttttatacagctaccaacaataaccaacttacttagtacgttcggtaccagacaacgaaaccaggaccacgccccctaacggtcctactactttactgggcacgtccgtacccggggtacggtccccggggttcccgtacggaccgtacttacgagacggcgacggcgggtcgtgggacagtactttacactcctccaaccactacccaaccaccgtcgacgacggcgtagaacgtagttcggtacggtacgttaagttttacgtttacgtagtactaagtactaaacttactttacttaaccgttccccttaccttcctaccgttaccggtcgggaccgggacgggtaaccgtagggtacggaacgtacgtaacgaaacggtacggtacgtcggacgtccgaccgtacgtaccttcgttacttaccttcaccgtttccgtacccgtccttacctcctacgtaccttaccg

SEQ ID NO: 52657 - DNA, 583 bp, Homo sapiens
  misc_feature: GYAE6OF02GLQQF.18.11.A11.1.454.CMB.1.raw
  modified_base (208)..(208): a, c, t, g, unknown or other
  misc_feature (208)..(208): n is a, c, g, or t
  modified_base (384)..(384): a, c, t, g, unknown or other
  misc_feature (384)..(384): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttanacagcctaccaacaataacaactacttagcttggtaccagcagaaaccaggacacgccccctaaggtcctcatttactgggcatcgtacccgggagtccgggtcctgaccgtattcagaggcaggcgggtctgggacagtattcactctcacatcaccaactgcacggctagaagntgtggtctagtttatactgtacagacaatactattacgtccctctctcgacggttcggacggtacgggaacctaagggtggaagtacgtaccgtaaaacgacgttggtacgtacctgacccaacctaacgttccgttaggttccctttactacgttcccgttaccccggtacctaacctaccgttaccgaaccttaacg

SEQ ID NO: 52658 - DNA, 775 bp, Homo sapiens
  misc_feature: GYAE6OF02I0JG9.18.11.A11.1.454.CMB.1.raw
  modified_base (202)..(202): a, c, t, g, unknown or other
  misc_feature (202)..(202): n is a, c, g, or t
  modified_base (208)..(208): a, c, t, g, unknown or other
  misc_feature (208)..(208): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtnttttanacagctaccaacaaataacaactacttagcttggtaccagcagaaaccaggaccacgccccctaaggtcctactactttacgtgggactacgtccgtacccggggtacggttcccgggggttcccctacggacccgtactttccgaaggacggaccgagggtccgggtcgtacggggacaggtacttttcgaaccgttcctaccgaactacgtacctaacccaacccgttcgaccgagggtacctacggaaacgtagttacggtacgggtactttacggttttaacgtttacgtcggttacgtaacggtaacttaaattaaccttaagtttaaacccggtttccccttacccgtttccttaacccgggttacccgggtttacggggtacccggggtaacgggtaaacccggaagggttacgggaaagtaaccgtaaccgtaaaaccgtaaccggttcgtagggtacctcgtaccaaccgtcgttaccgttacggtttacttttacccgtttcccggttacccctacccgtacccgtttagtacccggttacgtacctttaaccccgg

SEQ ID NO: 52659 - DNA, 575 bp, Homo sapiens
  misc_feature: GYAE6OF02HWXR9.18.11.A11.1.454.CMB.1.raw
  modified_base (210)..(210): a, c, t, g, unknown or other
  misc_feature (210)..(210): n is a, c, g, or t
  modified_base (290)..(290): a, c, t, g, unknown or other
  misc_feature (290)..(290): n is a, c, g, or t
  modified_base (347)..(347): a, c, t, g, unknown or other
  misc_feature (347)..(347): n is a, c, g, or t
  modified_base (391)..(391): a, c, t, g, unknown or other
  misc_feature (391)..(391): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgaccccagtctccagactccctggttgtgtctctgggcgagaggccaccatcaactgcaagtccagccagagttgtttttanacagctaccaacaaataacaactacttagcttgtaccagcaagaaaccagacacgaccccctaaggtcctacatttacgngggcatccgtacccgggaggtcccggggtcctggaccattcagacgcgaggcggtcngggacagtattcactctcacatcaccactgcagctagaagatgngctagtttatactgcagctaagtactatacgtcctccttctcgtacggttcggacggtacgggaaccgtaagggtagagaactaaccgaaacgtacgtaggtacgactcgacctaccgtattccgttacgttacctttacgtaccgttcccttccccgaccgtacttccgtacgaccttaaccg

SEQ ID NO: 52660 - DNA, 638 bp, Homo sapiens
  misc_feature: GYAE6OF02HT5EH.18.11.A11.1.454.CMB.1.raw
  modified_base (216)..(216): a, c, t, g, unknown or other
  misc_feature (216)..(216): n is a, c, g, or t
  modified_base (308)..(308): a, c, t, g, unknown or other
  misc_feature (308)..(308): n is a, c, g, or t
  modified_base (408)..(408): a, c, t, g, unknown or other
  misc_feature (408)..(408): n is a, c, g, or t
  modified_base (424)..(424): a, c, t, g, unknown or other
  misc_feature (424)..(424): n is a, c, g, or t
tcagtacgagtatgcacgaccggtgctcgatttagctacgactgcaggggcagcaagatgggtgttgcagacccaggtcttcatttctctgttgctctggatctctggtgccggacggggacatcgtgatgacccagtcctccagacctccctggttgtgtctcgtgggcgagagggccaccatcaactgacaagtccagccagtagttgttttanacagcctaccaaacaaataaccaacttacttagcttacggtaccagcaacgaaaccaggaccaccgacccccgtaaggtcctctatttacgnggcacgtccgtacccggggcgttcccggggtcctcggaccgtatcgaggagcgaggcgggtcagggacagtattcactcaccaacataccgaacctacgngacgaggctagacgtntggtcggtactagtttatacgtagtcgacgtactaactactattacgttccctaccttcctacgtaccggtccgggacgggtacgggaaccgtaagggtacggtaacgtaacgtaaccgtaaacggtacgtacgtacggtaccgtagtacctaccgtcttcgttcgttccttactaccgttccctacccggtaccttacgtacctcgacttacg

SEQ ID NO: 52661 - DNA, 612 bp, Homo sapiens
  misc_feature: GYAE6OF02FK2P4.18.11.A11.1.454.CMB.1.raw
  modified_base (283)..(283): a, c, t, g, unknown or other
  misc_feature (283)..(283): n is a, c, g, or t
  modified_base (384)..(384): a, c, t, g, unknown or other
  misc_feature (384)..(384): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttacngggcatcgtacccgggagtcccgggtcctgaccgattcagaggcagcgggtctgggacagtatttcactctcaccatccaaccaacctgcaggctagaagntgtaggctagttttatacgtgtacagacctaaatactaagttacgtcccttcctctccgtacggttccggacgggtaacgggaaccgaagggtaggaacgtacgtaaccgaaaaccggtaacgttcggtacggtacctacggacctaacccgtagttccgttacgttacccgtttactaacgtttccccgttccccgacccttacttcccggtacgtaaccctaaccg

SEQ ID NO: 52662 - DNA, 625 bp, Homo sapiens
  misc_feature: GYAE6OF02G9CC7.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtgccgacgggacatcgtgatgacccagtctccagactccctggttgtgtctctgggcgagagggccaccatcaactgcaagtccagccagagttgttttatacagctaccaaacaataacaactacttagcttgtaccagcagaaaccagacacgcccctaaggtcctcattactgggcatcgtacccgggaggttcccgggtccctgaccgacttcgagacggcgacgtcgggtcgtgggacagtactttcgactctcaccactccaacctaacctgacaggctagaacgatcgtcggactagttttacttactgtctagactaagttactaacgttacgtacccttccgtaccttcgtaccggttccgggaccgggtaacggggtaaacccgtagggttacggacggtaacttaaccgaaaacgtacgtagggtacgacgtacgcctaaccgtattccgttcggttaccttactaccttcccgttacccgtccttacgtccgttacgacttaaccg

SEQ ID NO: 52663 - DNA, 715 bp, Homo sapiens
  misc_feature: GYAE6OF02GWHCK.18.11.A11.1.454.CMB.1.raw
  modified_base (700)..(700): a, c, t, g, unknown or other
  misc_feature (700)..(700): n is a, c, g, or t
tcagtacgagtatgcacgaccggtgctcgatttagctacgactgcagggggcagcaacgatggtgttgcagacccaggtcttcatttctcgtcgttgctctggactcgtctggtgccgacggggacatcgtgatgaccagtctcagactcctggtgtgtctcgtgggcgagacgggccaccatcaactgctaagtccgacgccaggagttgttttaactactactcctaccaacaaactaaaccaacttaacttaagtcttaggtaccagcaacgaaaccaggacaccgacccctaaggtacctcgtaactttacgtcgggtactactaccgtacccgggacggttcccggggtaccctacggtaccgtacgttcgaacggacggacgaggtccgggtacgtaggggacctaggtacgtttaccgaacctcgtaccgaacctactaccgtaaccaaccgtacgaccgtaacggtaccgtacggaacgtaacgttcggtacggtaacttaaggtttttaactacgtacgtgtaacggtacttaaaattaccctttaggttaaccctccgttaacccttcgtaaccgttacggtttccggacggtaacggacgtaaggggtcgaaacgtaactaccgaaaaggtacttaggtacgactcgacctaccgtaatcgtcttacgtctaccttacgtcccgtactntccggtacacttacg

SEQ ID NO: 52664 - DNA, 643 bp, Homo sapiens
  misc_feature: GYAE6OF02IWU39.18.11.A11.1.454.CMB.1.raw
  modified_base (290)..(290): a, c, t, g, unknown or other
  misc_feature (290)..(290): n is a, c, g, or t
  modified_base (420)..(420): a, c, t, g, unknown or other
  misc_feature (420)..(420): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagacctccctggttgtgtctcgtgggcgagaggccaccatcaactgccaagtccagccagagttgttttatacagctaccaacaataacaactacttagcttgaccagcaagaaaccagacacgacccccctaaggtcctctatttacgngggctacgtccgtacccgggacggtccggggtccctggaccgattcgagcggcgaggcgggtactgggacagtatttccacttctaccgaccacgtaccaaccaactcgacctaagggactacggaaagngtaggttcggtacctaagtttacttacgtgtacagaactaacttaactattacgttaccctcttacgtacctaccggttgggacggaacgggtaccggtagggttacggagtactaacgtaaacggtacgttagggacgacgtcgacccgtacgtaacgtttcctacgtttcctaccgtacctttcccgttacccgtacctacgtaccgttacgaccttaacg

SEQ ID NO: 52665 - DNA, 644 bp, Homo sapiens
  misc_feature: GYAE6OF02FG49O.18.11.A11.1.454.CMB.1.raw
tcagtacgagtatgcacgaccggtgctcgatttagctacgactgcagggggcagcaagatggtgttgcagacccaggtcttcatttctctgtttgctctggatctctggtgccgacggggacatcgtgatgacccagtctccagactccctggttgtgtcctctgggcgagagggccaccatcaactgcaagtccagccagagtgttttacacagctaccaacaataacaactacttagcttggtaccagcagaaaccaggacagccccctaaggtcctctattactgggcatcgtaccgggagtccggggtcctgaccgattcagagcagcggtctggacagctttcacgtctacaccacgtaccaccaacctgacacgggtctagaagactggtacggacttagttttaacttacgttcgttcaaggtaccaaagttactaacgttaacggtcccttaccttaccgttacctacggttcccgggtacgggaaccgggtaaacccgtaaggggtaccggaaacggtacgttaacccgaaaacgtaaccgttggtacggtaccgttagtaccgacgtaacgttcttacgttcgttacctactttcccgttaccccgtaccgtactaccgttacgtacttaaccg

SEQ ID NO: 52666 - DNA, 574 bp, Homo sapiens
  misc_feature: GYAE6OF02FZG88.18.11.A11.1.454.CMB.1.raw
  modified_base (288)..(288): a, c, t, g, unknown or other
  misc_feature (288)..(288): n is a, c, g, or t
  modified_base (344)..(344): a, c, t, g, unknown or other
  misc_feature (344)..(344): n is a, c, g, or t
  modified_base (394)..(394): a, c, t, g, unknown or other
  misc_feature (394)..(394): n is a, c, g, or t
tcagtacgagtatgcacgaccggtgctcgatttagctacgactgcaggggcagcaagatggtgttgcagacccaggtcttccatttactctgttgctctggatctctggtgccgacggggacatcgtgatgacccagtctccagactccctggttgtgtctctgggcgagagggccacatcaactgcaagtccagccagagtgttttataacagctaccaacaataacaactacttagcttgtaccagcagaaaccaggacacgaccccctaaggtcctctatttacngggcagtcctacccggggagtccggggtccctgaccgtattcgagacgcagcggtntggacagtactttcactctccacctatccaaccactgccaggctagaagntggtgactagtttactacttagccagcgtaattactatacgtcccttccgtctctaccggttcggacgggtacggaacctagggtcgaagactaccgtaaaaccgacgttgcggtctacggacctacccgtattcctcggttccttacacgttccttacccgctacgtctacgacttacg

SEQ ID NO: 52667 - DNA, 588 bp, Homo sapiens
  misc_feature: GYAE6OF02FHJRL.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaaacaataacaactacttagcttggtaccagcagaaaccaggacagccccctaaggtcctcatttactcgggcactctacccggggagtcccggggtccctgacccgattcgagaggcaggcgggtctgggacagactttcactctccaccataccaaccaacctgacgacggctagaagagtggtagactagtttacttaacgtgtacaagtctaaatacttaattacgtcccttcctcctcgtacggtttccgggacggtaacgggacccgtaagggtcgaagtactaacgaaactacgtggtcggtctagaccaccgtactcgtcgttcttactacttcccgttacccgcctatccgtagaccttaacg

SEQ ID NO: 52668 - DNA, 599 bp, Homo sapiens
  misc_feature: GYAE6OF02IQ874.18.11.A11.1.454.CMB.1.raw
  modified_base (212)..(212): a, c, t, g, unknown or other
  misc_feature (212)..(212): n is a, c, g, or t
  modified_base (226)..(226): a, c, t, g, unknown or other
  misc_feature (226)..(226): n is a, c, g, or t
  modified_base (449)..(449): a, c, t, g, unknown or other
  misc_feature (449)..(449): n is a, c, g, or t
  modified_base (563)..(563): a, c, t, g, unknown or other
  misc_feature (563)..(563): n is a, c, g, or t
  modified_base (590)..(590): a, c, t, g, unknown or other
  misc_feature (590)..(590): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctcgtgggcgaggacgggccaccatcaactgcaagtccagccagagttgttttanacagcctaccaaanaataacaactacttagcttaggtaccagcaacgaaaccaggaacaccgacccccgtaaggtcctactactttacgcgggctaacgtccgtaaccccggggacggttcccgggggtcccctacggtacccggtattaccgaggacggcgacggcgggtcgtacgggacagtactttccaactctaccacactaccaacctacctgacaggtctagaagtatggngtacttagtttactacgtgtacgactactaactactatacgtcctcctctacgtacgtcgggacgacggacgtaggtacgagtacaacgtaaacgtacgtgcgtctgactacgnttctctctactcttccttcccgctacncgtcactac

SEQ ID NO: 52669 - DNA, 606 bp, Homo sapiens
  misc_feature: GYAE6OF02F70T0.18.11.A11.1.454.CMB.1.raw
  modified_base (289)..(289): a, c, t, g, unknown or other
  misc_feature (289)..(289): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagacgggccaccatcaactgcaagtccagccagagttgttttatacagctaccaacaataacaactacttagcttaggtaccagacagaaaccaggacacgcccctaaggtcctctatttacnggcatcgtacccgggaggtccgggtcctacgaccgattcgagtggcaggcgggtcgtgggacagtactttcacgtctacaccagtccaaccacctcgcgacggtctaggaagtagtggtgcgttaagtttattacgtgtacgagtactaatacttaagttacgttcccttccttacctcgtacggttccgggacgggtaacgggacgaggtacggaagtactaacgaaacgtacgttggtacgtctacgaccgaccgacgttccgttcgtaccgttactacgttccgtcccgtacctacctttctacgtacctaacg

SEQ ID NO: 52670 - DNA, 596 bp, Homo sapiens
  misc_feature: GYAE6OF02IAYM5.18.11.A11.1.454.CMB.1.raw
  modified_base (284)..(284): a, c, t, g, unknown or other
  misc_feature (284)..(284): n is a, c, g, or t
  modified_base (570)..(570): a, c, t, g, unknown or other
  misc_feature (570)..(570): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagttgttttatacagctaccaacaaataacaacttacttagcttaggtaccagcaagaaaccaggacacgaccccctaaggtcctntactttacgtgggaccacgtccgtacccggggtacggttccccggggtaccctaggacccgtattcgaggacggcgacggtcggggtctggggactaggtaactttccaacgtcctccaacctatacccaaccctacctgacgacggtctaggaagtactggtcgacttagttttactactgacagactatactactacgtcctactcgtctacggtcggacgacggacaggtagagactacaagacgtgtagctcgacactcttacgtctccttacgaccttccncccgtactcgtactacgaccttaacg

SEQ ID NO: 52671 - DNA, 793 bp, Homo sapiens
  misc_feature: GYAE6OF02F6ONQ.18.11.A11.1.454.CMB.1.raw
tcagtacgagtatgcacgaccggtgctcgatttagctacgactgcaggggcgagcaagatggtgttgcagacccaggtcttcatttctctgttgctctggatctctggtgccgacggggacatcgtgatcgacccagtctccagacctccgtggttgtcgtctcgtgggcgaggacgggcccaccgataccaaactcgacaacgtcccagccagtagttgttttatacagcctaccaaacaactaacaacttacttagccttacggaccagacaacgaaaccagacaccgaccccgtaagtcctactacttacgcggacacgtaccggtacccggggtacggtccccgggtaccctacggaccgtacttacggacggacggcgacgggtccgggtcgtacgggactacgttacttccgaaccttcctaccaccgtactacccaacccgtaaccgtcggaccgacggtacgtaaggaacgttacggtacggttacggtacgtttaacgttttaacgttaccgttacgtacgtaacgttaacttaaacgttaactttaaccggttacctttcccttacccgttacgttacccggttacgggttaccggggaaccgggtaacgggtaaacccggttaaggggtaccgggtaaacgttaaccgtaaaccggtaaaccgttacgttcgggttaacgccgttacgaccctaaccgtaccggttccttacgtttacccgtacccgttacttccccggttacccgtaccttaccgttcccgtaaccggtaccttaacccgg

SEQ ID NO: 52672 - DNA, 512 bp, Homo sapiens
  misc_feature: GYAE6OF02FXRWC.18.11.A11.1.454.CMB.1.raw
  modified_base (384)..(384): a, c, t, g, unknown or other
  misc_feature (384)..(384): n is a, c, g, or t
  modified_base (472)..(472): a, c, t, g, unknown or other
  misc_feature (472)..(472): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctaccaacaataacaactacttagcttggaccagcagaaaccaggacagccccctaaggtcctcattactgggcatctacccgggagtccgggtccctgaccgattcagaggcaggcgggtctgggacagatttcactctcaccatcaccaaacctgcaggctgaacgatgnggactagttttaattacgtgtcagacaatactatagtcctctctctacgttcggcggagggaccaaggtgagtactacaaacgactgngctgcaccatctgtcttcatccttcccgctatctgactag

SEQ ID NO: 52673 - DNA, 525 bp, Homo sapiens
  misc_feature: GYAE6OF02H8Z9N.18.11.A11.1.454.CMB.1.raw
tcagtacgagtatgcacgaccggtgctcgatttagctacgactgcagggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacacgaccccctaaaggtcctctatttactgggctatccgtacccgggaggtccggggtccctggaccgattcagaggcagcgggtctgggacagattcactctacacatcaccaactgacacggctgaagatgtggactagtttatactgtacagactaatactatacgtcctctctctacgttcggcggaggacccaggtgagtacagaaacgatgtcgctgacacatcgtgtcttcacttccgttcccgctatctagacctacg

SEQ ID NO: 52674 - DNA, 728 bp, Homo sapiens
  misc_feature: GYAE6OF02GZWXM.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctcgtgggcgagagggccaccatcaactcgcaagtccagccagtagttgtttttaactacagtcctaccaaacaaactaaacaacttacttacgcttggtaaccagacaacgaaaccgaggaccaccgacccccgttaaggtcctactacgtttacgtcgggtacctacgtacccggtacccggggtacgggttccccggggttccccgtacgtaccggtacttaccgaaggacgggccgacgggtccgggtacgtacggggactaggtactttaccaccgtctaccaccctactaccctaaacccgtaccctcggaccgaacgggtacctaggtaaacgtagttggtacgggtactttaacggttttaacttaccgttgtacgtaacgtacgtaaactacgttaattacgttccccttaccgtaccttccgaccgggtttacgggaccggggtacggtaaaccggtagggtacgagtaacgttaaccgaaagtacgtgggtcgactacgacctacgtacgtcttacgtcctacgttcccgttcctaccgtctacttccgtatacctaacg

SEQ ID NO: 52675 - DNA, 894 bp, Homo sapiens
  misc_feature: GYAE6OF02JGYVS.18.11.A11.1.454.CMB.1.raw
  modified_base (216)..(216): a, c, t, g, unknown or other
  misc_feature (216)..(216): n is a, c, g, or t
  modified_base (219)..(219): a, c, t, g, unknown or other
  misc_feature (219)..(219): n is a, c, g, or t
tcagtacgagtatgcacgaccggtgctcgatttagctacgactgcaggggcagcgaagatggtgttgcagacccaggtcttcatttctactcgttgctctggatctctggtgccgacgggacatcgtgatgacccagtctccagactccctggttgtgtctctgggcagacgggccacctattcaactgacgaacgtccagccagacgttgtttanacngctaccaacaataacaactacttagcgttaggtaccagtccaagtaaaaccaggaccacgtaccccccgtaaggttcccctctaacttttaacctcgggcctacgttcccggtaaccccggggtacggttccccggggttacccctacgggtaacccgtaacgtttccgaacggtaacgggaccgtaacgggtccgggggttacgttacgggggaacctaacggttaacgtttttccggaacccgtttaccggtacccgtaaaccctaacgttacccctaaaccccgttaaaaccccttcggaacccgtaacgggacccttaacggggtaaaacggtacgtttacgggtttacgggaaccgttttaaacgggttttttaaaccgttaaccgtttccgggttaaccgtaaacggttaaccgttaaaaccttttaaccgttaaaccgtttaaccggttccccttttaccccgttaccggttacccgttaccggttttaccggggacccggggtaacgggttaaaccgtaacgggggttacgtaacggtaaccgttaaacccgggaaaacggttaaccgttagggtacggtaccctacgaacccgtacgttaacgttacgttcggttaccttacgtaaccttcccgtccgtacctacgttctaccggtaccttaaccg

SEQ ID NO: 52676 - DNA, 868 bp, Homo sapiens
  misc_feature: GYAE6OF02IM8V4.18.11.A11.1.454.CMB.1.raw
  modified_base (218)..(218): a, c, t, g, unknown or other
  misc_feature (218)..(218): n is a, c, g, or t
tcagtacgagtatgcacgaccggtgctcgatttagctacgactgcaggggcagcaagatggtgttgcagacccaggtcttcatttctctgttgctctggatctctggtgccggacggggacatcgtgatgacccagtctccagacctccctggttgtgtctcgtgggcgaggacgggcccaccatcaactgctaacgtccagccagagtttgttttanacagctaccaactaaataaccaacttactagtcttcggtaccaggaccaacgaaaccacggaacaccgacccccgtaacggtaccctactattttaaccgcgggtcctaacgtcccgttaaccccgggggtacggttccccggggtcccctaacggtacccgtacgttacgacgggacggaccgtacgggtccggggttcgtacgggactaacggtacttttccgaacctttccgtactaaccctacgttacccgaaccctaaccgttcggacccggtaaggtacccgtaaggtaaaccggttgttacgggtaccggttaacgtttaaggttttttaaacctttacggtacgggttaccaacggttacctaaatttaaccttacggttaaccgttttcccctaccgttacccttacggttacccggggtaccgggtaccggggtaaacggggtaacccgtttaacggggtacggtaaacgtaccggttaaaacccgaaacgggtttaaccgttcggggtacgggtaccccttaggtaacccggtacccctaacggggttttacccgtcggtttttaccccgttaacgtcccgtttaccccggtttaccccgccttaacccgggttctaaccgggtaacccctttaaccgg

SEQ ID NO: 52677 - DNA, 658 bp, Homo sapiens
  misc_feature: GYAE6OF02HCJRY.18.11.A11.1.454.CMB.1.raw
  modified_base (637)..(637): a, c, t, g, unknown or other
  misc_feature (637)..(637): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgaggagggccaccatcaactgcaagtccagccagtagttgttttatacagctaccaaacaaataacaacttacttagcttaggtaccagcaacgaaaccaggaaccacgccccctaaggtcctactatttacgtgggcactccggtaccccgggaggtcccggggtccctcggaccgattccgaggtacggcagggccgggtcgtgggacagtactttccactcaccaccactccaacccaacctgccgacggccgtagaacgtatacgggtcgtacttagttttactacgtcgtacaacgactaattacgttatacgttccctccttctcgtaccggttcgggaccgggtacgggtaaccgtagggtacggaacgtaacgtaaccgaaaacggtacgttcgggtacggtctacgaccaccgtagttcccgttacgttccgttaccttccgttaccccgttcccgtaccttntacccgtacgtaaccttaccg

SEQ ID NO: 52678 - DNA, 728 bp, Homo sapiens
  misc_feature: GYAE6OF02GZZIR.18.11.A11.1.454.CMB.1.raw
  modified_base (212)..(212): a, c, t, g, unknown or other
  misc_feature (212)..(212): n is a, c, g, or t
  modified_base (306)..(306): a, c, t, g, unknown or other
  misc_feature (306)..(306): n is a, c, g, or t
  modified_base (462)..(462): a, c, t, g, unknown or other
  misc_feature (462)..(462): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctcgtgggcgagagggccaccatcaactgacaagtccaggccagagttgttttanacgagcctacaaacaataacaacgtacttacgcttacggtaccagaccaagaaaaccgaggacaacgaccccctaaggtccctactatttacgnggctacgtccgtacccggggagtaccccgggtccctggacccgtattccgaggtacggcgtacggcggggtcgtaggggacgtagtactttaccgacttcctacgaaccctatccgaacctaaccgtgactacggcgtagaacgtagttgtacggngttaacgtttacgtaacgttcggtacaacgggtactaaacttacgttaacttaacccggttccttacccttaccgtaccgttacgggtaccggggtaacggggacgggtaaacccgtaaggggtacgtaacgtaacgtaacccgtaaaacggtaaacgttgggtacgtaccggtacgtacctacccgtaacggttccttaaccggtttccgtacctacccgttcccggttaccccacgtaccctttagtaccggtaccttaaccgg

SEQ ID NO: 52679 - DNA, 552 bp, Homo sapiens
  misc_feature: GYAE6OF02JC67J.18.11.A11.1.454.CMB.1.raw
  modified_base (287)..(287): a, c, t, g, unknown or other
  misc_feature (287)..(287): n is a, c, g, or t
  modified_base (350)..(350): a, c, t, g, unknown or other
  misc_feature (350)..(350): n is a, c, g, or t
  modified_base (384)..(384): a, c, t, g, unknown or other
  misc_feature (384)..(384): n is a, c, g, or t
  modified_base (387)..(387): a, c, t, g, unknown or other
  misc_feature (387)..(387): n is a, c, g, or t
  modified_base (493)..(493): a, c, t, g, unknown or other
  misc_feature (493)..(493): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagtagtgttttatacagcctaccaacaataacaactacttagcttggtaccagcagaaaccaggaccagccccctaaggtcctcatttacngggcatctacccgggagtccggggtccctgaccgattcaggacggcagcgggtctgggacagntttcactctcaccatcaccaactgcagctgaagntgnggctagtttacttactgtcagctaatactatacgtcctcctctctacgttccgggcggacggaccaagggtgaacgagtacaaacgacttgcgtctcggcaccgtnttcgtgttccttcctaacgttccctttaccccggacctcgtaccgtaccgtactaaccg

SEQ ID NO: 52680 - DNA, 901 bp, Homo sapiens
  misc_feature: GYAE6OF02I60SJ.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtgccgacgggacatcgtgatgacccagtctccagacctccctggttgtgtctcgtgggcgagagggccaccatcaactgcaagtccagccagtagttgttttatacagctaccaaacaataacaactacttagcttaggtaccagcaagaaaccaggacacgaccccctaaggtcctactactttacgtgggactactaccggtaccccggggtacggttcccggggtccctcggacccgtagttaccgaggtacggcgacgggtccgggttcgtagggacgacgtacttttaccgacttcctaccaacctacgtaccaacccctaaaccgttcgacccgtaacgggtccttaacgggtaaacggtacgttacgggttaccgggtaacccgttttaaagggttttttaaactttacccgttagggtttaacccgtaaaacggtaaccgttaaaacgttttaaccgtttaaacggtttaacccggtttacccccctttacccgtttaaccccgttaccccgggtttaaaccccgggggtttaccccggggtaacccggggggtaaaaccgggggtaaaaccccgggttaacgggggtttaaacggggaaacggttaaaaccggttaaaccccgaaaaaccggggttaacggtttaaccgggggtaccgggtaacctttacccgggaaccctaaccgttaaaccggtttcgttaccggtttaccctttaacccgtacccgtttaccccgttacccccgacgttacccttacggtacccgttaacccgtttaaaccg

SEQ ID NO: 52681 - DNA, 709 bp, Homo sapiens
  misc_feature: GYAE6OF02G7MS7.18.11.A11.1.454.CMB.1.raw
  modified_base (293)..(293): a, c, t, g, unknown or other
  misc_feature (293)..(293): n is a, c, g, or t
tcagtacgagtatgcacgaccggtgctcgatttagctacgactgcaggggcagcaagatggtgttgcagacccaggtcttcatttctctgttgctctggatctctggtgccgacgggacatcgtgatgacccagtctccagactccctggttgtgtctcgtgggcgagagggccaccatccaactgcaagtccagccagagttgttttatacacgctaccaaacaaataaccaacttacttagcttaggaccagacacgaaaccagacacgacccctaaggtcctcatttacncgggcactcgtacccgggagtccgggtccctgaccgtactcgagtaggccaggccgggtcgtcgggacaggtactttacacgtctcaaccgtactccaaccctaactcgactacgggacctaggaaacggtagttaccggtcggtaacgttaacggtttttaactttaccgtacggttacgacggtactaaaccgtttaacgttaaccttaacggtttccccttaccccgttcgtaaccgttaccgggttccggtaccggggtaaccgggtaacccgtaagggttacggaacggttaagtaacccgaaacgttacgtaggtacggtaccgtgacccgtacgtcgttaccgtcgtttaccgtaccttacgttcccgtttacccccggccttaaactttcccgtacgtacgttaaccg

SEQ ID NO: 52682 - DNA, 640 bp, Homo sapiens
  misc_feature: GYAE6OF02H0DB0.18.11.A11.1.454.CMB.1.raw
  modified_base (211)..(211): a, c, t, g, unknown or other
  misc_feature (211)..(211): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagacctccctggttgtgtctctgggcgagagggccaccatcaactgcaagtccagccagagttgtttttanacagcctaccaacaaataaacaactacttagcttaggtaccagacaagaaccgaaggaccacgaccccctaaggtcctctattttacgtgggacacgtccgtaaccccgggacggttcccgggggtccctcggaccgtacttcgaggaggacgtaggcgggtcgtagggactagtactttcactcctacaccataccaaccaccgtgacgacggtcgtagaagtagtaggtggtacttaagttttacttactgtacagtactaatactagttacctccttccttcgttactacggtcgggacgggacgggtaaccgtagggtagtacgtaactaacgtaaacgacgtggtacgtactgacctaccgtacttccgttcgttaccttctaccgttcccttacccgtacctacgttccgtacgacttaaccg

SEQ ID NO: 52683 - DNA, 778 bp, Homo sapiens
  misc_feature: GYAE6OF02GMHUG.18.11.A11.1.454.CMB.1.raw
  modified_base (223)..(223): a, c, t, g, unknown or other
  misc_feature (223)..(223): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagtagttgttttatacagctaccaaanaataacaactactagcttggtaccagcaagaaaccaggacaacgccccctaaggtcctctatttacgtggactactaccgtaccccggggagttcccggggtccctcggaccgtattaccgagaggaccgaggcggggttctagggacaaggttaactttccgaacttacgtacctaacccgtaacttaccgaacccaacccgttgaccggtaacgggtaccgtaacgggaaacgtacgtttacgggtacgggtacgtttaacggtttttaaatttaccgtacgttaccgaacggtaacctaaagttaaccgttaagttaaccggttaccccctttaccgttccgttaccgtacccggggttttaccggggacccggggtaaacggggaaccgtaaacggggtacgggaaacggttaacgtaaaccgtaaaaccggtaacgttacgggtacggtcgttaccgaccgtaaccgtcgttacgtttaccgttaccctttaccgtaccgtttaccccgttaccccgtacccgtaacttccgttacgtaacccttacccg

SEQ ID NO: 52684 - DNA, 665 bp, Homo sapiens
  misc_feature: GYAE6OF02FIMAN.18.11.A11.1.454.CMB.1.raw
  modified_base (283)..(283): a, c, t, g, unknown or other
  misc_feature (283)..(283): n is a, c, g, or t
  modified_base (290)..(290): a, c, t, g, unknown or other
  misc_feature (290)..(290): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagacctccctggttgtgtctctgggcgagagggccaccatcaactgcaagtccagccagtagtgttttatacagctaccaaacaataacaactacttagcttaggtaccagcaagaaaccaggaccagccccctaaggtcctnatttacngggcactcgtacccgggagtccgggtccctgaccgattcagaggcaggcgggtcgtgggactagtactttcactctcaccatcaaccaactcgacaggcctagaacgtgtcggtaggcgttagtttaacttacgtagtaccaagtacctaaactaacttagttaacgtcccgttaccttaccgttacgtacccgggtttacgggtaccgggaacgggtaaacccgtaaggggtacggtaagtaacggtaacccgaaaacgtacggttggttacgggccgttacgaccgtaacccgtaagttcccttacggttcctttacaaccggtttcccctttaacccccggtcctaactttacccgtagtaccttaacccgg

SEQ ID NO: 52685 - DNA, 524 bp, Homo sapiens
  misc_feature: GYAE6OF02H4IXV.18.11.A11.1.454.CMB.1.raw
  modified_base (327)..(327): a, c, t, g, unknown or other
  misc_feature (327)..(327): n is a, c, g, or t
  modified_base (372)..(372): a, c, t, g, unknown or other
  misc_feature (372)..(372): n is a, c, g, or t
  modified_base (484)..(484): a, c, t, g, unknown or other
  misc_feature (484)..(484): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgcgatgacccagtctccagactccctggttgtgtctctgggcgagagggccaccatcaactgcaagtccagccagagttgttttatacagctccaacaataacaactacttagcttggtaccagcaagaaaccaggacacgccccctaaggtcctcatttactgggcatcgtaccgggagtccggggtccctgaccgattcagngcagcgggtctgggacagtattcactctcaccatcaccactgacnggctgaagatgtaggctagtttatactgtcagctaatactatacgtcctctctcgtacgttcggcggaggtaccaggtcgaagtacacgaaacgactgtcgactgcctaccnttctgtccttctattccttacccgcctatctacgaactac

SEQ ID NO: 52686 - DNA, 693 bp, Homo sapiens
  misc_feature: GYAE6OF02JDRF9.18.11.A11.1.454.CMB.1.raw
  modified_base (212)..(212): a, c, t, g, unknown or other
  misc_feature (212)..(212): n is a, c, g, or t
  modified_base (298)..(298): a, c, t, g, unknown or other
  misc_feature (298)..(298): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctcgtgggcgaggagggccaccatcaactgcaagtccagccagtagttgttttanacagctaccaaactaactaaccaacttacttagcttggtaccagacaacgaaaccaggacacgcccctaaggtcctacactttacngggactataccgtacccgggtacgtcccggggtccctacggacccgtattccgagacggctaggcgggtcgtgggactagtatttccacttcgaccaccatccaccaaccgtgacctaaggccttaggaagtaacgtttcggacgtacgttaacggtttttaacttactacgttacgaacgtacgttaaataaccctttagttaaccgtttcccttaccccttacgttaccgtaaccgggtttcgggaccgggtacgggtaaccgtaacggggttgggaaactacgtaaccttaaaacggacgttaaggtcgtaccgtacgtaccgaccctaagttaccttcggttaccttaccgtacgttcccgttaccctcggacttacgttacgacttaccg

SEQ ID NO: 52687 - DNA, 704 bp, Homo sapiens
  misc_feature: GYAE6OF02JLDM7.18.11.A11.1.454.CMB.1.raw
  modified_base (200)..(200): a, c, t, g, unknown or other
  misc_feature (200)..(200): n is a, c, g, or t
  modified_base (214)..(214): a, c, t, g, unknown or other
  misc_feature (214)..(214): n is a, c, g, or t
  modified_base (256)..(256): a, c, t, g, unknown or other
  misc_feature (256)..(256): n is a, c, g, or t
tcagtacgagtatgcacgaccggtgctcgatttagctacgactgcaggggcgagcaagatggtgttgcagacccaggtcttcatttctctgttgctctggatctctggtgccggacggggacatcgtgatgacccagtctccagactcccgtggttcgtgtctcgtggggcgaggacgggccaccatcaactgcaagtcngccagagtgtttancagctacaaacaataacactacttgcttcgacagcagaaccnggacacgtcccctaaggtcctcatttacgcggcagtacccgtcccgggaacggttcccgggtccctacgtccgggaacttcgacggaagcgacggtcgggtacgtggccaacgtattccgtaactccgtacaccctaactccgaacctaaccgtgtccgaggtacccgtagtaacgggtatacggtaccgggtacgttaacgttttaacttacgtacgtaccgtaacgtacttaaacgtccgttaacgtaccgtttaccctaccccgttaacttccgtacgggtttaccgggaaccgggtaacgggtaaacccgtaaggggttaccgtaacggaacgttaaaccgtaaaggttaaaccgtcgggttacgtccgtactaccgtaaccgtcttcccggtagttacccttacgtaccgttcccgtcccgacttacgtactcgactaaccgg

SEQ ID NO: 52688 - DNA, 880 bp, Homo sapiens
  misc_feature: GYAE6OF02IEESH.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtgccgacgggacatcgtgatgacccagtctccagacctccctggttgtgtctcgtgggcgagacgggccaccatcaactgcaagtccagccagagttgttttatacagcctacaaactaaataacctaacttacttagacttacggtaaccaacggctaaacggaaaacccgagggtaaccaccggtacccccccttaaaagggtccccttacgtaacttttaccgtcggggacctagtacccgttaaccccgggggtaacggttccccgggggttcccctacggaacccgtacgtttccggaagggacgggacgacggtaccggggttctacgggggtaacaggttaaccttttaccggacttccgtacctaaccctaacgttacccaaacccgtaaccgttacgacccgtacgggtacgtaacgggtaacggtacgtaggtttacgggaccgtttaaggtttttaccttaaacgttcggtttaccgaacggacccttaaaagtttaacccgttaagtttaacccgtttccccgttaccccgtttaaccgtttacccgggtaacgggttttccccggggaacgggggtaaacccggggtaaaccggttaaccggggtaaggaacggtaaaccgtacccgtaaaaacggtaccggttacggttacgggccttaccgggtaccctaccggtaccgtttcgtaacggttccccttaaccggtacttaccccgttaccccggtacctaccggttacgtacccgtacgttaacccgg

SEQ ID NO: 52689 - DNA, 816 bp, Homo sapiens
  misc_feature: GYAE6OF02JL3BR.18.11.A11.1.454.CMB.1.raw
  modified_base (218)..(218): a, c, t, g, unknown or other
  misc_feature (218)..(218): n is a, c, g, or t
  modified_base (307)..(307): a, c, t, g, unknown or other
  misc_feature (307)..(307): n is a, c, g, or t
tcagtacgagtatgcacgaccggtgctcgatttagctacgactgcaggggcagcaagatggtgttgcagacccaggtcgtcatttctctgttgctctggatctctggtgccggacggggacatcggtgatcgacccagtcctccagactccctggttgtcgtctcgtgggcgaggacggcccacatcaactgcaagtccagccagtagttgttttaanacagtcctaccaaactaataacaacttacgttagccgtttaggaccagcaagaaaccaggacacgcccctaaggtcctactatttacgngggtactacgtaccgtacccggggacgttcccggggtaccctggaacccgtattacgacggacggactacgggtccgggtacgtaggggaactaggtacttttccgaaccgttcctaccaacccgtactacccgaaccctaaaccgtgacccgaaagggtccttaagggaacgtacgttacggtacgggtacttaacgtttttaacgttacgttacgttaccgagtaaccgtaaacgttaaccgttaacgtttaccggttaccctttaccgttcccgttaacgttaccgggtttaccggggaaccgggtaaccggggtaaacccgttaaggggtacggggtaaacgtaaacccgttaaaccgtaaaacgggtaacgtttaccggttagggtacccttacggtacccgtaaaccgttacggtttaccgttacgtttacccgttacgttacccgtttccccgtttaaccccggtacccttaacgtaccgttaaccgttaccttaaacccgg

SEQ ID NO: 52690 - DNA, 716 bp, Homo sapiens
  misc_feature: GYAE6OF02FPRQ6.18.11.A11.1.454.CMB.1.raw
  modified_base (209)..(209): a, c, t, g, unknown or other
  misc_feature (209)..(209): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagttgttttanacagctaccaaacaataaaccaacttacttagcttacggtaccagcagaaaccaggaccacgaccccctaaggtcctctatttactgggacatccgtacccggggtacggtcccggggtcctgaccgtattacagaggcaggcgggtcgtgggacagtatttcactctaccacctactaccaacctaaccgtgaccgagggccgttaggaaagtagttggtacgggtactttaacggtttttaattacgttacgtaccgaacggttacctaaataaccgtttaagttaccgttcccctttacccttaccgttacccgttaccgggtttccggggacggggttaaaccgggtaaccgttaacggggtacggagtaaccgtaaacgaaaaccggtacgttcggttacgcgttacgaaccgtaaccgttacttaccgtttacggtttcctttaccgtaccgtttccccgtttccccgtacccgttaacgttccgtaccgtaccttaaccg

SEQ ID NO: 52691 - DNA, 765 bp, Homo sapiens
  misc_feature: GYAE6OF02JCGII.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagttgttttatacagtctaccaacaataaacaacttacttagcttaggtaccagacaagaaaccacggacgacgaccccctaaggtcctactactttacgtcgggactacgtccgtacccggggaggtccccggggtccctcgaccgattccgaggacggtcgacggcgggtacgtgggaccaggtactttcacctcctccgaacctactaccaacctacctacgacgacggaccgtaggaagtacgtggtacgtacgtatttagttactgtacacgtactaaacttacgttacttaaccttcccgttaccttaccggttacccgttacccggtaccgggggtaaccggggtaaccggggtacccgggttaagggtaaccgggtaacgttaaaccgttaaacccgtaaaaccggttaaaccggttcgggtaaccgggttaccgtaccgacccggtaacccgttacggtacccgtttacggtttacccgttaacccgttaaccgttttcccccggttacccgtaccctttaacccggtttaccgttaacccggaagtttaacccccgg

SEQ ID NO: 52692 - DNA, 700 bp, Homo sapiens
  misc_feature: GYAE6OF02I6LV6.18.11.A11.1.454.CMB.1.raw
  modified_base (310)..(310): a, c, t, g, unknown or other
  misc_feature (310)..(310): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatcgacccagtctccagacctccctggttgtgtctcgtgggcgaggacgggccaaccatcaactgacaacgtccacgccagtagttgttttaataaccagcctaccaacaactaacaacctacttagcttaggtaccagacaagaaaccaggaccacgaccccctaaggtcctactatttacgnggctacgtaccgtacccggggtacggtcccgggtccctacggacctacgttacgaggacgcgagggtccgggtcgtacgggacagttactttaccgacttcctacctaacctactacctaacccaaccgttacgaccgtaacggaccgttaggaaacggtacgttaggtacgggtactttaagtttttaacttcctagttaccaacggtaactaaacttacttacgttaaccgttcccttacccttcttacccggtaccgggttaccgggacggggtaacgggaaccgaggggttacgaagaacgtaccgaaagtaccgttggacgtctacgcctacgattccgtagttcttactacgttccctccggtacctcgttacacgtactaccg

SEQ ID NO: 52693 - DNA, 602 bp, Homo sapiens
  misc_feature: GYAE6OF02HTVQ3.18.11.A11.1.454.CMB.1.raw
  modified_base (208)..(208): a, c, t, g, unknown or other
  misc_feature (208)..(208): n is a, c, g, or t
  modified_base (348)..(348): a, c, t, g, unknown or other
  misc_feature (348)..(348): n is a, c, g, or t
  modified_base (391)..(391): a, c, t, g, unknown or other
  misc_feature (391)..(391): n is a, c, g, or t
tcagtacgagtatgcacgaccggtgctcgatttagctacgactgcaggggcagcaagatggtgttgcagacccaggtcttcatttctctgttgctctggatctctggtgccgacgggacatcgtgatgacccagtctccagactccctggttgtgtctctgggcgagagggccaccatcaactgcaagtccagccagagttgttttanacagctccaaacaataaccaactacttagcttggtaccagcagaaaccaggacagccccctaaggtcctacatttactggcatcctacccgggaggtcccggggtccctgaccgattcgagaggcaggcggtctgggacngtattcactctccactatcaaccacgtgcaggctagaagtacngtggtactagttttaatacgtgtcgagtacaattactaattacgtcccttccttccgtccgtacgttcggggaccggtagggaccgtaagggtggaacgacttacgaaaacgtacgtaggtcggactagccgtaacctcgttacgttcgttaccttccgtaaccgttccctttacccccgggaccttaccttaccgttacacctttaaccg

SEQ ID NO: 52694 - DNA, 572 bp, Homo sapiens
  misc_feature: GYAE6OF02JKXIX.18.11.A11.1.454.CMB.1.raw
  modified_base (213)..(213): a, c, t, g, unknown or other
  misc_feature (213)..(213): n is a, c, g, or t
  modified_base (290)..(290): a, c, t, g, unknown or other
  misc_feature (290)..(290): n is a, c, g, or t
  modified_base (347)..(347): a, c, t, g, unknown or other
  misc_feature (347)..(347): n is a, c, g, or t
  modified_base (352)..(352): a, c, t, g, unknown or other
  misc_feature (352)..(352): n is a, c, g, or t
  modified_base (361)..(361): a, c, t, g, unknown or other
  misc_feature (361)..(361): n is a, c, g, or t
  modified_base (372)..(372): a, c, t, g, unknown or other
  misc_feature (372)..(372): n is a, c, g, or t
  modified_base (382)..(382): a, c, t, g, unknown or other
  misc_feature (382)..(382): n is a, c, g, or t
  modified_base (386)..(386): a, c, t, g, unknown or other
  misc_feature (386)..(386): n is a, c, g, or t
tcagtacgagtatgcacgaccggtgctcgatttagctacgactgcaggggcgagcaagatggtgttgcagacccaggtcttcatttctctgttgctctggatctctggtgccgacggggacatcgtgatgacccagtctccagacctccctggttgtgtctctgggcgaggagggccaccatcaattgcaagtccagccagagttgtttttanacagctaccaacaataacaactacttgcttgaccagcagaaaccaggacacgaccccctaaggtcctctatttacgnggcactccgtaccgggacgtcccggggtacctgaccgtatcgagacgcgagcggtcnggacngattcactncacatcacacngcagctgaangtgnggtactattttactctgcagacaatcttatcgtcccttactcgtctacggttacgggccggtaagggaacctagggcgtaagacttaacccgaaagtactgggcctacgtacgacaccgttaacgtcttggttaccctacgttaccctcccggtttacccgaccttataccgttacgaacttaccg

SEQ ID NO: 52695 - DNA, 933 bp, Homo sapiens
  misc_feature: GYAE6OF02HAZ78.18.11.A11.1.454.CMB.1.raw
tcagtacgagtatgcacgaccggtgctcgatttagctacgactgcaggggacgagcaagatgtgttgccagacccgacggtcttcgaatttccctcgtgttgctccttggacttccttcctggtcgtccgacgggcatccgtgatacgaccccgagtacttcgagtacctccctggttgtcgtcctcgtcggaccgtaggtacggtcccacctacgtacgaaacgtcgacctaaccgtccaacgccgaaggtacggttacgtttttaacgaccgtaaggtacccttaacctaaaaccgtaaacgtaaacccttaaaccgttaaccgttacgtaccgtttacggtaaccgaacgaacgtaaaccggtaaacccgacggaaccgtacccggtacccccccgttaagggtaccccttacccgtaacttttaccggtcgggtaccgtacgttaccccggtaacccccggggtacggttacccccgggggttacccctacggtaccggtacgtttaccgaaccgggacggaccgtaccgggtccgggttacggtccggggaacgtacggttacgtttccgaacgttccgtaccgtaaccttacgtaacccgaccctaacccggtgaccgtacggtaaccgtacggtaacgtacggttacggtacggtacccgtttaaggttttaaacgttacgtttaccgtaacgtaacggttaaccttaacgttaccttaaggttacccgttacccgttaaccctaccgttaccgtaccgggtttacccgggacggttaacccgggtaaccggtagggttaccgggaaacgttaccgaaaccggaaaccggtacgtaacggtacgaccgtacggtactaaccgttagtccgttaccgtactaccgtcccttaccgtccgtaccgttactacgttcgaccttaacccg

SEQ ID NO: 52696 - DNA, 655 bp, Homo sapiens
  misc_feature: GYAE6OF02HNION.18.11.A11.1.454.CMB.1.raw
  modified_base (211)..(211): a, c, t, g, unknown or other
  misc_feature (211)..(211): n is a, c, g, or t
  modified_base (284)..(284): a, c, t, g, unknown or other
  misc_feature (284)..(284): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctcgtgggcgagagggccaccatcaactgacaagtccagccagagttgttttanacagctaccaaacaataaccaactacttagcttaggaccagcaacgaaacaggacacgacccctaaggtcctnatttacgtgggctactccgtacccggtggtacccgggtcccggtccacgtacgtcgtagacggacgaggtacgggtcgtacgggacgacgtagtttacctacgtctaccaacgtacctaccgtaacccacccgtaacgcacggacgtagtacgagtagtcggtacgtacgtttattacgttacgtacgtaacacgtactaacgttaattaccgttaccttaccgtccttactacggtccggacgggtacggaaccggtaagtacgggtagaacgtacgtaaaccgtacgtacgtcggtatcgaactaccgtaactaccttacgttcgtccttaacgtcccttacccgtacccgtctacgtaccagttaacc

SEQ ID NO: 52697 - DNA, 740 bp, Homo sapiens
  misc_feature: GYAE6OF02I5TJJ.18.11.A11.1.454.CMB.1.raw
  modified_base (224)..(224): a, c, t, g, unknown or other
  misc_feature (224)..(224): n is a, c, g, or t
tcagtacgagtatgcacgaccggtgctcgatttagctacgactgcaggggtcgaggcaagatggtgttgcagacccaggtcttcatttcctctgttgctctggatctctggtgccgacgggacatcgtgatcgacccagtctccagactccctggttgtgtctctgggccgagacgggcctacccgattccaactgcaacgtccagccagtacgttgtttttanaccagtcctaccaactaaataacaacttacttagacgttacggtaccaagcaagaaacctacggacaccgaccccctaaggtaccctactacttacctgggacctacttaccgtacccgggtacggtcccgggcccctacggaccgcttccgagagcgtaggtcggtgtcgggactgtactttccacttacctccgaacctacgtacccaacccgtaaacccttgacccgtaacggtaccgtacgtaaacgtacgtacggttcgggtacctaaggttttaacttacgttacgttacgacgtaacctaaacgttaaccttacgttaacgttccccttaccttaccttcccgttaccggttaccgggcgggtaaaccgggtaccgtaacggggtagtaaacggtacttaacgtaaaccggtaacggtcggtaccgtacgtcgtaccaaccgtcgttacttcggttaccttaccgtacgtttccgtaccccgtaccttagtaccgtaccgtacttaccg

SEQ ID NO: 52698 - DNA, 735 bp, Homo sapiens
  misc_feature: GYAE6OF02IAR77.18.11.A11.1.454.CMB.1.raw
  modified_base (207)..(207): a, c, t, g, unknown or other
  misc_feature (207)..(207): n is a, c, g, or t
  modified_base (285)..(285): a, c, t, g, unknown or other
  misc_feature (285)..(285): n is a, c, g, or t
tcagtacgagtatgcacgaccggtgctcgatttagctacgactgcaggggcagcaagatggtgttgcagacccaggtcttcatttctctgttgctctggatctctggtgccggacggggacatcgtgatgacccagtctccagactccctggttgtgtctctgggcgagagggccacatcaactgcaagtccagccagagtgtttanacagctccaaacaataacaactattagcttcggtaccagtcaagaaaccaggacagcccctaaggtcctcatttacgnggacagtccaccgggtagtcccgggtcctgaccgtatcagacggcacggacggtctagggacagtacgtttcactctacaaccatccgaacctaccgtcgtacgtacggacctaggaacgtactaggtacggacttaacgttttacgtttaacgtcgttaacctaaggtacctaaacgttaacttaacgttacccggtttaacccttccgttaccgttcgtaaccgggtttccgggaccgggaaacggggttaaccccgtaaagggtttaacggggacttaaaccggttaaccgtaaaacgggtaaaccgttcggggttacggaccgttacgggaaccctaccggtaacctttaccgggtttcccgttaccgttttaaccccggtattttaccccccgggttaccccggtacttaacccgttttccggaaccgtttaccccgttaaacgg

SEQ ID NO: 52699 - DNA, 640 bp, Homo sapiens
  misc_feature: GYAE6OF02H0QYQ.18.11.A11.1.454.CMB.1.raw
  modified_base (301)..(301): a, c, t, g, unknown or other
  misc_feature (301)..(301): n is a, c, g, or t
  modified_base (373)..(373): a, c, t, g, unknown or other
  misc_feature (373)..(373): n is a, c, g, or t
tcagtacgagtatgcacgaccggtgctcgatttagctacgactgcaggggcagcaagatggtgttgcagacccaggtcttcatttctctgttgctctggatctctggtgccggacggggacatcgtgatgacccagtctccagacctcctggttgtgtctcgtgggcgaggagggcccaccatccaacgtgacaagtccaggccagagttgttttatacagcctaccaaacaataaccaactacttacgcgttcggtacaggcaacgaaccaggacacgcccctaaggtcctctattacgngggcatccggtacccgggacggttcccggggtccctaggaccgtacttccgaaggacggcgacggcgggtcngggacaggtactttcgacttcgcaccagtccaaccaactgacaggcagacgtagtgtggacttacgtttaattcgatcgatacactattatccgttacctcctcttccgtacggtccggacggggtacgggaaccgtaagggtacggaagttccgaaacgtaaaccggtagttaccggtggaccgttacgaccgtaccaacggttccttggtttacccgtaactccgttcccgtttacccgccgtttccgtactacgtacttaaccg

SEQ ID NO: 52700 - DNA, 843 bp, Homo sapiens
  misc_feature: GYAE6OF02GNKKZ.18.11.A11.1.454.CMB.1.raw
tcagtacgagtatgcacgaccggtgctcgatttagctacgactgcaggggcaggcaagatggtgttgcagacccaggtcttcatttctctgttgctctggatctctggtcgccgacggggacatcgtgatcgacccagtcctccgagaccttcccgtggttgtcgtcctcgtcgggcgaggagggcccaccgatcaactgcaagtccagccagagttgtttactacagcctaccaacaactaacaacttacttagtcttcggaccagcaacgaaaccaggacctaaccgccccctaaggtccctacactttacgacggactatcccggtaacccgggtcgtaccccggggtcccctaggacccgtacgttcccgaggtacggtccgaagggtccggggttcgtacggggaacctagggttactttccgacttcctaccgtaaccgtactaccgtaaccctaaccgtcggacctaacggtccgttaacgaacgtcgttacggtacggtaccgtttacgttttaagtttaccgtcggttactaacgtaacgttaaacttacgttacgttaaccgttacccgtttacccgttaccgttaccggtaacccggttttaccggggaaccggttaaaccggggttaacccggtaacggggtttaacgggtaaaccggttaacgttaaaccccgggtaaaacgtaaccggtaggtttaacccgtaccggttacgaccggtttaacccgtaggtttacccgttaccggtttaacccgtttcctaaccgtttacccccggttcccgtttacccgtttacccgtaacggttacccgttacccgtttaaccccgg

SEQ ID NO: 52701 - DNA, 683 bp, Homo sapiens
  misc_feature: GYAE6OF02GKY79.18.11.A11.1.454.CMB.1.raw
  modified_base (218)..(218): a, c, t, g, unknown or other
  misc_feature (218)..(218): n is a, c, g, or t
  modified_base (265)..(265): a, c, t, g, unknown or other
  misc_feature (265)..(265): n is a, c, g, or t
  modified_base (447)..(447): a, c, t, g, unknown or other
  misc_feature (447)..(447): n is a, c, g, or t
tcagtacgagtatgcacgaccggtgctcgatttagctacgactgcaggggcagcaagatggtgttgcagacccaggtcttcatttctctgttgctctggatctctggtgccggacggggacatcgtgatgacccagtcctccagacctcccgtggttgtgtctcgtgggcgagacgggccaccatcaactgcaacgtccacgccagtagttgttttanacacgctaccaaacaaactaaactaacttacttagcttaggtaccanacaacgaaaccaggaccacgtacccctaagtcctactacttacgcggctacgtccggtacccggggtacggtcccggggtaccctacgaccgtacttaccgaggacggccgaggtcgggtcgtagggacagttacttcaccgtctaccaccactccaaccacctgacgtagacgtagaagtntgtcgtactagtttatctggacagactaactactacgttctcccttcctcgttctacggggttcggaccggaaacggacggtacggtacggtacaacgtaaccaaacggttaccgtagggtcgtacgtaccgtaactacccgttaccttaggtcccgttttaccctaacggtttacccctttacccccgtttaccggacccttaacgtttccggtaacgttaaccccgtttaacgg

SEQ ID NO: 52702 - DNA, 668 bp, Homo sapiens
  misc_feature: GYAE6OF02IMBHY.18.11.A11.1.454.CMB.1.raw
  modified_base (301)..(301): a, c, t, g, unknown or other
  misc_feature (301)..(301): n is a, c, g, or t
  modified_base (370)..(370): a, c, t, g, unknown or other
  misc_feature (370)..(370): n is a, c, g, or t
  modified_base (658)..(658): a, c, t, g, unknown or other
  misc_feature (658)..(658): n is a, c, g, or t
tcagtacgagtatgcacgaccggtgctcgatttagctacgactgcagggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagttgttttatacagtcctaccaaacaataaaccaactacttagcttaggaccagcaacgaaaccgaggaccacgacccccctaaggtcctactatttacgnggctataccgtacccggggaggtcccggggtccctacggaccgtattcaggacggcgacggtcgggtcnggggacaggtacttaccgacttacctacctaaccgactaccgaaccctaaccgtcgacgacggtctaacgaacgtagttcggacgtactttaacggtttattacgtagtacacggtacttaaacgtacttaacttaccgttaccctcccgttactccggtaaccggtcggggacgggacgggtaaccggtagggttaacgaagtacgtaaccgtaaacgacgttcgggcgtacgtctacaccgtattccgtgttcctacgtacgttcccgtacccgactacgtcctanaccgttaacg

SEQ ID NO: 52703 - DNA, 866 bp, Homo sapiens
  misc_feature: GYAE6OF02FH2V5.18.11.A11.1.454.CMB.1.raw
  modified_base (311)..(311): a, c, t, g, unknown or other
  misc_feature (311)..(311): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagacctccctggttgtgtctcgtgggcgagacgggccaccatcaactgcaagtccagccagagttgttttatacagcctaccaaacaaataactaacttacttagtccttggtaacccagaccaacgaaaaccgaggaaccacgacccccttaacggtcctactattacgngggtacacgtccgtacccgggtacgtcccggggttcctacgtaccgattcgaggtacggcgaggcgggttcgtggacagtactttaccgactctccgaaccacgttaccaacccgtaacctcggaccgtacgggaccgttaggaaacggtacgttagggttacggtaccgtttaacggtttttaacggtttaccgttacggtacccgtacggtaaaccttaaaaccgttaaccgtttaacgtttaacccgttacccccgttttacccgttacccgtttaacccggttaacccgggggtttcccgggggaacgggggttaaacccgggggtaaacccgggttaaaccgggggtaaggggttaaaccgggtaaaccgtttaaacccgggaaaaaccggttaacccggttaacggggttacccggggtaccgttaccggaacccgtaacccggttaaccgtttccggtttaccggtttaccctttaacccgtacccgtttacccccggttaccccgtacccgttaaccgttcccgttaacggttaacccttaacccgg

SEQ ID NO: 52704 - DNA, 729 bp, Homo sapiens
  misc_feature: GYAE6OF02I7HIL.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtgccggacggggacatcgtgatcgacccagtctccagacctccgtggttgtgtctcgtgggcgagcggccactatcactgacaacgtccacgccagtagttagtttacacacgtcctacaaactaactaaacctaacttactagtacgttacgtaccagacaacgaaaccgacggaccgaccgtacccccgtaagtcctactacgttacgcggactacgtacccggtaccggggtacggtcccgggtacctcgaccgtataccggaggtaacggccgagggtccgggtacgtacggaacgtaacgttacgttcaaccgttccaacctaccgtactaacccaacctacgtacgaccgtaggcctaaggaacgagttcgtacgtactttaacgttacttcgtagtacacgtactaacttactacgttactcccgttacctaccgtacggtaccggtacgggtaccgggaacgggttaccgtaagggtacgtaacgtaacgtaacccgtaaacgtacgtcgggtccgtacgtacctaccggtaaccttcgttaaccgttccgttaccttacccgtaccgtttacccggtccccgttacctaccgtccctaacgttaccttaaccg

SEQ ID NO: 52705 - DNA, 673 bp, Homo sapiens
  misc_feature: GYAE6OF02G5397.18.11.A11.1.454.CMB.1.raw
  modified_base (210)..(210): a, c, t, g, unknown or other
  misc_feature (210)..(210): n is a, c, g, or t
  modified_base (295)..(295): a, c, t, g, unknown or other
  misc_feature (295)..(295): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagtagtgtttttanacagcctaccaaacaataacaacttactagcttggtaccagcagaaaaccaggacacgaccccctaaggtcctcgtactttacgngggacatccgtacccggggaggttaccccggggtccctaggaccgtattcgaggaggcagggcgggtcgtagggacagtactttcgacctctaccaccatccaacctaaccgtcgacacgggactagaacggacttggtggtacctaaggttttactttaacgttgtacgagtactaagtaccttaattaccgtcccttacctaccgttccgaccggtttaccggggacgggtaacgggtaccgaaggggtcggaagtaccgttaacgaaaaccgtaacgttgggagtcccgtacgaccaaccgtacttaccgttcgttacctttaccgaacctttcccgttaccccgtaccttacgttcccgttacacccgttaccg

SEQ ID NO: 52706 - DNA, 709 bp, Homo sapiens
  misc_feature: GYAE6OF02JDVIP.18.11.A11.1.454.CMB.1.raw
  modified_base (223)..(223): a, c, t, g, unknown or other
  misc_feature (223)..(223): n is a, c, g, or t
  modified_base (642)..(642): a, c, t, g, unknown or other
  misc_feature (642)..(642): n is a, c, g, or t
tcagtacgagtatgcacgaccggtgctcgatttagctacgactgcaggggcagcaagatggtgttgcagacccaggtcttcatttctctgttgctctggatctctggtgccggacggggacatcggtgactcgaccctagtcctaccagtacctcccgtggttgtcgtctcgtgggcgagacggccacgatcaactgcaacgtccagccagtagttcgtttanacgagtcctaccaaactaataacctaacttacgttagtccgttacggtaccagtaccgaacgtaaaccgacgaccgtaccgtaccccgtaaggtcctacgtacgttacgcggtacctacgtcccggtaaccgggtcggtcccgggtccctacggaacccgtacgtacgacggtacggtacgtacggtccgggtacgtacgggactacgttacgttccgaccgtccgtaccaccgtactacccgaacctacgtcgaccgtacggtacgtacggaagtagtcggtacgtactacgtttactacgtcgtacgacgtaactaacgttacgtacgttaccgttcccttaccgtccgtaccgtacggtaccgggacggtacggtacgaggtacgaacgtacctaacgaacgtacgttggacgtcncgtaccacgtcttcgttacgtccgttactccgttcccgtaccgtaccgtcgtacctacgaccttacg

SEQ ID NO: 52707 - DNA, 806 bp, Homo sapiens
  misc_feature: GYAE6OF02JFZGJ.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtgccggacggggacatcgtgatgacccagtctccagacctccctggttgtgtctctgggcgaggagggccaccatacaactgcaagtccagccagagttgtttatacagcctaccaacaactaaccaacttacttagcttacggtaccagacaacgaaaccgaggaccaccgacccccgtaacggtccctactacttttacgcgggactactccggtacccgggtacgggttccccggggtacccgtacggaccgtacgttaccgaggtacgggcgacgggaccggggtcgtacggggaactagtacgttttccaaccttcctaccaacccgaacttacccgaaacccgtaacccgtcggacccgtaaccgggtacttaggaaagtacgttacggtacggtacgttaacgttttaacgtttacgttcgttacgtaacgtacgtaaactaaccttaacgttacgttacccttcccttaccgttaccgttaccggttccgggtaccgggtaaccggggtaaccggtaacgggtacgggtaacggtaaccgttaacgtaaaccggtaaacgtacgggtacggtccgtaaaaacgtccgtaaccgtaaccttaccgttaccgttacccgtttaccgtttaacccgttaccccgtttaccccgttaccccgttaaccgttaccgttaccgtaaccgttaacccg

SEQ ID NO: 52708 - DNA, 751 bp, Homo sapiens
  misc_feature: GYAE6OF02GK1RY.18.11.A11.1.454.CMB.1.raw
  modified_base (225)..(225): a, c, t, g, unknown or other
  misc_feature (225)..(225): n is a, c, g, or t
  modified_base (736)..(736): a, c, t, g, unknown or other
  misc_feature (736)..(736): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagacctccctggttgtgtcctcgttggacgaggacggccactatacaacgtcgacaacgtccacgccaaggtagtttagttttanacgacgcctaccaaactaaactaacctaacttacttacgtcgttacgtaaccagacaacgaaaaccgaggaaccaccgtacccccgttaacggtccctacttaacttacggtcggactacttccggtaaccccggggtcggttccccgggtaccgtaccggaaccgttacttacgacggtaacggcgaacgggtccgggttacggtcgggaaacctaaggttacttttacccgacctttacccgtacctaaccgtaacgtaacccaaacccctaaaccgtcgtaacccggaggtaccgttaacgggaagtacggttaggtcggtacgttttaaagtttaccttacgttacgtacgacgtaactaaacgttacttaattaccgtcccttccgtactacccgtacggttaccgggacgggaaccggtacgtaacgggaggtaagacgtaaccgaaacgtacgtaggtgaccgtcgaccacgtcttacgtccgttactactactcccgtacccnctactcgtacactac

SEQ ID NO: 52709 - DNA, 659 bp, Homo sapiens
  misc_feature: GYAE6OF02F58US.18.11.A11.1.454.CMB.1.raw
  modified_base (294)..(294): a, c, t, g, unknown or other
  misc_feature (294)..(294): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagacctccctggttgtgtctcgtgggcgagagggccaccatcaactgcaagtccagccagagttgttttaatacagcctaccaaacaataaacaactacttagcttggaccagacagaaaccaggacacgaccccctaaggtcctcatttacgnggcactcgtaccgggcgtcccgggtcctcgaccgattcaggacggcaggcgggtcgtagggacagtactttcgactctaccaccactaccaaccaactgcaggctagaagtagtggtacggtactttaagttttacttaacgtcgtacgagtactaaacttaacttactacgttccccttccgttacctaccgtaccggtttacggggccggggtaaacgggaccgtaaggggtacgggtaaacgtaacgttaacgaaaaaccgtacgttacgggtacggtacgtaccgacctaaccgtacttccgtttacttccttaccgttaccttcccgttcccgtaccacgtttacgtaccgacgttaacc

SEQ ID NO: 52710 - DNA, 852 bp, Homo sapiens
  misc_feature: GYAE6OF02HJ48D.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctcgtgggcgaggagggccaccatcaatgcaagtccagccagagttgttttatacagctaccaaacaataaccaactacttagcttgtaccagcaagaaaccaggacacgaccccctaaggtcctacactttacgtgggactacttaccgtacccggggtacggtccccgggggtccccttacggaacccggtactttaccgacggtacgggcgaacgggtccggggttcgtacggggacctaaggtactttaccgaccttccgtaccaccgtaacttaccaaccctaaaccgttcggaaccgtaacgggtcccgttaagggaaacgtacgttacgggttcgggtaacgtttaacgggtttttaaccttaccggttacgttaccgtaacgggtaacttaaaacgtttaaccttaagtttaaacccggtttcccctttacccgttacccgttaccggttaacccggggttttcccggggtaacggggtaacccgggggtaaaccggttaacggggggtagggtaaaccgtaacggttaaacccggttaaaaaccgggtaaccgttaggggtaccggttaccggtacgtacccgtaaaccgttacggtttccgttaaccggttttccgttacccgttaaccgtttcccgttaaccccggaccttaaccgttacccgttacgtaacccgttaaaccgg

SEQ ID NO: 52711 - DNA, 832 bp, Homo sapiens
  misc_feature: GYAE6OF02IYR83.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtgccgacggggacatcgtgatgacccagtcctccagacctcccgtggttgtgtctcgtgggcgaggacgggcccacactacaactgacaacgtccagaccagtagttagtttttaatacacgacctaccaaactaaactaaaccaaaccttaacttagtcttacggtaccacgacaacgaaacgaccgacgaccgaccccgtaaccgtacctcctattacgttcggacgtactaccgtacccgggtaccgggtaccggggttccccggtaccggtaccgtaccgtacgtagaacgggacggacggtacgggtcgggtacgggtacggtaacgtacgtttacctaccgttcctaccgtacctactaacctaacccgtaaacctaccgtaccgacgtaacggtacggaacggtaagtccggtgggtacgtttaacggtttaacttttaacgttcgtaagtaccgaaccttaactaaacgttaaccgtttactttacccgttcccttccttaacccggttaccggttaacgggtccggggaaacgggtacccggtaagggttacgggaaaggtactaaaccgtaaaaccggtacgttaaccgggtcgggtactacccggtacgtaacccgtacgttttaacccggtttcgtaaccgtttaccccgtttactacccccgggtttcccgtaaaccccgttactacccggtttaccgaacctttaaaccgg

SEQ ID NO: 52712 - DNA, 583 bp, Homo sapiens
  misc_feature: GYAE6OF02FXG0H.18.11.A11.1.454.CMB.1.raw
  modified_base (208)..(208): a, c, t, g, unknown or other
  misc_feature (208)..(208): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttanacagctccaacaataacaactacttagcttggtaccagcagaaaaccaggacagccccctaaggtcctcattactgggcatccgtacccgggagtcccggggtcctcgaccgattcagtaggcagcgggtcgtaggacagtacttcactctcaccatacaaccaacctgacacggctacgaagagtcgtggactagtttattactagtacagacctaagtaactagttactcccttacctctcctacggtcggacgggtacggaccgtaaggggtcgaaggtaactacgaaaccgtaaacttgggtacgtcgtcgaccacctagttctacggttcctacgtacttccgttcccgacctagtcttacgacttaacg

SEQ ID NO: 52713 - DNA, 684 bp, Homo sapiens
  misc_feature: GYAE6OF02GG4UN.18.11.A11.1.454.CMB.1.raw
  modified_base (209)..(209): a, c, t, g, unknown or other
  misc_feature (209)..(209): n is a, c, g, or t
  modified_base (289)..(289): a, c, t, g, unknown or other
  misc_feature (289)..(289): n is a, c, g, or t
tcagtacgagtatgcacgaccggtgctcgatttagctacgactgcaggggcagcaagatggtgttgcagacccaggtcttcatttctctgttgctctggatctctggtgccgacgggacatcgtgatgacccagtctccagactccctggttgtgtctctgggcgaggagggccaccatcaactgcaagtccagccagagttgttttanacagctccaaacaataacaactactagcttggtaccagcaagaaaccaggacacgcccccttaaggcctactatttacgngggaccatccggtacccggggacggttcccggggtccctacggaccgtagttccgaggacggcgacggccgggttcgtcgggaacagtatttccactctccaccatccaacccgaaacgtcgacacggcgtacgaagtagtacggtggtacttaagttttatactaggtctaacgtactaaagtacttacgttaaccgtcccgttaccctgtaccgtacggtttaccgggacgggtaacgggaaccgtaacgggttgaacgttacgaaacgtaaaaccgtaacggttcggtacgggtacctacggaccgtaaccgtacgttaccgttacgttacctttacccgtacgtttaccccgttcccgaccttacgttacccgttaggtaacccttaacgg

SEQ ID NO: 52714 - DNA, 529 bp, Homo sapiens
  misc_feature: GYAE6OF02FPCH0.18.11.A11.1.454.CMB.1.raw
  modified_base (335)..(335): a, c, t, g, unknown or other
  misc_feature (335)..(335): n is a, c, g, or t
  modified_base (351)..(351): a, c, t, g, unknown or other
  misc_feature (351)..(351): n is a, c, g, or t
  modified_base (355)..(355): a, c, t, g, unknown or other
  misc_feature (355)..(355): n is a, c, g, or t
  modified_base (366)..(366): a, c, t, g, unknown or other
  misc_feature (366)..(366): n is a, c, g, or t
  modified_base (372)..(372): a, c, t, g, unknown or other
  misc_feature (372)..(372): n is a, c, g, or t
  modified_base (376)..(376): a, c, t, g, unknown or other
  misc_feature (376)..(376): n is a, c, g, or t
  modified_base (430)..(430): a, c, t, g, unknown or other
  misc_feature (430)..(430): n is a, c, g, or t
  modified_base (473)..(473): a, c, t, g, unknown or other
  misc_feature (473)..(473): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacacgccccctaaggtcctctattactgggcatctacccgggagtccgggtcctgaccgattcgagaggcagcggtcnggacagatttcactcncacntcaccactgcngctganatgngctagtttatactgtcagtacaatactatacgtccttcctctacgtcgttcggnggtacggacgtaggtcgaagcgtaacgaaacgtacgtagtcgntcgacaccatctagtccttcacgttccgttcccgacctagtaccctagtacctacg

SEQ ID NO: 52715 - DNA, 708 bp, Homo sapiens
  misc_feature: GYAE6OF02GHOS1.18.11.A11.1.454.CMB.1.raw
  modified_base (209)..(209): a, c, t, g, unknown or other
  misc_feature (209)..(209): n is a, c, g, or t
  modified_base (295)..(295): a, c, t, g, unknown or other
  misc_feature (295)..(295): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagttgttttanacagcctccaacaataaacaacttacttagcttaggtaccagcaagaaaccaggacacgcccccgtaaggtccctacatttaacgngggactactccgtaaccccggggtggtcccggggtccctacggacccgtattccgagtacggacacgggtccgggtcgtacgggacgaagtacgtttccacttccgtaccaccgtatacccgaaccctaacccgtcggaccgtaggccgtaacggaaacgtagtcgggttacggtaccgtttaagttttacgtttacgtaggtaccgtaacgtaccttaaacttacgttaattaccgttacccgttcccttacgttaccgtacccggtttccgggacgggtaccgggaaccggtacggggtagacgtacgtaaccgaaaccgtacgtcgggacgtcgtaccgaccgtacctacgtcgttacgttcctacgttaccttccgtcccgtaccttactacgtacgtacgttaacccg

SEQ ID NO: 52716 - DNA, 677 bp, Homo sapiens
  misc_feature: GYAE6OF02F2WSE.18.11.A11.1.454.CMB.1.raw
  modified_base (211)..(211): a, c, t, g, unknown or other
  misc_feature (211)..(211): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactcctggttgtgtctctgggcgagagggccaccatcaactgacaacgtccagccagtagttgttttanacagctaccaacaactaacaactacttagcttagtaccagcaagaaaccaggaccacgccccctaaggtcctctatttactggcactaccgtacccgggacggtccggggtccctcgaccgacttacgagacggcaggcgggtcgtgggacaggtactttacgactctccgacctactccgaaccctaaccttcgaccgtaacggtctaggaacgtagtcggtagtacgttaagttttaacgtttaacttggtactaacggtaactaacgttaaccttattaacgttcccttacccttccttaccgttaacggtttccgggacgggtaacgggaaccgtagggtagaagtacgttaaccgaaacgtacggttcgtacggcttagaaccgaccgtaagttccgttagttcccgttacgttaacttccccgttaccctacccgttactaccctacgtacccttaaccg

SEQ ID NO: 52717 - DNA, 562 bp, Homo sapiens
  misc_feature: GYAE6OF02HI47C.18.11.A11.1.454.CMB.1.raw
  modified_base (216)..(216): a, c, t, g, unknown or other
  misc_feature (216)..(216): n is a, c, g, or t
  modified_base (305)..(305): a, c, t, g, unknown or other
  misc_feature (305)..(305): n is a, c, g, or t
  modified_base (378)..(378): a, c, t, g, unknown or other
  misc_feature (378)..(378): n is a, c, g, or t
  modified_base (382)..(382): a, c, t, g, unknown or other
  misc_feature (382)..(382): n is a, c, g, or t
  modified_base (384)..(384): a, c, t, g, unknown or other
  misc_feature (384)..(384): n is a, c, g, or t
  modified_base (504)..(504): a, c, t, g, unknown or other
  misc_feature (504)..(504): n is a, c, g, or t
  modified_base (513)..(513): a, c, t, g, unknown or other
  misc_feature (513)..(513): n is a, c, g, or t
  modified_base (519)..(519): a, c, t, g, unknown or other
  misc_feature (519)..(519): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatcgacccagtctccagacctccctggttgtgtctcgtgggcgaggacggccaccatcaactcgcaagtccagccagtagttgttttaanacagcctaccaaacaaataaccaaactacttagcttggaccagacaacgaaaccacggacaccgaccccctaaggtcctactattacgnggcatccgacccgggcggtcccgggtcctcgaccgtatcgagaggcaggcggtcgtggacagtacttcactcncacncncaccactgacaggactaggatagtgtgtacttagtttactcgtgtacagtactaatactatactcctctctcgtacgtcgggacgaggaccgagggagagtacacgtaaacgtgtgcgcncacctactntacctntacctacgtacttcccgtcccgtactcttacgtacgacttacg

SEQ ID NO: 52718 - DNA, 735 bp, Homo sapiens
  misc_feature: GYAE6OF02GIO5V.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctcgtgggcgaggagggccacatcaactgcaagtccagccagagttgttttatacagcctaccaaacaataacaacttactagcgttgtaccagcaagaaaccaggacacgcccctaaggtcctacattacgtggactactccggtacccgggtacggtcccgggggtacccctcggacccgattaccgaggacggcgacgggccgggtacgtcgggacgtagtacgtttccacttccgtacaccgtactaccaaccctaaccttcgaccacgggtacttacggaaacgtagttcggtaggtacctttaagggtttttacttaccgtcggtaacctacggtactaaacttacgttaacttccgttacccttcccgttactcccgttacggttccgggacgggtaccgggtaaccgtaaggggtcgggaacggtactaaacgtaaaccgtaacggtacgggtcgtaccgtagtacccgtaactacggttaccgttaccggtttccgttaaccttacccgtttacccggtttaccccccgtccgtttaacccgtacgttaccgtaaccgttaaaccccgg

SEQ ID NO: 52719 - DNA, 697 bp, Homo sapiens
  misc_feature: GYAE6OF02JZZEV.18.11.A11.1.454.CMB.1.raw
  modified_base (217)..(217): a, c, t, g, unknown or other
  misc_feature (217)..(217): n is a, c, g, or t
tcagtacgagtatgcacgaccggtgctcgatttagctacgactgcaggggcagcaagatggtgttgcagacccaggtcttcatttctctgttgctctggatctctggtgccggacgggacatcgtgatgacccagtctccagacctcccgtggttgtgtctcgtgggcgaggacgggccaccatcaactgacaagtccagccaggtagttgttttanacagcctaccaaacaaactaacaacctacttagtcgttacggtaccagacaagaaaccgaggacaccgtaccccgtaagttcctactactttacgtgggactacgtacccgtaaccggggcgttcccggggtacccacggaccgtagttaccgagggtacgcgtacggtcgggtaccgtaggaacgtagtacttcgacctctaccaaccgtactaccacctaaccgtcgtacaacgggtacacgagtactagggtacgtacgtagttttaactcgcgttacaacgtactaacgttaactcttaccgttcccttcgttacccacggttaccgggttccggggaaggtaacgggtaacgagggacgtaacaagtaaccgtaaaacgtcgtggtacgacttccggactacgttaacttacgtccgtttactacccgttacgttaccgttacccggaccttacgacgttacgaccctttaccgg

SEQ ID NO: 52720 - DNA, 720 bp, Homo sapiens
  misc_feature: GYAE6OF02HSU0N.18.11.A11.1.454.CMB.1.raw
  modified_base (211)..(211): a, c, t, g, unknown or other
  misc_feature (211)..(211): n is a, c, g, or t
  modified_base (223)..(223): a, c, t, g, unknown or other
  misc_feature (223)..(223): n is a, c, g, or t
  modified_base (300)..(300): a, c, t, g, unknown or other
  misc_feature (300)..(300): n is a, c, g, or t
  modified_base (438)..(438): a, c, t, g, unknown or other
  misc_feature (438)..(438): n is a, c, g, or t
  modified_base (689)..(689): a, c, t, g, unknown or other
  misc_feature (689)..(689): n is a, c, g, or t
  modified_base (712)..(712): a, c, t, g, unknown or other
  misc_feature (712)..(712): n is a, c, g, or t
tcagtacgagtatgcacgaccggtgctcgatttagctacgactgcagggcagcaagatggtgttgcagacccaggtcttcatttctctgttgctctggatctcgtggtgccggacgggacatcgtgatgacccagtctccagactcctggtgtgtctcgtgggcgaggacggccaccatcaactgacaagtccagcctagagttgttttanacagcctacaanaagtaaacaactacttagtcttggaccagcaagaaaccaggaacaccgtaccccgtaaggtcctacgtaatttacgngggacacgtacccggtaaccgggtccgttcccggggtacccacggaaccgtatacggacggacggacgacgggtccgggttcacggggacaagttaacttccgaactccgtaccaacctactaccaaacccgttaacncggacacggggtacctaaggtaaaggtagtcgggtacggtacgttttaaacggtttttaactaacccggttggtaccaacgttaaacccttaaagggtttaactaacgtttaacccggtttccccgttaccttacccggtaacgttaccggggttaccgggaagggtaacccgggtaaaccggtaggggtacgaataccgtaaacgaaacggtacttgggacgtcgagtacccagacttctgtcttaccgntttaccctccgacgtctacgttnattaaccg

SEQ ID NO: 52721 - DNA, 570 bp, Homo sapiens
  misc_feature: GYAE6OF02HA08H.18.11.A11.1.454.CMB.1.raw
  modified_base (209)..(209): a, c, t, g, unknown or other
  misc_feature (209)..(209): n is a, c, g, or t
  modified_base (328)..(328): a, c, t, g, unknown or other
  misc_feature (328)..(328): n is a, c, g, or t
  modified_base (394)..(394): a, c, t, g, unknown or other
  misc_feature (394)..(394): n is a, c, g, or t
  modified_base (556)..(556): a, c, t, g, unknown or other
  misc_feature (556)..(556): n is a, c, g, or t
  modified_base (562)..(562): a, c, t, g, unknown or other
  misc_feature (562)..(562): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagttgttttanacagcctccaacaataacaactacttagcttggtaccagcagaaaccaggaccagccccctaaggtcctctattacgtggacagtccgtaccccgggaggtcccgggtccctgaccgtntccgagaggcagcgggtctggggacagatttcactctacaccatcaccaactcgcagcgtagaagntcgtgctagtttactacgtgtctaagcctaaatacctagttaccgtccctacgtcttcctaccggttcgggacggtaaggggtaccctaaggggtcgaacgtaactaccgaaacgtaacgtggtcgtactcgactacagttctacttcttcacttctcccgntatccngtataccg

SEQ ID NO: 52722 - DNA, 711 bp, Homo sapiens
  misc_feature: GYAE6OF02IWQAJ.18.11.A11.1.454.CMB.1.raw
tcagtacgagtatgcacgaccggtgctcgatttagctacgactgcaggggcagcaagatggtgttgcagacccaggtcttcatttctctgttgctctggatctctgtgccgacgggacatcgtgatgacccagtctcagactccctgtgtgtctcgtggcgagagggccaccatcaactgcaacgtccacgccagagttgtttatacagctacaacaataacaactacttagcttcgtaccagcaagaaaccagacacgccccctaaggtcctactatttacgtggactatccgtaccgggtagtcccgggtcctacgaccgtattaccgagacggtaccgaggtaccgggttcgtacgggtaacctacggtaactttccgaacttcccgtaccaaccgtaccttaaccaaacccgtaaccgtcgaccgtacgggtacgtaacggtaaagcgttacggtacggtaccgtttaacttttaacgttacgttacgtaccgtaaccgaacgttaaactaccgtaagtttacccgttacccttacccttcgttaccaccgggtttaccgggaacgggtacggtaacccgtaagggtacggaacggtaaccttaacgaaacgttaccgttaggaccggtacgtacaacggtaacacgttacgtcggtttacctaccgttactacccgttcccgacttacgtcgttacgaccttaacg

SEQ ID NO: 52723 - DNA, 668 bp, Homo sapiens
  misc_feature: GYAE6OF02JRMNM.18.11.A11.1.454.CMB.1.raw
  modified_base (215)..(215): a, c, t, g, unknown or other
  misc_feature (215)..(215): n is a, c, g, or t
  modified_base (294)..(294): a, c, t, g, unknown or other
  misc_feature (294)..(294): n is a, c, g, or t
tcagtacgagtatgcacgaccggtgctcgatttagctacgactgcaggggcagcaagatggtgttgcagacccaggtcttcatttctctgttgctctggatctctggtgccggacggggacatcgtgatgacccagtctccagacctccctggttgtgtctcgtgggcgaggagggccaccatacaactgacaagtccagccagagttgttttanacagctaccaacaataacaactactagcttagaccagacaagaaaccaggacacgacccctaaggtcctactattacgnggacctacgtaccgtacccggggacgtccccggggtcctaggaaccgtattaccgaggacggccgaggtccgggtcgtacgggaactaggtactttacacgtcctacaccgtactaccaaccctaacgtcgaccgaggacgttaggaacgtacgtggtacgacgtttagttttacttacgtcgtacgtacgtactaacgttactacgttaccgttaccctccttaccaccggttaccggtccgggaacgggtaccggtaaccggtaggtaggacggtaactaaccgaaacggtactcgggttacgctacgacctacgtaccgttatccgttacttccacgttcccctaccggcctacgtcgtaccgtatacccg

SEQ ID NO: 52724 - DNA, 775 bp, Homo sapiens
  misc_feature: GYAE6OF02H2MMS.18.11.A11.1.454.CMB.1.raw
  modified_base (208)..(208): a, c, t, g, unknown or other
  misc_feature (208)..(208): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttanacagctccaacaataacaacttacttagcttcggtaccagacaacgaaaccaggacacgaccccctaaggtcctactaattttacgtgggacctatcccgtacccggggacgttccccgggggtccctcggaacccgtattaccgaaggtacggccgacgggtccggggtcttcggggaaccaggtaacttttcccgacttaccgtacaacccgtatacccaaaccctaaccgttgaccgaaggtccttaagggaaacgagttggtacgggacctttagtttttaacttaacgttacgtacgtaacggactaaagtttacctaacgttacgttaccccttccttacctaccgttaaccgggtttccgggaacggggtaaccggggtaaaccgtaggggttaacgggaacgtaaacttaaacccgtaaaaccggtaaagtttaccgggaggtaccttaccggaccctaacccgttactacccgtttcggttaacccttttccgaaccgttttcccccgttaccccggtacccgttaaacgtttcccgttacgaacccgtttaaaccgg

SEQ ID NO: 52725 - DNA, 691 bp, Homo sapiens
  misc_feature: GYAE6OF02JZ9NN.18.11.A11.1.454.CMB.1.raw
  modified_base (215)..(215): a, c, t, g, unknown or other
  misc_feature (215)..(215): n is a, c, g, or t
  modified_base (313)..(313): a, c, t, g, unknown or other
  misc_feature (313)..(313): n is a, c, g, or t
  modified_base (460)..(460): a, c, t, g, unknown or other
  misc_feature (460)..(460): n is a, c, g, or t
  modified_base (502)..(502): a, c, t, g, unknown or other
  misc_feature (502)..(502): n is a, c, g, or t
  modified_base (607)..(607): a, c, t, g, unknown or other
  misc_feature (607)..(607): n is a, c, g, or t
tcagtacgagtatgcacgaccggtgctcgatttagctacgactgcaggggcgagcaagatggtgttgcacgacccaggtcttcatttctctgttgctctggatctctggtgtcgacgggacatcgtgatgacccagtctccagacctccctggttgtgtctctgggcgagacgggccaccatcaactgacaagtccaggccaggagttgttttanacacgtccgtaccaaacaactaaacaacttacttaggtcctttagggaccctagacaacgaaaccaggacacgccccctaaggtcctactattaacgngggccaagtcccgacccggggacgttacccggggtcctacggaccgtattccgaaggtacggaccgtcggacgggtacgtacggggtaaccaggttagttcctaccgtacgtaccaacgtactaccaacctaacgtgacgaccggtntagacagtacgtgacttacttagtaacctgtacacgtaactnttaacttacgttacgttaccctactcgttaactcgggtaccggtaagccgggtaaacgagggttaccgaagtacgtaaccgtaaacgtactaagggtccgtacgngtacccaagtccgttaacgtcggttaaaccttctaacggttccccgttaccggacttacccgtaggttaccctagttaaccccg

SEQ ID NO: 52726 - DNA, 520 bp, Homo sapiens
  misc_feature: GYAE6OF02IQLYR.18.11.A11.1.454.CMB.1.raw
  modified_base (153)..(153): a, c, t, g, unknown or other
  misc_feature (153)..(153): n is a, c, g, or t
  modified_base (208)..(208): a, c, t, g, unknown or other
  misc_feature (208)..(208): n is a, c, g, or t
  modified_base (247)..(247): a, c, t, g, unknown or other
  misc_feature (247)..(247): n is a, c, g, or t
  modified_base (284)..(284): a, c, t, g, unknown or other
  misc_feature (284)..(284): n is a, c, g, or t
  modified_base (298)..(298): a, c, t, g, unknown or other
  misc_feature (298)..(298): n is a, c, g, or t
  modified_base (320)..(320): a, c, t, g, unknown or other
  misc_feature (320)..(320): n is a, c, g, or t
  modified_base (330)..(330): a, c, t, g, unknown or other
  misc_feature (330)..(330): n is a, c, g, or t
  modified_base (344)..(344): a, c, t, g, unknown or other
  misc_feature (344)..(344): n is a, c, g, or t
  modified_base (364)..(364): a, c, t, g, unknown or other
  misc_feature (364)..(364): n is a, c, g, or t
  modified_base (376)..(376): a, c, t, g, unknown or other
  misc_feature (376)..(376): n is a, c, g, or t
  modified_base (424)..(424): a, c, t, g, unknown or other
  misc_feature (424)..(424): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctcagactccctggttntgtctctgggcgagagggccaccatcaactgcaagtccagccagagtgtttttanaccagctccaacaataacaactacttagcttggtaccancagaaaccaggacagccccctaaggtcctcatttacnggcatctaccgggngtccgggcctgaccgattcagnggcagcggtntgggacagatttcnctctcaccatcacctaaccngcaggctgaagntgtaggcagttttatactgtccagctaatacttatgtcctcgtctacncgttcggcggaggaccgaaggtgagatacaaacgtacgtacgtgactgaccacgacttctgttcttactagtcccttccgccaatctacgactacg

SEQ ID NO: 52727 - DNA, 839 bp, Homo sapiens
  misc_feature: GYAE6OF02IYZ2F.18.11.A11.1.454.CMB.1.raw
  modified_base (212)..(212): a, c, t, g, unknown or other
  misc_feature (212)..(212): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctcgtgggcgagacgggccaccatcaactgcaacgtccagccagtagttgtttanacagcctaccaaacaataacaactacttagcttgtaccagacaagaaaccaggacacgtacccctaaggtcctacgtaactttacgagggactacgtacccgtacccggggacggttccccggggtccctacggaccgtattccgaggacggacgacggtcgggtcgtgggacagtacttccactcgtaccaccgtatacccaacctaaccgtcgaccggtacggtaccgtaaggtaaacggtacgttacggtacgggtaacctttaacgggtttttaaacttacccggtttacggtaacccgaaacggttaaccttaaaacgtttaaccgtttaaccgttaacccggtttacccccttaccccgtttaaccggttacccggttaaccggggtttaccccgggggaacgggggttaaacccggggtaaacccggttaagggggttaaacgggtaaccggtaaaccggttaaaccgtaaaaacccgggtaacggtttacgggtaaccgggtaccgttaccgaacccgttaaccgtaccggtttaccggttaccgttaacccttaccgttacccggtttcccgttacccccggtaccttaacgtcccggttacgtaaccgttaacccgg

SEQ ID NO: 52728 - DNA, 522 bp, Homo sapiens
  misc_feature: GYAE6OF02GYZ3O.18.11.A11.1.454.CMB.1.raw
  modified_base (208)..(208): a, c, t, g, unknown or other
  misc_feature (208)..(208): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttanacagcctaccaacaataacaactacttagcttggtaccagcagaaaccaggacagccccctaaggtcctcatttactgggcatctacccgggagtccggggtccctgaccgattcagagcagcgggtctgggacagatttcactctcaccatcaccaacctgcaggctagaagatgtcggctagtttatactgtcagcaatactatacgtcctctctcacgttcggacggacggaccaaggtgagatacgaaacgacgtgtgctgaccacctatcctgtccttcacttccgttcccgcctatcctagactaccg

SEQ ID NO: 52729 - DNA, 547 bp, Homo sapiens
  misc_feature: GYAE6OF02I16LC.18.11.A11.1.454.CMB.1.raw
  modified_base (395)..(395): a, c, t, g, unknown or other
  misc_feature (395)..(395): n is a, c, g, or t
  modified_base (474)..(474): a, c, t, g, unknown or other
  misc_feature (474)..(474): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagttgttttatacagctaccaaacaataacaactacttagcttggtaccagcaagaaaccaggacacgccccctaaggtccctactatttacgtgggcactcgtacccgggagtcccggggtccctgacccgattcagaggcaggcgggtctagggacagatttccactctcacatccacctaacctgcagctaganagtgtcggactagtttattactgtacagactaatacttatcgttcctcctctcgtacgttcgggcggaggacctagggngagactacgaacgatggtgctgcctacgtctctgttctactacttcccgtccctccacttctagacttaaccg

SEQ ID NO: 52730 - DNA, 632 bp, Homo sapiens
  misc_feature: GYAE6OF02H0TY0.18.11.A11.1.454.CMB.1.raw
  modified_base (209)..(209): a, c, t, g, unknown or other
  misc_feature (209)..(209): n is a, c, g, or t
  modified_base (293)..(293): a, c, t, g, unknown or other
  misc_feature (293)..(293): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagttgttttanacagctaccaacaataacaactacttagcttaggtaccagacaagaaaccaggacacgaccccctaaggtcctactatttacgngggactatccgtacccgggagtcccggggtcctgaccgattcgagaggcaggcgggtactggggacaggtactttcacttctcaccatacaaccacctgaccgaggctagaagtagtgtggtacttaaggtttttactactgtcaagactaattacttattacgtcccttacctcttaccgtacggttccgggacgggtaacgggaacccgtaagggtcggaacgtaacttaccgaaaaccgtacgtaggtacgggccttacggaccctaaccgtaacttccgttcgttaccttcctaactttcccgtaccccgtactaacgtttcctagaccctaacg

SEQ ID NO: 52731 - DNA, 690 bp, Homo sapiens
  misc_feature: GYAE6OF02HB2LM.18.11.A11.1.454.CMB.1.raw
  modified_base (397)..(397): a, c, t, g, unknown or other
  misc_feature (397)..(397): n is a, c, g, or t
  modified_base (630)..(630): a, c, t, g, unknown or other
  misc_feature (630)..(630): n is a, c, g, or t
tcagtacgagtatgcacgaccggtgctcgatttagctacgactgcaggggcagcaagatggtgttgcagacccaggtcttcatttctctgttgctctggatctctggtgccggacggggacatcgtgatcgacccagtcctccagacctcccgtgggttgtgtctcgtgggcgaggacgggccaccatcaactgacaacgtccacgccagtagttgttttacacacgcctaccaaactaactaaacctaacttacttagcttaggtaccagacaagaaaccaggaccaccgacccctaaggtcctacgtacgtttacgcgggactacgtacccggtacccggggtaggttccccgggtccctacggaccgtattcgaggacggcgaggtcgggtacngggactagtactttcacctcgtaccacctactaccaacctactcgacgtaacggacgtacgaacgtagttcgtacggttacgttaagttttactaacgttcgtacgagtacctaaacttacgtagttacctcccttacgtccttaccgtaccgggttcggacgggtaacggaaccgtagggtacggtactaacgtaacgaaacgtacgtaggtcgtacgactaccgtacgttntacccgtttcgttactccgttaccgtaccttcccgccttacgtcttacggattaacccgg

SEQ ID NO: 52732 - DNA, 688 bp, Homo sapiens
  misc_feature: GYAE6OF02GF60I.18.11.A11.1.454.CMB.1.raw
  modified_base (211)..(211): a, c, t, g, unknown or other
  misc_feature (211)..(211): n is a, c, g, or t
  modified_base (394)..(394): a, c, t, g, unknown or other
  misc_feature (394)..(394): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagttgtttatacngctaccaaacaaactaacaactacttagcttggtaccagcacgaaaccagacacgaccccctacggtacctcatttactgggactactacgtaccgggacgtaccgggtccgtcgaccgacttcacgaggcgaggtcgggcgtgggacgagtacttctctctcaccataccaccacgtcgacncggactagaagatcggtacgacttagttttacttacgtacgtacgtaacgacgttaacttacgttaacgttaccgttcccctttcccttaccgttacccgttaccgggtttaccggggcgggtaaaccggggtaaaccgtaggggtacgtaacggttaacaaccgggttaaaaccgcgtttagggacgggtccttcggaaccttaccgttaacgttcggtttaccgttaccttttacctaccggtttccccgttacccggtacccttagttcccggttaacagtttaaccccgg

SEQ ID NO: 52733 - DNA, 801 bp, Homo sapiens
  misc_feature: GYAE6OF02G1UAY.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtgccgacggggacatcgtgatcgacccagtctccagactccctggttgtgtctcgtgggcgaggacggccaccatacaactgcaacgtccagccgagtagttcgttttatacacgtcctaccaaacaaactaaacaacttacttagccttacggtaccagaccaacgaaaccgaggaccaccgaccccctaaggtccctacgtacgtttacgcgggcacgtccgtacccggggtacggtccccgggtccctcggaacccgtcgtacgaggacgggcacggtcggggtcgtagggactagtactttaccgactcctaccaacctactacccgaaccctaaccgtcgacccgtaggtactacgggaacgtgttcggtacggtacttaaggtttttaactccgtacgtacgtaacgtacgtaaactttacgtaacgtttaccgttaccctttcccgtaaccgttcgtaaccgggttcccgggtaacgggaccgggtaacccgttaagggggtacgaacggttaactaaacccggtaaacggtaccgtacgggttcgggaacctaccgggtactaaaccccgtttcgggttaacccttcgggtttacccgttaacccgtttccccgtttaccccccggtttaccccgtaacccggtttaaccggtttaccccgtaaacggttaacccctttaaacccc

SEQ ID NO: 52734 - DNA, 723 bp, Homo sapiens
  misc_feature: GYAE6OF02HQGAF.18.11.A11.1.454.CMB.1.raw
  modified_base (211)..(211): a, c, t, g, unknown or other
  misc_feature (211)..(211): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctcagacctccctggttgtgtctcgtgggcgaggaggccaccatcaactgcaagtccagccagagttgttttaanacagtcctaccaaacaataacaactacttagcttcgtaccagacaacgaaaccaggacacgaccccctaaggtcctactactttacgcggacctaagttcccgtacccggggtacggttcccgggggtcccctaggtaccgtattaccgaggtacggtcgaaggtccgggtctggggacaggtactttcgacttctaccacctacgtaccaacctaacctgaccgacgggtcctaaggaacgtagtacggtacgggtacttaacggttttataccgtttacgactaacggtactaaacttacgtaacttacgttacccttccctttaccgtacgttaccggtttaccgggacgggtaaaccggggaaccgtaaggggtacgtagtaaacgtaaccgaaaaccggtcgtacggtcggtaccgtacgaccgtaaccgtaacgttcccgtacggttacctttaccgtacgttcccctacccggtaccttacgtaccttacgtaaccttaacccgg

SEQ ID NO: 52735 - DNA, 616 bp, Homo sapiens
  misc_feature: GYAE6OF02FJL8O.18.11.A11.1.454.CMB.1.raw
  modified_base (211)..(211): a, c, t, g, unknown or other
  misc_feature (211)..(211): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccacatcaactgcaagtccagccagagttgttttatacngctccaaacaataacaactacttagcttggaccagcagaaaccagacagccccctaaggtcctcattactgggcatctacccgggagtccgggtcctgaccgattcagaggcaggcgggtcgtgggactagtatttcactctccacctataccaaccaacctgacctaggctagaacgatcggtggcttagttttactttactgtacgaacgtactaaactacttaattacgtccccttacccttacgtccgtacggtttccgggacgggaacgggaaccgtaaggggtacggaagtaacgttaaccgaaaacgtacgttcgtggtacctggaccaaccgtacgtccttacggttccttactaccgttacccgttcccgtaccttactccttacgaccttaaccg

SEQ ID NO: 52736 - DNA, 828 bp, Homo sapiens
  misc_feature: GYAE6OF02JANSW.18.11.A11.1.454.CMB.1.raw
  modified_base (207)..(207): a, c, t, g, unknown or other
  misc_feature (207)..(207): n is a, c, g, or t
  modified_base (294)..(294): a, c, t, g, unknown or other
  misc_feature (294)..(294): n is a, c, g, or t
tcagtacgagtatgcacgaccggtgctcgatttagctacgactgcaggggcagcaagatggtgttgcagacccaggtcttcatttctctgttgctctggatctctggtgccgacgggacatcgtgatgacccagtctccagactccctggttgtgtctctgggcgagagggccaccatcaactgcaagtccagccagagtgttttanacagcctaccaacaataacaactacttagcttggtaccagacagaaaccaggaccacgccccctaaaggtccctacgattttaacgngggacacgttccgtaacccggggacgttcccgggggtacccttacggaacccgtacgtttaccgaaggtaacgggccgtaacgggtccgggggttaccgtacgggggtaaccaaggttaacgtttttacccgaaccttccgttacccaacctataccctaaacccaaaccgttggacccgtaaggggtacccttaagggaaacggtactttacggggttacggtaacccgtttaagggtttttaacctttaacccggttagggttaccaaaccgggtaacgttaaaacttaaaccgttaacgttaaccggtttaccccttacccggtttaccttacccggtaaccgggtttacccggggaaccggggtaaacggggtaacccgtaaaggggtaccgggtaagtaaccgtaaccggtaaaaaccggtacgttacgggtacggtaccgtacggtaacccaacgtaacgtttaccgttcgttaccgtttaccaacgtttcccgtacccgtacgtacttccgttacgaaccttaaccg

SEQ ID NO: 52737 - DNA, 712 bp, Homo sapiens
  misc_feature: GYAE6OF02GIRYS.18.11.A11.1.454.CMB.1.raw
  modified_base (545)..(545): a, c, t, g, unknown or other
  misc_feature (545)..(545): n is a, c, g, or t
  modified_base (552)..(552): a, c, t, g, unknown or other
  misc_feature (552)..(552): n is a, c, g, or t
tcagtacgagtatgcacgaccggtgctcgatttagctacgactgcaggggcagcaagatggtgttgcagacccaggtcttcatttctctgttgctctggatctctggtgccggacggggacatcgtgatcgacccagtcctccagacctcccgtggttgtgtctcgtgggcgaggacggccacatccaactgctaacgccacgccagtagtttgttttaacacacgtcctaaccaaacaaaactaacctaacttaccttagtaccgttacggtaaccagtaccaaacgaaaccgacggtaccaacccgtccccgttaaaggtccctacttacgtttaccggcggactaccgttaccccggtaccgggggtacggtccccggggttacccctacggaccgtcgttacggacggtacggcgacgggtccggtacggagggaactaggttactttaccaccgttcctaccgaacctactacccgaacccaaccgtcgaacgtcgggtactaggaacgtgtcggtacgttacgttagtttccttacgtntaacgtntaacgtactacttatacccgtccttcgtccgttacgccggttgggacgggtaccgtaacgagggtacgaacgtaacgtaaccgaacggtgtacggttcgactcgacctacgtcttcctcgttctctaccgtaccctaccgttacctatccgtactactcg

SEQ ID NO: 52738 - DNA, 759 bp, Homo sapiens
  misc_feature: GYAE6OF02GF9VM.18.11.A11.1.454.CMB.1.raw
  modified_base (155)..(155): a, c, t, g, unknown or other
  misc_feature (155)..(155): n is a, c, g, or t
  modified_base (221)..(221): a, c, t, g, unknown or other
  misc_feature (221)..(221): n is a, c, g, or t
  modified_base (224)..(224): a, c, t, g, unknown or other
  misc_feature (224)..(224): n is a, c, g, or t
tcagtacgagtatgcacgaccggtgctcgatttagctacgactgcaggggcagcaagatggtgttgcagacccaggtcttcatttctctgttgctctggattctctggtgccgacggggacatcgtgatgacccagtctccagactccctggttntgtctcgtgggcgaggacgggccaaccataccaactcgacaagtccacgccagtagttagttttanacngcctaccaaacaataacactacttagcttaggtaccagacaagaaaccaggacaccgtacccctaagtcctactatttaccgaggactacgttcccgtaccggggtcgttcccgggtcctacggaccgtattcgagacgacgaggtccggtcgagggactaggtctttccacgttctaccaccgtactacccaaccctaaccgtcgacggtacggtcgtaaggaacgtagttcgggacggttacgttaaagtttttaacgttaaccgttagtacgtaaacggtaccttaaacttacgttaacttaaccgttccccgttaccttaccgttaccgggtaaccggggtttaccgggaccgggggttaaaccgggtaacccggtaaggggtttccgaaagttaaaccgtaaacccgtaaaacggtacggtacgggttaccggaccgttacgacccgttaacccgtcgtttaccgttcccggtacttacccgtactttaccccggtaccctaccttacgttacgtaaccgtacgttaccg

SEQ ID NO: 52739 - DNA, 564 bp, Homo sapiens
  misc_feature: GYAE6OF02FU8A7.18.11.A11.1.454.CMB.1.raw
  modified_base (208)..(208): a, c, t, g, unknown or other
  misc_feature (208)..(208): n is a, c, g, or t
  modified_base (505)..(505): a, c, t, g, unknown or other
  misc_feature (505)..(505): n is a, c, g, or t
  modified_base (526)..(526): a, c, t, g, unknown or other
  misc_feature (526)..(526): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttanacagctccaacaataacaactacttagcttggtaccagcagaaaccaggacagcccctaaggtcctacattactgggcatcgtaccccgggagtcccggggtccctgacccgattcagaggcaggcgggtctgggacagatttcactctcaccatcaccaacctgcaaggctagaacgatgtagggctaagtttacttactgtacacgtacaataacttattacgttcctcctcgtactacgtttccgggcggaacgggaccgaaggtggaacgagttaacaaaccggtactggtgntacgcaaccgtcgtactcgtnttacctacgttcctacccgtaccagtctacgacttaac

SEQ ID NO: 52740 - DNA, 758 bp, Homo sapiens
  misc_feature: GYAE6OF02ID611.18.11.A11.1.454.CMB.1.raw
  modified_base (228)..(228): a, c, t, g, unknown or other
  misc_feature (228)..(228): n is a, c, g, or t
  modified_base (232)..(232): a, c, t, g, unknown or other
  misc_feature (232)..(232): n is a, c, g, or t
  modified_base (536)..(536): a, c, t, g, unknown or other
  misc_feature (536)..(536): n is a, c, g, or t
tcagtacgagtatgcacgaccggtgctcgatttagctacgactgcaggggcagcaagatggtgttgcagacccaggtcttcatttctctgttgctctggatctctggtcgccggacgggacatcggtgagtcgacccagtcctccgagtacctcccgttggtgtcgtctcgtgggacgaggacggccaccatacaactcgacaacgtccagccgagtagttgttttanacancctaccaaacaataacacttactagtcgttacggtaccagacaacgaaacctacggacaccgtaccccgtaacgcctctattacgtgacaccgtaccgtaacccgggtccggtacccgggtccctacgtaaccgtacgttaccgaacggaccgggtaccgtaacgggtccgggtacggttacggggaactaacgggtactttacctaccgtttacccaccttaaacccgtaactacccaaacccgtaccgtcgacgtaaccggtacgtacggaaagttgtaggttacggacctttaaaggtttnttacgtagttcgaacgtaactaactacttacgtacgttccctactaccgttaccgtacgggtccgggaaacccggggtaggtaaaccggtaagggtacgtaagtaaccgtaaccgaacggtaacgtcggtacggcctacggacctaccgttacgttcccggttattacccctagtacccgtttcccggacccctacccgtaacgtcgtaccgacttaaccgg

SEQ ID NO: 52741 - DNA, 706 bp, Homo sapiens
  misc_feature: GYAE6OF02HA9LK.18.11.A11.1.454.CMB.1.raw
  modified_base (154)..(154): a, c, t, g, unknown or other
  misc_feature (154)..(154): n is a, c, g, or t
  modified_base (208)..(208): a, c, t, g, unknown or other
  misc_feature (208)..(208): n is a, c, g, or t
  modified_base (222)..(222): a, c, t, g, unknown or other
  misc_feature (222)..(222): n is a, c, g, or t
  modified_base (262)..(262): a, c, t, g, unknown or other
  misc_feature (262)..(262): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttntgtctctggcgagagggccaccatcaactgacaagtccagccagagttgtttanacagcctaccaaanaataaccaactacttagcttaggtaccagacaagaaaccnggacacgacccccgtaaggtcctactattacgtgggactagtacccgtaacccggggtacgtccccggggttacctacggaaccgtagttaccgaaggtacggacgtagggccggggtaccttaggggaacctaggtacttttacccgacgttaccgtccaaacctacgtacccaaccgtaacctgtaccgaaggtcgtaacgaagtacgtagtacggacttaagtttacgtactaggtctaagtacaaacgtacgtacttaccgtccttacctaccgtaccacgggtttaccgggacggtaacggaaccggtaacgggtagaacgttaactaaccggaaaaccgtagtacgggtcgtacgtcgaaccgtaccgtattaccgttcggtaaccttacggtaaccttccgttccccggaactttacgtacttaccggacttaacgg

SEQ ID NO: 52742 - DNA, 628 bp, Homo sapiens
  misc_feature: GYAE6OF02FG5EO.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagacctccctggttgtgtctctgggcgagaggccaccatcaactgcaagtccagccagtagttgttttacacagcctaccaaacaataaccaacttacttagcttggtaccagcaacgaaaccaggacacgccccctaaggtccctactatttacgtcgggcactccgtacccggggacgtcccggggtcctcgaccgtattcagaggtcaggtcgggtcgtggacagtactttacgactctacaccataccaaccacctgacacggtactagacgactgtcggctagtttatactgtcagctaactactacttacgtccttcctctacgtaccggttcgggacggacgggaaccgtaagggtcgggaactagtaaccgaaacgtacgtacgggtccgacgttacgaccgtaacctactcgttacgttacctttacgtaacccttcccgtttaccccgaccgttacctccgtacgttaaccttaaccg

SEQ ID NO: 52743 - DNA, 570 bp, Homo sapiens
  misc_feature: GYAE6OF02GA49R.18.11.A11.1.454.CMB.1.raw
  modified_base (287)..(287): a, c, t, g, unknown or other
  misc_feature (287)..(287): n is a, c, g, or t
  modified_base (343)..(343): a, c, t, g, unknown or other
  misc_feature (343)..(343): n is a, c, g, or t
  modified_base (507)..(507): a, c, t, g, unknown or other
  misc_feature (507)..(507): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctaccaacaataacaactacttagcttaggtaccagcagaaaccaggacacgccccctaaggtcctcatttacgngggcatcgtacccgggagtcccggggtccctgaccgattcagaggcaggcgggtcngggacaggtattcactctcaccataccacaacctgacaggctagaagagtgtggctagtttattactgtcagtcaatactattacgtccctcgtctacgtacgtcggacggacggaccgagggtcgagtactacgaaacgtacgtagcgtcgtcgactaccgtnttaccgttcgtacctttacgtaccttcccgttacccgacccttattccgtacgtacttaaccg

SEQ ID NO: 52744 - DNA, 748 bp, Homo sapiens
  misc_feature: GYAE6OF02I5KO7.18.11.A11.1.454.CMB.1.raw
  modified_base (674)..(674): a, c, t, g, unknown or other
  misc_feature (674)..(674): n is a, c, g, or t
tcagtacgagtatgcacgaccggtgctcgatttagctacgactgcagggcagcaagatggtgttgcagacccaggtcttcatttctctgttgctctggatctctggtgccgacggggacatcgtgatgacccagtctccagactcctggttgtgtctctagggcgagacgggccaccatcaactgcaagtccagccagagttagtttttacacagtcctaccaaacaaactaaaccgaactaaccttaggacttacgggtaacccagacaaggaaaaccaggaacaccgtacccccctaaacggtcctccaattttacgtcgggcctaacgtaccgtacccgggacggtcccggggtccctaggacccgtagttacgaccgtagggccgtacggtcgggtttcgtacggggactaacggtacttttccgaccttacctacaaccctactacccaaacccgtaaccgtcgaccgtagggaccttagaaagtagttacggtagtaccgttaaagttttaacgttacgtaggtacctagaacttaaacgttaccttaacgttaccgttacccgttacccttccgtaccgtacccggggtttacgggacccgggttaaacgggtaccgaaacgggttgggaacttaacgtaccggaaaaccgtagtcggttaacgggntccgtaaccgactaacgtcttcggttacccttctacgttcccggtaccgtccctagtacccttagaccccttag

SEQ ID NO: 52745 - DNA, 788 bp, Homo sapiens
  misc_feature: GYAE6OF02GIT1Z.18.11.A11.1.454.CMB.1.raw
  modified_base (160)..(160): a, c, t, g, unknown or other
  misc_feature (160)..(160): n is a, c, g, or t
  modified_base (211)..(211): a, c, t, g, unknown or other
  misc_feature (211)..(211): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctntgggcgagagggccaccatcaactgcaagtccagccagacgttagttttanaccagcctaccaaactaaataaccaaacttacttacgtctttacggtaaccagacaacgaaaacccaagggaccacgaccccccttaaaggtccctactaatttacgcgggactatacccgtacccggggacggttcccggggtcccctggaaccgtattccgaaggtacgggcccgaagggtccggggttcgtacgggggaaccaaggttaacgtttaccgaactccttaccaaacccgtaattaaccccaaccctaaaccccgttcggacccgtaacggggtacccttaacggggaaaagtacgttacgggtacgggtaaccctttaaggtttttaaatttaccgttacggtactaacggtaactaaacttacttaaacgttacttccctcctaactcccgtaacggttccgggaacggtacgggacctaaaggggtcgaaacgtaccgttaaccgaaaacggtaccgttagggaccgtacgttccgaaccgtacgtaacgttccgtaccgttcctttagtaaccccgtttcccgttccccgaaccttaacgttcccgtaccggtaacttaccgg

SEQ ID NO: 52746 - DNA, 626 bp, Homo sapiens
  misc_feature: GYAE6OF02G8POD.18.11.A11.1.454.CMB.1.raw
  modified_base (208)..(208): a, c, t, g, unknown or other
  misc_feature (208)..(208): n is a, c, g, or t
  modified_base (289)..(289): a, c, t, g, unknown or other
  misc_feature (289)..(289): n is a, c, g, or t
tcagtacgagtatgcacgaccggtgctcgatttagctacgactgcaggggcagcaagatggtgttgcagacccaggtcttcatttctctgttgctctggatctctggtgccgacgggacatcgtgatgacccagtctccagactccctggttgtgtctctgggcgagagggccaccatcaactgcaagtccagccagagttgttttanacagctaccaacaataacaactacttagcttgaccagcaagaaaccaggacacgacccccctaaggtccctctatttacgnggacacttccgtaaccccggggacggttccccggggttcccctggacccgtacttcgaggacggcaggccgggtcgtgggacagtatttccactctccacactcaaccactgcagctagagtatgagctagtttactactcgtacagactaactactattacgtccttcctactcgtaccgttcgggacggtacggaccgtaagggtgaacgagttaaccgaaacgtaacgtcggtacggccgtacgtaccgaaccgtattaccgttcgttcccttaaccgtactttccccgttaccccggacccttaacgttccttaaccggtaaccttaacccgg

SEQ ID NO: 52747 - DNA, 700 bp, Homo sapiens
  misc_feature: GYAE6OF02I129T.18.11.A11.1.454.CMB.1.raw
  modified_base (127)..(127): a, c, t, g, unknown or other
  misc_feature (127)..(127): n is a, c, g, or t
  modified_base (221)..(221): a, c, t, g, unknown or other
  misc_feature (221)..(221): n is a, c, g, or t
  modified_base (314)..(314): a, c, t, g, unknown or other
  misc_feature (314)..(314): n is a, c, g, or t
  modified_base (453)..(453): a, c, t, g, unknown or other
  misc_feature (453)..(453): n is a, c, g, or t
  modified_base (477)..(477): a, c, t, g, unknown or other
  misc_feature (477)..(477): n is a, c, g, or t
tcagtacgagtatgcacgaccggtgctcgatttagctacgactgcgaggggcagcaagatggtgttgcagacccaggtcttcatttctctgttgctctggatctctggtgccggacgggacatcgtnatcgacccagtcctccagactcccgtggttgtgtctcgtgggcgaggacggccaccatcaacgtcgacaacgtccagccagtagttagtttaanacagcctaccaaacaaataaacaacttactagcgttaggaaccagtacaacgaaaccaggaccaccgtacccctaagtcctactaatttacgnggactaacgtccgtaacccgggcggtcccgggtaccctacggaccgtataccgaggacggaccgacggccggtacgtacgggaactagtacttcgaccttcacccacctataccaaccactgacacgtacgtagtaagngtgacgtactaagttttacacgtnacgaacgtactaaacgttacgtacttacccgttcccttaccgtccttaaccggtacggttcccggggaacggttaaccgggaacggtacggacgggtaacaacgttaaccaaacggttaaccgttgggaaccgtctaccgtacctaacgttcttacgttccggttacttaaccccgtagtttccccgttacccgattaccgttactaccgtaaccttaaccgg

SEQ ID NO: 52748 - DNA, 716 bp, Homo sapiens
  misc_feature: GYAE6OF02G67C5.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagacctccctggttgtgttctcgtgggcgaggagggccaccatcaactgacaacgtccagccaagtagtttagttttatacagtcctaccaaacaaactaacaaacttacttagcttacggtaccaagacaacgaaaccgacggaacacgtacccccgtaacggtcctactactttacgtcgggctacgttaccgtacccggggtacggttccccggggtccctcggaccgtactcgaggacgcgaggccgggtcgagggacagtacttccactacctccacctactaccaacctaccgtcgactacggacgtaagtaagtaaggtggtacgtacgttaagtttttaacttacgttcgttaacagtaaccgtaaagttaccttaggtacctttcctcccgttactaccgtacgggtttcgggacgggaacggtacggtaaggtcggaacgtaagtaacccgaaagtacggtttaacggccggtactccggaaccctaacggttcgttacccgtcttacctttaccgtacgtttaccccgttcccggtacccttactacccgttagaccctttaacg

SEQ ID NO: 52749 - DNA, 581 bp, Homo sapiens
  misc_feature: GYAE6OF02GZNGO.18.11.A11.1.454.CMB.1.raw
  modified_base (285)..(285): a, c, t, g, unknown or other
  misc_feature (285)..(285): n is a, c, g, or t
  modified_base (340)..(340): a, c, t, g, unknown or other
  misc_feature (340)..(340): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgtttatacagctccaacaataacaactacttagcttggtaccagcaagaaaccaggacacgccccctaaggtcctacatttacngggcatcctacccgggagtcccggggtccctgaccgattcagaggcagcgggtcngggacagtatttcactcgtacaccatacaccaactgacgaggctagaaagtgtggtggactaagttttacttacgtgtacacgactaaattactaattacgtcccttcctcctctaccggttcggacggtacgggaaccgtaaggtaggacgtaacgtaaccgtaaacgacgtaggtcgactcgaccaccgtagtcttcgtacttcgtaactcccgttacccgtcctactctacgactacg

SEQ ID NO: 52750 - DNA, 780 bp, Homo sapiens
  misc_feature: GYAE6OF02IJR6Y.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtgccggacggggacatcgtgatgacccagtctccagacctcccgtggttgtgtctcgtgggcgagacgggccaccatcaactgcaagtccagccagtagtttagttttaatacgacgtcctaccaaaactaaaattaaacctaaacttaaccttacgtcgttacggtaccaagaccgaaacgaaaacccgaggaaccgaccggtaacccccgtaaacggtccctacgttacttttaacgtcgggtacctacgttacccggtaaccccgggggtacgggttccccggggttcccctacggtaaccgtaacgttacgaacgggacggacgacgggtccggggttaccgtaggggaacgtacggttactttccgaaccttcctaccaacctactaccaaacccgtactacgtacgaccggtactacggtaagtacgtgggtacggtactttagtttaactttacgtctacgagtaccgtaaattacttaacgttacctttccacccgttcgttaccgtaccgggttacgggcgggtaaaccgggtaacgtagggtaggtaacgtacgaaaccgtaaacgtacggttggtaccgtacgtacgacctaacgtccttaccgtcgttacctttactaccgtttacccgttcccgtacttacgtccttccgtaacgttacg

SEQ ID NO: 52751 - DNA, 717 bp, Homo sapiens
  misc_feature: GYAE6OF02GWKC0.18.11.A11.1.454.CMB.1.raw
  modified_base (653)..(653): a, c, t, g, unknown or other
  misc_feature (653)..(653): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatcgacccagtctccagacctccctggttgtgtctcgtgggcgaggacgggcccaccatcaactgaccaacgtccagaccagtagttagttttacacacgtacctaaccaaactaaactaaacctaacttacttacgtacgttacgaccagacaacgaacgacgaccaccgtaccctacgtctacttacttcggcgactacgtaccggtaccgggtccggtcccgggtacctacggaccgtagtacgagggacgacgtacgggtccggtacggtacggaactacgttactaccgaccttcacctaaccgtacacccgtaaacccgtacggtacgacggtaacggtacgtaaggtaacgtggttaccggtacggttacgtttttaaagttaccgtcgttacggaagtaacctaacgttaacttacgttaaccgtccctttcccgtaaccttcgtaccggacgggttaccggggaacggaaccgggtagtacgggtagacctaaccgaagtaccgaggttgaccgtacncgaacctcgtacttcgtcctcttaccgtcttaccccgtcgtattcggtactacgtacttacggg

SEQ ID NO: 52752 - DNA, 695 bp, Homo sapiens
  misc_feature: GYAE6OF02GLB28.18.11.A11.1.454.CMB.1.raw
  modified_base (209)..(209): a, c, t, g, unknown or other
  misc_feature (209)..(209): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctgttgtgtctctgggcgagagggccaccatcaactgacaagtccagccagagttgttttanacagcctaccaacaataacaactacttagcttgtaccagcaagaaacaggacacgaccccctaaggtcctctatttacgtggacataccgtacccgggagtcccggggtccctgacccgtattcaggagcgaggccgggtcgtgggacagtactttcactcctaccaccctactaccaaccaaccgtgaccgacgggtctaggtaagattcgggtggactttaaggttttaacttacgtcgttaccgaagtaacctaaacgttacttaagttacccggttcccttacccttactacccgttaccgggtttacccgggacggggtaccgggtaaaccggtaaagggttagggaactaacggtaaacccgtaaaaccgggtaacttcggggttacggtactacggacccgtaacccgtattcccgttaggttcccttacgttacccttcccgttaccccgaccgttctacccgtaccgtactaacccg

SEQ ID NO: 52753 - DNA, 783 bp, Homo sapiens
  misc_feature: GYAE6OF02H3XDP.18.11.A11.1.454.CMB.1.raw
  modified_base (223)..(223): a, c, t, g, unknown or other
  misc_feature (223)..(223): n is a, c, g, or t
  modified_base (697)..(697): a, c, t, g, unknown or other
  misc_feature (697)..(697): n is a, c, g, or t
tcagtacgagtatgcacgaccggtgctcgatttagctacgactgcaggggcagcaagatggtgttgcagacccaggtcttcatttctctgttgctctggatctctggtcgccggacggggacatcgtgatcgaccccagtcctccagactcccgtggttgtgtctcgtgggacgaggacggcccaccatcaactgaccaacgtccagccagtagttgttttanacgacgtcctaccaaactaataaccaacttacttagcttacggtaaccacgactaaacgaaaccgacggaccaccggtacccccgttaacggtcctacttacgtttacggcgggacctacgtaccccggtaacccggggacggttcccccggggtaccctaggtaacccgttacgttaccgaacggtaacgggccgtaaccgggtcgggttaccggtacggggaactacggttaaccttttccgaaccttcctaccgaaccctacttacccgaacccctaacgtcgtaccggaaggtcccaaggtaaaccggtgttcggtacggtactttaacggttttactcgtgtacgaacgtactaacttacgttcgtaccgtttccctacgtaccttacggaccggttacgggacggtaaaccggtaacgtacggttaggaaaccttacgaaaccgtaaccgtagtaccggtacgtaccncgtaaccctcgtaacgtttcgtccgttaccttaccgtaccgtttccccgacccgtaccttaccgttacgtaccgtaaccgttaccg

SEQ ID NO: 52754 - DNA, 646 bp, Homo sapiens
  misc_feature: GYAE6OF02FNEOM.18.11.A11.1.454.CMB.1.raw
  modified_base (584)..(584): a, c, t, g, unknown or other
  misc_feature (584)..(584): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagcctaccaaacaataacaacttacttagcttaggtaccagcaagaaaccgaggaccacgaccccctaaggtcctacacttttacgtggccactccgtacccgggaggtcccgggtacctgaacccgattcgaagacggcagggtcgggtcgtagggacagtactttacactcctcaccgtactacaacctacctcgacgacggacttagaagtagtggtaggtacttaagttttattaaccgtgtacgaagtactaaataccttagttaaccgtccctttcctacttcccgaacggtttccgggacggtaacgggaaccgtagggtacgaagtacctaacgaaaccgtacgtcggtgcctagacctacccgtnttaccttacgttacctttacgaccttcccgttaccccgccttactcgtaccgtacttaaccg

SEQ ID NO: 52755 - DNA, 776 bp, Homo sapiens
  misc_feature: GYAE6OF02HI6UA.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtcgccggacggggacatcgtgatgacccagtctccagacctccctggttgtgtctctgggcgaggacgggccaccgatacaacgtgacaacgtccaggccagagttgtttaatacagactaccaaacaataaaccaacttacttagcttaggtaaccagacaacgaaaaccaggaaccacgacccccgtaaacggtccctactaactttacgtgggaccaagttacccgtaccccgggggaaccggttccccggggtaccccttacggacccgtaacgttaccgaagggacggcgacgggtcggggtaccgtaggggaactacggttactttaccgaaccgttctaccctaacccacgttaaccaaaccccgtaacgtccggaactacgggtacctaagggtaacgtaaggttcggtaggtacttaacggtttttaaacgttaacgttacggtaacgaacgtaaccttaaacttaactaacgttactttccccgtccctctaccggtacccggttacggggacgggtaacgggtaaaccggtaggttaacgggacgtaacgtaaccgtaaaacgtaacgtgtacgggtcctagacctaccgtacgttccgttagttaccttaccgtcttacccgtttaccccgcttaacgtttctacggtacctaaccg

SEQ ID NO: 52756 - DNA, 774 bp, Homo sapiens
  misc_feature: GYAE6OF02GY92J.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagacctcctggtgtgtctcgtggcgaggacgggccaccatcaactgacaagtccaggccagtagttgtttttacacgagcctaccaaacaaataacaacttacttagccttaggtaccagacaagaaaccgtagacaccgtaccccctaaggtccctatatttacgtaggcactaccgtacccggggtacggtacccggggttcccctaggtacccgtaactttaccgaaggtaaccggcgtaacgggtccggggtaccggttacgggaaccgtaaggttaccgttttaccaacccgttccgttacccaaacccgtaacttaccccgaaacccgttaaaacccgttgtacccggaaaccggttccgttaaaccggaaagttaacggttcgttaaggtaccctttaaaggttttaccttaacgttaccggtacgtaaactaccgtaaacttaaccgttattaaccgtcccttacctacgtaccgttacggtaccgggacggttaggaaccgtaagggtacgtagaacgtaaccgaaacgactttcgggagtcctaggaccctacgtacgttacctgttaccctttacgtaccttccccgttacccgacgttacgtaccgttaccgaacgtttccg

SEQ ID NO: 52757 - DNA, 844 bp, Homo sapiens
  misc_feature: GYAE6OF02GA237.18.11.A11.1.454.CMB.1.raw
  modified_base (121)..(121): a, c, t, g, unknown or other
  misc_feature (121)..(121): n is a, c, g, or t
tcagtacgagtatgcacgaccggtgctcgatttagctacgactgcaggggcagcaagatggtgttgcagacccaggtcttcatttctctgttgctctggatctctggtgccggacgggacntcgtgatgacccagtctccagacctccgtggttgtgtctcgtgggcgaggaggtcaccatcaactgcaagtccagccagtagttagtttacacagtcctacaaacaactaacaacttacgttagtccgtttaggaccagacgaacgtaaaccgaggaaccaccggtacccccttaaggtcccctacttacgttttacgtacggggtacctaacgttaccccgggttaaccccggggtacggggttacccccgggggttaccccgttaccgggtaacccgtaacggttttacccggaaggggaaccgggtaccggtaacgggggtccgggggtttaccggttaacggggggaaccgtaaaccgggtttaccgtttttaacccgaaaccttttcccgtaaccccggtaacccgttaacccgtaaccctaaaccccggtaaacccgttaccgaacgggtaaccgggtaacgttaaccgggaaaagttaccggttacgggtacgggtttaacttaacgggtttttaccgttaacgtacgggtactaacggtaacctaaatttaaccgtactttacgtcccgttacctacgttaccgtaccgggtacgggaccggtaagggaaccgtagggtacgtaacgtactaacgaaacggtcgttaggtcgaactcgactaccgtcttacgtctattccacgttcccgtctctaccgtctacggtactaaccgg

SEQ ID NO: 52758 - DNA, 673 bp, Homo sapiens
  misc_feature: GYAE6OF02HDYX4.18.11.A11.1.454.CMB.1.raw
  modified_base (293)..(293): a, c, t, g, unknown or other
  misc_feature (293)..(293): n is a, c, g, or t
tcagtacgagtatgcacgaccggtgctcgatttagctacgactgcagggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagttgttttatacagcctaccaaacaaataaaccaactacttagcttggtaccagacaagaaaccaggacacgccccgtaagtcctcattacgnggcactccgtaccgggacggtcccggggtccctgaccgtattccgaggtacggcaggcgggtctcgggactgtactttcactctccaccactaccacctaacgtcgacgtacggtactaggaacgtattcgggtacggtacgttaaagtttttactaccgttgggtaactaacgtacctaaacgtttaaccttaaacgttaacccggtttccccttacccgttaccgtaccgtaacccggggtttcgggaaccgggtaacgggtaacccgtaagggtggtaactaacgtaaccaaacggtaccggtggtaccggtactcggacctacgtacgtccgttacgtccttacaccgttccctacccgcctagtcctagtactac

SEQ ID NO: 52759 - DNA, 775 bp, Homo sapiens
  misc_feature: GYAE6OF02GDM9H.18.11.A11.1.454.CMB.1.raw
  modified_base (297)..(297): a, c, t, g, unknown or other
  misc_feature (297)..(297): n is a, c, g, or t
tcagtacgagtatgcacgaccggtgctcgatttagctacgactgcagggggcagcaagatggtgttgcagacccaggtcttcactttctctgttgctctggatctctggtgccgacggggacatcgtgatgacccagtctccagactccgtggttgtgtctctgggcgagagggccaccatcaactggacaagtccacgccagtagttgttttagacagcctaccaacaaataacaactacttagcttggtaccagcagaaaccaggaccacgaccccctaaggtccctcatttacngggcatcctaccggggacgtccgggtccctgaccgattcgaggacggcacggcgggtcgtacgggactaggtactttcaccttcgtaccacctactaccgaaccgtaacctcgacgtacggccgtaggaaacgtagtacggttcgggacttaaggtttttacttaccgttacgttacgaacggtaacctaaagttaacgttaacgttaccgttaccctttacctttacccgtaccgttaccgggttcccgggaacgggtaccggggtaaaccggtaaagggttacggggtaacgtaaccgttaaacccggtaaaacgtaaaccgggtttacgggttacgggtaacccgttacgggacccgttaaacccgtacgggtttacccgtttaacggttaccccttttaacgttacccgttttaccccgtttacccccgggacccgttaaccttttccggtaacccgttaaccgtttaaccccg

SEQ ID NO: 52760 - DNA, 803 bp, Homo sapiens
  misc_feature: GYAE6OF02JRDRR.18.11.A11.1.454.CMB.1.raw
  modified_base (151)..(151): a, c, t, g, unknown or other
  misc_feature (151)..(151): n is a, c, g, or t
  modified_base (173)..(173): a, c, t, g, unknown or other
  misc_feature (173)..(173): n is a, c, g, or t
  modified_base (207)..(207): a, c, t, g, unknown or other
  misc_feature (207)..(207): n is a, c, g, or t
  modified_base (412)..(412): a, c, t, g, unknown or other
  misc_feature (412)..(412): n is a, c, g, or t
tcagtacgagtatgcacgaccggtgctcgatttagctacgactgcaggggcagcaagatggtgttgcagacccaggtcttcatttctctgttgctctggatctctggtgccggacgggacatcgtgatgacccagtctcagactcctggtntgtctctggcgagaggccaccntacaactgcaagtccagccagtacgttgttttanacgacgcctaccaacaaataaccaacttacttagcttcggtacccaggacaacgaaacctacggacacgaccccctaaggtcctactactttacgcgggactactaccgtacccgggaggttcccgggtacctcgaccgtaactttcgaaggtacggcgtcggtaccgggttccagggtacgaacgtcttttacgaaccctttcnccctaaaccgacgttacccaaaccgtaacccgttcggacccgtaacgggtaccctaggtaaacgttacgttacgggtaacgtaacgtttaaacggtttttaccgttaaacggttcgtacgtaaacgaccgtttaaacgttaccgttacgttaaccgtttacccgttacccttccgttaaaccgttccggttaccggggaacccgggtaaacggttaacccgggtaaagggtttacgggaacctttaacggtaaacccgttaaacgtaaaccggttcgttaacgggtcgtacccgtaaccgttacccgtaagtttcccgttacggttacctttacccggaacttttcccgggttacccaccggttacctacggttaccgtacccttaaccgg

SEQ ID NO: 52761 - DNA, 915 bp, Homo sapiens
  misc_feature: GYAE6OF02I22NG.18.11.A11.1.454.CMB.1.raw
  modified_base (214)..(214): a, c, t, g, unknown or other
  misc_feature (214)..(214): n is a, c, g, or t
tcagtacgagtatgcacgaccggtgctcgatttagctacgactgcaggggcagcaagatggtgttgcagacccaggtcttcatttctctgttgctctggatctctggtgccggacgggacatcgtgatgacccagtctccagacctcctggttgtgtctcgtgggcgagacgggccaccatcaactcgacaagtccagccagtagttgttttanacacgcctaccaacaataacaacttacttagcttcggaccagcaagaaccacggaccaccgacccctaagtcctactactttacgtcgggacctacgtacccggtaccccgggggacggttccccggggggttacccctacggtaccccgtaaggtttaccgaaacggtacggggtaccgtacgggtccggggtttaccggtacggggtaaacgtaacggttaaccttttaccggtaacctttcccgttaacccaacccgtaaccttacccgtaaaccccgtaaaccccgttacggaccccggtaaacggggtacctaacgggaaacggtacgttttacggggtacgggttaaccccgtttaaggtttttaacgttttaaccggtttgggtaacccgttaaagaacccgtttaaaagtttaccgtttaaccgttaacccgtttaccccgtttacccttacccgttaaccggttacccggggttaccggggttacccggggaaacggggttaaacccggtaaggggttacggtaacgttaaaccgttaaccgaaaacggttacgtttcgggaacgggttcctaccggtaccgtaacccgttcgtttacccggtttacggtttccccttaccgtttacggtttacccccgttttaccccggacctttaacccgttttcccggtaacgtaacccgtttaaccgg

SEQ ID NO: 52762 - DNA, 689 bp, Homo sapiens
  misc_feature: GYAE6OF02IY5DB.18.11.A11.1.454.CMB.1.raw
  modified_base (333)..(333): a, c, t, g, unknown or other
  misc_feature (333)..(333): n is a, c, g, or t
  modified_base (684)..(684): a, c, t, g, unknown or other
  misc_feature (684)..(684): n is a, c, g, or t
tcagtacgagtatgcacgaccggtgctcgatttagctacgactgcagggggcagcaagatggtgttgcagacccaggtcttcatttctctgttgctctggatctctggtgccgacggggacatcgtgatcgacccagtctccagactcctggttgtgtctcgtgggcgaggacggccaccatacaactgactacgtccacgaccaggtagtttgttttaactacacgtcctaaccaaacaaactaaacctaaccttaacttacgtccgttacggtaaccagacaacggaaaccgaggaacaccgacccccgtaaggtccctactactttacgnggtcacgtaccgtacccgggcggtcccggggtccctacggaccgtacgttcgaaggtacggcgacgggtccgggttacgtacgggaacacgttacttaccgacttcctacgaaccctatacccaaaccctaaccgtacgacggacggtacgtacggaacgtagttacggtacggttacttacgtttatttaccgtgtacgataacgtaacttacttagttaccgtccttcctacgtcgtaccggttggaaccgggacggtaacgtagggtacgagtactacgtaaacgtacgtcgcgcgtacgactacgtcgttactacgtcttactccgttaccctccgctacgtctacnctacc

SEQ ID NO: 52763 - DNA, 710 bp, Homo sapiens
  misc_feature: GYAE6OF02HJ9Y2.18.11.A11.1.454.CMB.1.raw
  modified_base (220)..(220): a, c, t, g, unknown or other
  misc_feature (220)..(220): n is a, c, g, or t
  modified_base (425)..(425): a, c, t, g, unknown or other
  misc_feature (425)..(425): n is a, c, g, or t
tcagtacgagtatgcacgaccggtgctcgatttagctacgactgcaggggcagcaagatggtgttgcagaccccaggtcttcatttctctgttgctctggatctctggtgccggacgggacatcgtgatgacccagtctccagactcccgtggttgtgtctcgtgggcgaggacgggccaccatcaactcgacaacgtccagccgagtagttgtttttanacagtcctaccaaacaaataaccaaccttaacttacgtcgttacggtacctaacgacgaacgaaaaccgtacggaccaaccgaccccccgttaaggtccctacctaagttttaacgcgggacctacgtacccggtaccccggggtaccggttccccggggtaccctcggacccgtagttcgaggtacggcgacggtccgggtcgngggactaggtacttccactcacaccatccaaccacctgcctaggtctacgaagtgtaggtacgtacgttaagttttacgtaccttgtacgagtactaagtaacttagtaccgtttccctccgttcgacttaccgggtaccgggacgggaacgggtaccgaagggtcgaacgtacgaaaccgtaaccgtaaagtcgggtacgtacctacgaccgtaccgtatccggttaccgttcttaccgtccgttacccttaccccgacgtacgtacctaccggtactacccgg

SEQ ID NO: 52764 - DNA, 718 bp, Homo sapiens
  misc_feature: GYAE6OF02FGRO7.18.11.A11.1.454.CMB.1.raw
  modified_base (432)..(432): a, c, t, g, unknown or other
  misc_feature (432)..(432): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctcgtgggcgaggacgggccaccatacaactgacaacggtccagccagagttagttttatacactaccaacaataacaactacttagtcgttcgtaccagacaacgaaaccacggacaccgtaccccaacggttcctacgtatttacacgggcactaccgtacccgggtcggtcccgggtccctacggaccgtaacgtcgagacgggtcgagggccgggtcgtaggacgtacgtatttccgacgtcctcaaccctactccaaccctaacgtgacncgggtacttaggaagtacgttggtacggttacctagttttacttagtacggttacaacgtaactaattaccgttattaccgttccctaccgttccttacccgggtacggtttccgggacggggtaaccggtaacgtaacggggtacggtaacgtaactaaccggtaaacgtacgttggaccgggttacctacggacctaccgtaccggtttcctcggtttacccttaccgtaacttttccccgtcccggtaccttacggttaccttaccgtattccgttaacccgg

SEQ ID NO: 52765 - DNA, 777 bp, Homo sapiens
  misc_feature: GYAE6OF02GY44Y.18.11.A11.1.454.CMB.1.raw
  modified_base (296)..(296): a, c, t, g, unknown or other
  misc_feature (296)..(296): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctcgtgggcgaggacgggccaccatcaactgcaagtccagccagtagttgttttatacagcctaccaacaataacaactacttagcttggtaccagacagaaaccaggaccacgaccccctaagtcctctagtttacgngggctacgtccgtacccggggacgtcccggggtccctcggaccgtacttcgaggacggcgaggtccgggtcgtacggggactacggtatttaccgacgttcctaccaaccctacgtaccctaaacccgtaaccgttcggtacgacgggtaccgttaggaaacggtagttacgggtagggttaccgtttaacgtttttacgtttaccgttacggtacgtaacggtaacctaacgtttaaaccgttaaccgtttaaccggtttcccctttacccgttaccgttaccgggttaaacccgggtttccgggtaaccggggaaaccggggtacccgttaagggtacggtaaacggtaaccgttaacgtaaaacccggtagtacgggtcgtaccggttaccgaccgtaaccgtcgtttaccgttacgttaccttaccgtaccgtttccccgttcccgtaaccgttaccgttctaacgttacctaccgg

SEQ ID NO: 52766 - DNA, 614 bp, Homo sapiens
  misc_feature: GYAE6OF02ISJXR.18.11.A11.1.454.CMB.1.raw
  modified_base (215)..(215): a, c, t, g, unknown or other
  misc_feature (215)..(215): n is a, c, g, or t
  modified_base (486)..(486): a, c, t, g, unknown or other
  misc_feature (486)..(486): n is a, c, g, or t
tcagtacgagtatgcacgaccggtgctcgatttagctacgactgcaggggcagcaagatggtgttgcagacccaggtcttcatttctctgttgctctggatctctggtgccggacggggacatcgtgatgacccagtctccagacctcctggttgtgtctcgtgggcgaggagggccaccatacaactgacaagtccagccagtagttgttttanacagtcctaccaaacaaataaaccaacttacttagtacttcggtaccagacaacgaaaccgaggaccacgacccccgtaaggtcctactatttacgtgggcactccggtacccggggacggtcccggggtccctcggaccgtattcgaggaggcgaggcgggtcgtgggacagtacttcactcacacactacaaccactgcgaggcgtagaagtcgtggtcggtacttagttttactacgtgtcagtactaatactattacgtcctacctntacgtacggtcggacgggacggacgagggtgaatacgtaacgtaaacgtacgtggacgtctacgactaccgttagtcgttcgttccttacgtaccgttcccgtacctccgttatccgtacgacttacg

SEQ ID NO: 52767 - DNA, 866 bp, Homo sapiens
  misc_feature: GYAE6OF02FW1N0.18.11.A11.1.454.CMB.1.raw
  modified_base (215)..(215): a, c, t, g, unknown or other
  misc_feature (215)..(215): n is a, c, g, or t
tcagtacgagtatgcacgaccggtgctcgatttagctacgactgcaggggcagcaagatggtgttgcagacccaggtcttcatttctctgttgctctggatctcgtggtgccggacgggacatcgtgatgacccagtctccagactccctggttgtgtctgtgggcgagacgggccaccatcaactgacaacgtcagccaggtagttagttttanacagcctaccaaacaataacaacttattagccttaggaccagacaagaaacccagggaccaccgacccccgttaaggtccctactaagtttacgtcgggacctacgttaccccggtaaccccgggggacgggttacccccgggggttaccccgtcggtaacccgtcgtttaccggacggtacgggacgtacggggtccggggttaccggtagggggtaacctacggttaacttttaccgacccgttacccttacccaacctaaccgttacccaaaccccgtaaaccgttcggaccgtaaccgggtacgtaaacgggtaaagttacggtttgggtaccgggtaactttacggggtttttaacttaacggttaggtaaccgttaacgtaaccgttaaacttaaccgttaagtttacccgtttccccgtttacccgttccttaacccggggttaccggttccggggtaacccgggggttaagggttaacccggtaacgggggttaacgggaacgtaaccgttaaaccgtaaaacggtaccggttagggtaccggtacgaccgtaaccgtacccgttaaacgttccgttaccgtcccgttttacgaccgtttccccgtacccgtaccgttaccgtacgttacgtaaccttaaccg

SEQ ID NO: 52768 - DNA, 633 bp, Homo sapiens
  misc_feature: GYAE6OF02HFSVE.18.11.A11.1.454.CMB.1.raw
  modified_base (207)..(207): a, c, t, g, unknown or other
  misc_feature (207)..(207): n is a, c, g, or t
  modified_base (324)..(324): a, c, t, g, unknown or other
  misc_feature (324)..(324): n is a, c, g, or t
tcagtacgagtatgcacgaccggtgctcgatttagctacgactgcagggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttanacagctccgaacaataacaactacttagcttaggtaccaggacagaaaccaggacacgaccccctaaggtcctacatttacgtgggacatacctacccgggagtccggggttacccnggaccgtattccagacggacagtccgggtctagggacctaaggactttacgacttactacaaccataccaaccaactgcacgggtactagaacgtatgtcggactaagttttaacttacgtagtctacgactaactacaagttacgtccttctacgttcaccgttacggacgggaagggtaccctaaagggttacgggaagtaacgtaacgaaaccgtaaaccgtgtacggcctagtaccaccgtacttacgttacgttacttacggtacttcccttaccgtaccgtaactcctacggaacccttaacg

SEQ ID NO: 52769 - DNA, 763 bp, Homo sapiens
  misc_feature: GYAE6OF02H0HFM.18.11.A11.1.454.CMB.1.raw
  modified_base (231)..(231): a, c, t, g, unknown or other
  misc_feature (231)..(231): n is a, c, g, or t
tcagtacgagtatgcacgaccggtgctcgatttagctacgactgcaggggcagcaagatggtgttgcagacccaggtcttcatttctctgttgctctggatctcgtggtgccggacggggacatcgtgatcgacccagtctccagtacctccgtggttgtgtctcgtgggcgaggacgggtccaaccagtacaacgtgaccaacgtccagccgaggtacgtttagttttanacacgtcctaaccgaaacaaataaaccaacttacttacggtccgtttacggaaccagaacgaaacgaaaccgtaggaaccacccggtacccccgtaaaggttccctacgttaacgtttacggcgggtaacctaccgttacccggtaacccgggggaccggtttccccgggggtacccttacggaaccgttactaccggtacggacggtaccgtaggggtccgggtacgtacggggtaacctagttaccttaccgtacttcccgtacaaccgtactacccgaaacccgtacgtcgacgtaacggtctaagggaagtgtcgtacggttacttaagttttactacgtgtacgtacgacttaacgtattacgtaccgttcctcctcgtacgtaccggttagggaaccggtacggaccggtaaaggtggaaccttagtaaacccgtaaacgtacgttggcgacttcggacctacgtctcgttacgtaccttacgacgttcccgttaccagttaaccttaccgtacgtaacgttaccg

SEQ ID NO: 52770 - DNA, 720 bp, Homo sapiens
  misc_feature: GYAE6OF02H9YV7.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtcctcgtggcgagagggccaccatcaactgcaagtccagccagagttagtttttatacagcctaccaaacaaactaacaaaccttaacttagtcttacggtaccagcaacgaaaccaggaacaccgaccccctaaggtccctactatttacgtcgggactactaccgtacccggggacggtcccggggtccctacggaccgtattcgagacggacgacggtcgggtcgtagggactagtactttcgaccttctacctaccgtaactaccaaccctaaccgtcgaccgacgggtctaacggaagtacgttgggtacggtacttaaggtttttaacttaacgttcgttacgaacgtaccgtaaacgttaccttaagttaccgtttccctaccttaccgttaccgtaccgggtttaccgggacgggtaacgggtaaccgtaagggtacggaacgtaactaaccgtaaaacgtacgttaggtacgaccgtcgaccctaaccgtctaccgttcgttaccttaccgtacttacccgttcccggtactacggttcctaggtaccttaaccg

SEQ ID NO: 52771 - DNA, 917 bp, Homo sapiens
  misc_feature: GYAE6OF02JIOIP.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtgccgacgggacatcgtgatgacccagtctccagactccctggttgtgtctcgtgggtcgagacgggccaccatcaactgcaacggtccagccgagtagttgttttacacacgcctaccaaactaaactaacctaacttacgttagtccgttacggtaacccaggtaccaaacggaaaacccgacgggaacctacccggtaccccccgttaaaggtcccctacgttaacgttttaccggcggggtaccttaacgttaccccgggtaaccccgggggtacggtttcccccgggggttaccccttaccgggtaacccgttaacgttaccggtaaggggaccgggtacccggtaccgggtccggggttacccggttacggggggaaccttaacggtttaaccgttttacccggtaaccctttcccgttaaccccggaacccttaccgttaaccccgtaaacccgtaaacccgttaccggacccggtaacgggtaccgttaagggtaacgttacggttacggtacccgggtaacgttttacggttttaaccgttaccgtacgtactacgtaccgtaaatttacgtacgttaccgttacccgttccttaccgttccgtaccgggtaccgggtacgggttaaccggtaccggtaaggtcgggtaactacccggtaacctaaacgggttaccgtacgggtcgtaccgtaccggtacctaaacccgtgttaacccgttcggttaacccctttacggttacccttacccggttccccgtaaccttaccgtttacccggttaccgtaaacccttaaccgg

SEQ ID NO: 52772 - DNA, 857 bp, Homo sapiens
  misc_feature: GYAE6OF02HSFWJ.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtgccgacggggacatcgtgatcgaccctagtctccagactccctggttgtgtctcgtgggcgaggacggccacatcaactgacaagtccagccagtagtttgtttaactacgacgacctaccaaacaaataaacctaacttacttagtcttacggtaaccagcaaacgaaccgaggtacaccgtacccctaagtcctactaagttaccgaggacctagtcccggtaacccggggtacggtccccggggttaccctacggaaccggtacttaccggaaggacggtaccggtacgggtccggggtaccgttaagggggaacctaaggttaccgttttacctaccttaccggtacctaaaccgtaacctacccgtaaaccctaaaccgtcggaaccgtaacgggttcaaacgggaagtacgtagggttaccggtaacgtttaacgttttaacgttacgttacggtaacgtacgaaccgttaaaatttacgttaaaccggttaccgttaccccttacgtttacccgtaaccgggttaccggttaccgggtaacgggtaaaccgggaaccggttaacggggaaacgggtaacctaacgggttaaaccaaacggggttaacccgttagttacccgggacgttaccggaaaccccttacgtacccgttaccgtttacggtaacccctttacggtaacccttttacccgggttaccccctaccgtttacctaccggttaccgaacccctttaacccgg

SEQ ID NO: 52773 - DNA, 703 bp, Homo sapiens
  misc_feature: GYAE6OF02JLI1B.18.11.A11.1.454.CMB.1.raw
  modified_base (197)..(197): a, c, t, g, unknown or other
  misc_feature (197)..(197): n is a, c, g, or t
  modified_base (209)..(209): a, c, t, g, unknown or other
  misc_feature (209)..(209): n is a, c, g, or t
  modified_base (220)..(220): a, c, t, g, unknown or other
  misc_feature (220)..(220): n is a, c, g, or t
tcagtacgagtatgcacgaccggtgctcgatttagctacgactgcagggcagcaagatgtgttgcagacccaggtcttcatttctctgttgctctggatctctggttgccgacggggacatcgtgatgacccagtctcagactccctggttgtgtctcgtggcgagaggccaccatcaactgcaacgtccagccagngttgtttacacngtctaccaaanaataacgaacttctagcttacggaacctagacacgaaaccgaggactacggacccctaaggtcctacgtacgttactcgggactacgtaccgtaccgggtacggtcccggggtaccctacgtacccgtacgttaccgtagacgggtcgacggtaccgggtcgtacgggacgtagtactttccaacttcgtaccgacctacaccgaacctaaccgtcgtacgacgtacgtacgtaagtcgttagacgggtccttaggtttacgttaccgtagtaccgacgtacaacgttacgtaacgttaccgttcctacccgttactccgtttaccggtccggacgggtaaacggtacccgtaacggtacggaaccggtacgtaacccgtaaagtccggtacgtcgtaccgttacggccctaaccggtcgttaccgcgtttccgtacgtaacccgtttcgaccccgtctacgtccgttacgtaagttaacccg

SEQ ID NO: 52774 - DNA, 677 bp, Homo sapiens
  misc_feature: GYAE6OF02IBEJ7.18.11.A11.1.454.CMB.1.raw
  modified_base (224)..(224): a, c, t, g, unknown or other
  misc_feature (224)..(224): n is a, c, g, or t
  modified_base (319)..(319): a, c, t, g, unknown or other
  misc_feature (319)..(319): n is a, c, g, or t
  modified_base (594)..(594): a, c, t, g, unknown or other
  misc_feature (594)..(594): n is a, c, g, or t
  modified_base (611)..(611): a, c, t, g, unknown or other
  misc_feature (611)..(611): n is a, c, g, or t
  modified_base (623)..(623): a, c, t, g, unknown or other
  misc_feature (623)..(623): n is a, c, g, or t
  modified_base (668)..(668): a, c, t, g, unknown or other
  misc_feature (668)..(668): n is a, c, g, or t
tcagtacgagtatgcacgaccggtgctcgatttagctacgactgcagggcagcaagatggtgttgcagacccaggtcttcatttctctgttgctctggatctctggtgccggacggggacatcgtgatcgacccagtcctccagacctcccgtggttgtgtctcgtgggcgaggacgggcccaaccatacaactgacaacgtccagccaagtgttagttttaanacgacgtcctacaaactaaataaaccaacttaacttagctttacggaccagacaacgaaacgagacaccgacccctaagtcctatacgtttacgngggactacgtacccgtaccgggtacggtccccgggtacctaggaccgtattaccgaaggtacggtacgacgggtccggttacgacggggacttaaggtacctttctaaccgtcctacgaaccctattacccaaccgtaaacccgtgaccgaacggtcgtaacgaagtcggtacgtcggttaactaacgtttttaactcgtagttaccgaaactactaattaactacgttaccgtccttaacgtctacggtacgtccgggaggtacgaccgaggtnaacgtacaagaacgtanggtacgtcgacncgtactgttactcgtccttacgccttaccgtccgtactacgttancctagtaac

SEQ ID NO: 52775 - DNA, 733 bp, Homo sapiens
  misc_feature: GYAE6OF02HUPC5.18.11.A11.1.454.CMB.1.raw
  modified_base (223)..(223): a, c, t, g, unknown or other
  misc_feature (223)..(223): n is a, c, g, or t
tcagtacgagtatgcacgaccggtgctcgatttagctacgactgcaggggcagcaagatggtgttgcagacccaggtcttcatttctctgttgctctggatctctggtgccggacggggacatcgtgatcgacccagtcctccagaccttccctggttgtgtctcgtggggacgaggacgggcccaaccatacaactgacaagtccagccagtagttgtttanacagctaccaaacaaataaactaactattagacttacggaccagcaaacgaaaccaggtacacgaccccgtaagtcctatacttacgtggactacgtaccgtaccgggtacggttccccgggtcctcgaccgtactacgaacgggacggtccaagggtccgggtcggtacggggtaactacggttaacttccgtaacctcctacctaacgtaacctccgaaacccctacgtacgacgacgggtaccgaagtaacgtacgttcggtacgtacgttttaaaggttttaccttaacgtacgttacgaacgtaacctaaattaaccgtaagttacccgtttccctaccgttaccttaacggtacccgggtaccgggtaacgggaaacgggtaaacctaggggtaacgaacgtaactaaccggaaaacgtcgtaggcgtacctacggacctacgtaacttccgtacttcccttacgacctttcccgccgtacctactagtaacgtacctaaaccg

SEQ ID NO: 52776 - DNA, 737 bp, Homo sapiens
  misc_feature: GYAE6OF02H3KAU.18.11.A11.1.454.CMB.1.raw
  modified_base (487)..(487): a, c, t, g, unknown or other
  misc_feature (487)..(487): n is a, c, g, or t
  modified_base (655)..(655): a, c, t, g, unknown or other
  misc_feature (655)..(655): n is a, c, g, or t
  modified_base (691)..(691): a, c, t, g, unknown or other
  misc_feature (691)..(691): n is a, c, g, or t
tcagtacgagtatgcacgaccggtgctcgatttagctacgactgcaggggcagcaagatggtgttgcagacccaggtcttcatttctctgttgctctggagtctctggtgaccgacggggacatcgtgatgacctagtctccagcctcctggttgtgctgtggcgagaggccaccatcaactgacaacgtccaggacctaagacgtttacgtttttaataacgagccttaaccgaaactaaaactaaactaaaccgttacttaacggtcttacgggtaaccaacgacgaaacgaaaaccgagggaaccaaccgaccccccgtaaaggtccttaacttacttaacgtcgggcctaagtcccggtaacccggggtaggttaccccggggttcccacggtaccggtacttaccggaagacgggaactacgggtcggtacggtacggacgtatactacgtcctacgtaccactaccaacgaccactacganacgtcaacgtagacgttcgtcgtacgtttagtttacgtaacgttcaacggtataacctaaagtactagttaacctccttaccgtactacggttaccggtacgggtacggtaaccggaacggtagggtacgaacggttaacttaaacggaaactcggtacgtcgaacgngaaccctagtaaccttcgttaccgttacccttaacnccggtttacacccggtaactcgtaaccgtttacgaccctttaacgg

SEQ ID NO: 52777 - DNA, 587 bp, Homo sapiens
  misc_feature: GYAE6OF02FLVHC.18.11.A11.1.454.CMB.1.raw
  modified_base (211)..(211): a, c, t, g, unknown or other
  misc_feature (211)..(211): n is a, c, g, or t
  modified_base (301)..(301): a, c, t, g, unknown or other
  misc_feature (301)..(301): n is a, c, g, or t
  modified_base (543)..(543): a, c, t, g, unknown or other
  misc_feature (543)..(543): n is a, c, g, or t
  modified_base (552)..(552): a, c, t, g, unknown or other
  misc_feature (552)..(552): n is a, c, g, or t
tcagtacgagtatgcacgaccggtgctcgatttagctacgactgcagggggcagcaagatggtgttgcagacccaggtcttcatttctctgttgctccggatctctggtgccgacggggacatcgtgatgacccagtctccagactccctggttgtgtctctgggcgagagggccaccatcaactgcaagtccagccagtagttgttttanacagcctaccaaacaataaaccaacttacttagcgttacggtaccagacaagaaaccaggacacgccccctaaggtcctactatttacgngggcatccgtacccggggcggtcccggggtccctcggaccgtattaccgaggacggcgaggcgggtctggggacagtacttcactctcaccataccacctactgacgacgctagaatagtggtaggctagtttactagtcgtacgacgtactaatactatcgttcctctctcgtacgtcggacgggacggaccgaggtcggagactacgaaacgtacgtgtggctgacctacacgtctcgtntaccccctnttcccgtaccgcctactcgtacgtactacgtaccg

SEQ ID NO: 52778 - DNA, 742 bp, Homo sapiens
  misc_feature: GYAE6OF02IR9UR.18.11.A11.1.454.CMB.1.raw
  modified_base (162)..(162): a, c, t, g, unknown or other
  misc_feature (162)..(162): n is a, c, g, or t
  modified_base (215)..(215): a, c, t, g, unknown or other
  misc_feature (215)..(215): n is a, c, g, or t
  modified_base (272)..(272): a, c, t, g, unknown or other
  misc_feature (272)..(272): n is a, c, g, or t
  modified_base (379)..(379): a, c, t, g, unknown or other
  misc_feature (379)..(379): n is a, c, g, or t
  modified_base (416)..(416): a, c, t, g, unknown or other
  misc_feature (416)..(416): n is a, c, g, or t
  modified_base (443)..(443): a, c, t, g, unknown or other
  misc_feature (443)..(443): n is a, c, g, or t
tcagtacgagtatgcacgaccggtgctcgatttagctacgactgcagggcagcaagatggtgttgcagacccaggtcttcatttctctgttgctctggatctctggtcgccggacgggactcgttcgtgactcgaaccctgtctacagtcctcccgtggttntgtctcgtgggcgagcggccactatacaactgacagtccagcctagtagtttntttacacacgtacctaccaaactaagtaacctaacttacgtacgtcgttcgtaaccngtaccaacgaaccgacgtaacctaccgtaccccgtaaggtccttacgtacgtttacggtggacctacgttaccggtacccggggtcggttcccgggactcggtaccngttccgaagtccgaggtacggcggttcgacggtactntacgtttcaacgtcgttacgaccttanccctaacgaaccgttgacgtacggcgttaagtaacggtcgtttcggacgttaccgttacgtttacgttacgtacgttacgaacgtacttaacgtacgttaccgttaccgtttccgtacgtttacggtaaccgttcgggttaccggtaacggtaaccggttacgtagggtacgtacggtaacttaccgttaaacgtacggttccgtagggtccttacggaccttacggccgtactttacgggtccttttccggtaccgtttaccgtaccgttccgaacgtttccgtaccgttagttaccg

SEQ ID NO: 52779 - DNA, 1051 bp, Homo sapiens
  misc_feature: GYAE6OF02F7P1K.18.11.A11.1.454.CMB.1.raw
tcagtacgagtatgcacgaccggtgctcgatttagctacgactgcaggggcaggcaagatcggtgttgcagaacccagggtcttctatttcttcgtgttgcgtctggatactctggtgccgacgggacatcggtgtagtcgacccagtcctccgacgtacctcccgttgggttcgttcgtttaccgtcggttggggaccgtaaggacggggtcccaaccgtattaccaaaccgttgggaccgaaacggttcccgaacggggacccgtaagggttacggtttcgttttttaacgaccgagggtacccttacccctaaaacgtaaaccgttaaacctaaccgtttaaccgttttacggtaccgttttacgggtacccctaaggtaccgaaaccgtaaaacccgaacggtaaccaaccggtacccccgttaaacggttaccccttacggtaacttttaaccggtcggggacctaacggtttaccccgggtaaccccgggggaacggtttccccggggggttccccctacgggtaacccggtacgttaccggaacggtacgggcggtaacgggtccgggttacgtacggggtaacctaggtttacctttacaccgtttaccgtaccgtaaaccggttactacccggtaaaccgtaaaccgtcggtacgtaacgggttacgtaacggtaaacgttcggtttacggggttaaccggttaccgtttaaagtttttacccgttaccgttaaccggtttaccaaacgggtaaccttaaaaccggttaaccttttaacgttaaccccggtttaccctttaacccggtttaccttaaccggtttacccggggttacccgggtaccggggtaaacgggtaaacccggtaaggggttaacggaaccggttaaacccgttaaacgtaaaaccggtacggttaacgggtacgggtaccgtacgggtaaccacccgggtttaactttccgttaacgtttcgtttaccgttacgtttaccccggtacccggttaaccgttaggtttcccgtaagtaccgtttaaccgg

SEQ ID NO: 52780 - DNA, 634 bp, Homo sapiens
  misc_feature: GYAE6OF02HVC7S.18.11.A11.1.454.CMB.1.raw
  modified_base (213)..(213): a, c, t, g, unknown or other
  misc_feature (213)..(213): n is a, c, g, or t
  modified_base (295)..(295): a, c, t, g, unknown or other
  misc_feature (295)..(295): n is a, c, g, or t
  modified_base (412)..(412): a, c, t, g, unknown or other
  misc_feature (412)..(412): n is a, c, g, or t
  modified_base (416)..(416): a, c, t, g, unknown or other
  misc_feature (416)..(416): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctcagacctccctggttgtgtctcgtgggcgaggagggccaccatacaactgacaagtccagccagagttgttttanacacgctaccaaacaataaccaactacttagcttaggtaccagacaagaaccagacaccgacccctagtcctctatttacgngggctacgtccgtacccggggacggttccccggggtaccctcggaccgtattcgaggacggcaggtccggtcgtagggacagtacttcactctcacactcaccactgcgagctaganatgngtactagtttatacgtgtacacgataactactatacgttccctacgttcctcgtaccgggttacgggacggtaacgggtaaccggtaggtacggaaggtactaaccgaaacggtactcggttaggaccttaccgaccaacccttacgtaccgttccggttaccttccgttacctccccgttaccccggtacctacgttaccctaccggtactaaccgg

SEQ ID NO: 52781 - DNA, 698 bp, Homo sapiens
  misc_feature: GYAE6OF02IE0LU.18.11.A11.1.454.CMB.1.raw
  modified_base (216)..(216): a, c, t, g, unknown or other
  misc_feature (216)..(216): n is a, c, g, or t
  modified_base (230)..(230): a, c, t, g, unknown or other
  misc_feature (230)..(230): n is a, c, g, or t
tcagtacgagtatgcacgaccggtgctcgatttagctacgactgcaggggcagcaagatggtgttacagacccaggtcttcatttcctctgttgctctggatctctggtgccggacggggacatcgtgatgacccagtctccagactccctggttgtgtctcgtgggcgagacgggccaccatcaactgacaacgtccagccagagttagttttanacagacctaccaanaataacaactacttagcttaggtaccagacaagaaaccgaggaacacgacccccgtaaggtcctactatttacgtgggactacgtaccgtacccgggacggttcccggggtaccctacggaccgtacttacgaggtacggcgacggtacgggtacgtaggggactagtacttacctactactaccaacctataccaaccaactcgaccgaaggactaggaagtacgtaggtacgtcgttaaagttttactacgtagtcaacgtactaaacgttactaagttaccgtacccttaccgtacttaccgtacggttccggacgggtaacgggtaccgaaagggtcgaacgtaacgtaaccgaaacgtacgtacggtcggtacgacgtacctactacgtacgttacgttccttaccgttaccttcccgttacccgaccgtaacgttaccgaacgttaccttaaccgttaccgg

SEQ ID NO: 52782 - DNA, 678 bp, Homo sapiens
  misc_feature: GYAE6OF02IMDYR.18.11.A11.1.454.CMB.1.raw
  modified_base (457)..(457): a, c, t, g, unknown or other
  misc_feature (457)..(457): n is a, c, g, or t
tcagtacgagtatgcacgaccggtgctcgatttagctacgactgcaggggcagcaagatggtgttgcagacccaggtcttcatttctctgttgctctggatctctggtcgccggacggggacatcgtgatgacccagtctccagacctccctggttgtgtctcgtgggcgagacgggccaccatacaactgacaacgtccagccagtagttagtttttaatacagtcctaccaaaacaaactaaaccaaacttaacttaagtacgttacggtaaccagacaacgaaaaccaggaaccaccgacccctaaggtcctactaacgtttacgtgggactactccgtaacccgggacggttcccgggggtacctacggaccgtattccgaaggacggacgaggtccgggtacgtgggacagtatttcgactctcacatcaaccactgacagctagagatcgngtacttagtttaactactgtacaagtactaaattactaacgtacgtcccttcgttacctacgtaccgggttaccgggacgggtaacgggtaaaccgtaagggtaggtaacgtaaactaaccgaaaaacggtactggtaacgggaccttacggacctacctaagttccgtgttaccttacgaactttcccgtacccggactaacgttcacggtaaccttacg

SEQ ID NO: 52783 - DNA, 677 bp, Homo sapiens
  misc_feature: GYAE6OF02HF2AD.18.11.A11.1.454.CMB.1.raw
  modified_base (212)..(212): a, c, t, g, unknown or other
  misc_feature (212)..(212): n is a, c, g, or t
  modified_base (308)..(308): a, c, t, g, unknown or other
  misc_feature (308)..(308): n is a, c, g, or t
  modified_base (625)..(625): a, c, t, g, unknown or other
  misc_feature (625)..(625): n is a, c, g, or t
  modified_base (659)..(659): a, c, t, g, unknown or other
  misc_feature (659)..(659): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctcgtgggcgagagggccaccatcaactgcaagtccagccagtagttgtttttanacagcctaccaaacaaataaacaacttacttagtcttggtaaccagacaagaaaaccaggtaccacggaccccctaaggtccctactactttacgngggactacgtcccgtaacccggggacgttccccggggtccctaggaccgtattcgaggacggctaggccggggtactggggaactagtactttaccacgttctaccgaaccacttcccgaaacctaaccgtgaccgtacggtaccgttaggaacgtacgtgggttaccggactttaaacggttttacttacgtgtacaacgtactaaactcttaactcgttcccttaccgttctacgtaccggttcgggacggtacggacccgtaagggtacgaaggtaactacgaaacgtagtcggtacgtctacggactaccgtnttacgtcgttaccttcgtacttcccgtacccgtntaccgtctacgactaccg

SEQ ID NO: 52784 - DNA, 811 bp, Homo sapiens
  misc_feature: GYAE6OF02GTAK7.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgacaagtccagccagagttgttttatacagcctaccaaacaataacaactacttagcttaggtaccagcaagaaaccaggacacgccccctaaggtcctacatttacgcgggacagtaccgtacccggggacggtcccggggtaccccgacggtaaccgtacttacggacggacggacgacgggtccgggttacggtacgggacgtaagttacgttacctaccgttacctacctaaccgtactacccaaaccccgtaccgtacgacggacggtccgtaaggaacgtacggttaggttcggaaccgttttaagttttacgttaccgttggtaaccgaacggtaacttaaaccttaacgtttaaccgttacccggtttacccctttaccgtacccgtttaccggtacccggggtttacccgggaacgggggttaacccgggaaccggttaacgggggtaacgtaaccgttaacggtaaacccgttaaaacggtaccggtacggttaccggtacccgtacgaaccctaccggttacttacgggtttaccttaacccgttacccttaacccggtttcccccttacccggtaacccttaccgtttacgaacccggttacctttaaaccccgg

SEQ ID NO: 52785 - DNA, 599 bp, Homo sapiens
  misc_feature: GYAE6OF02F7HOA.18.11.A11.1.454.CMB.1.raw
  modified_base (210)..(210): a, c, t, g, unknown or other
  misc_feature (210)..(210): n is a, c, g, or t
  modified_base (402)..(402): a, c, t, g, unknown or other
  misc_feature (402)..(402): n is a, c, g, or t
  modified_base (450)..(450): a, c, t, g, unknown or other
  misc_feature (450)..(450): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagacgggccaccatcaactgcaagtccagccagagttgttttanacagctaccaacaataacaactacttagcttgtaccagcaagaaaccaggaccacgccccctaaaggtcctacactttacgtgggcatcgtacccggggagtcccggggtccctgacccgtattcgagacggcaggccgggtcgtagggacagtattcactctacaccatcaaccaactgacagctagaagntgtgctagtttatacgtgtcagtactaatactattacgtccttacctntaccgtacgttcgggcggaacgggaaccgaagggtacggagtaacgtaccgaaaaggtacgtggacggtctcgaccaaccgtagtccgttacggttacctttcgtaaccgttcccgttacccgtacctattacccgtaccgacttaacg

SEQ ID NO: 52786 - DNA, 706 bp, Homo sapiens
  misc_feature: GYAE6OF02FZO0I.18.11.A11.1.454.CMB.1.raw
  modified_base (526)..(526): a, c, t, g, unknown or other
  misc_feature (526)..(526): n is a, c, g, or t
  modified_base (647)..(647): a, c, t, g, unknown or other
  misc_feature (647)..(647): n is a, c, g, or t
  modified_base (687)..(687): a, c, t, g, unknown or other
  misc_feature (687)..(687): n is a, c, g, or t
tcagtacgagtatgcacgaccggtgctcgatttagctacgactgcaggggcagcaagatggtgttgcagacccaggtcttcatttctctgttgctctggatctctggtgccggacggggacatcgtgatgacccagtcctccagacctccctggttgtgtctcgtgggcgagagggccaccatccaactgacaacgtccagaccagtagttgttttacacagacctaccaaacaaactaaactaaccttaacttacgtcctttacggtaacccagaccaacgaaacccaggaaccaccggaccccccttaaggtccctactaacttttacgtcgggactacgtacccgtaccccgggggtacggttccccggggtcccctacggtaacccgtagttacaacggtaggaccgaggtccggggttatccggggtaactacggtactttacctaccgtcctacccgaacctacctaccaaaccctaaccgtagtacgacgggtacgtaaggaagtacgtggtaaccgtntttaagtttacttacgtacgttacgacgtactaaacgtcttaacgttacgtacccttcctccgtcgtaacggtcgggtacggacggtacacggtgagtactaaccgaaagtacgtgtacgntacgactacctatccgtcgttactacgtcctcctacccgntactaccgtagtactaccc

SEQ ID NO: 52787 - DNA, 851 bp, Homo sapiens
  misc_feature: GYAE6OF02G7SXS.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtgccggacggggacatcgtgatcgacccagtcctccagactcccgtggttgtgtctcgtgggacgaggacgggccaccataccaactgacctaacgtccagccgaaggtagttagttttacacgacgtacctaccaaacaaactaacctaacttacttagtcttacggtaaccacgaccaacgaaaccgaggaccaaccgtacccccgtaaggtcctactacgtttaaccggcgggacctacgtacccggtaacccggggtaccggttccccggggtaccctacggtaacccgtagttaccggaaggtaccgggacgtacggggtccgggtaccggtacggggaactacggttaactttaccgaccgttccgtaccaacccgtaacgtacccgtaaacccgtaccgtacggaccgtaacgggtctaaacggtaggtacgttacgggtacgttaaccgtttaacgttttaacgtacccggttacgttacgaaacgttaaccttaaagttacccttaacggtttcccctacccgttacccgtttacgccgggtttaaccgggttaccgggacggggtaaccggtaaaccggtagggtaccggtaactaaccggttaaaccaaaccggtttagtaccgggtacggttcccacggtaaccttaccgtcgtttaccggttaccgtaccctttaccgtaccgtttaccccgacccgttactaacgtcccggttaagtaccccttaacggg

SEQ ID NO: 52788 - DNA, 725 bp, Homo sapiens
  misc_feature: GYAE6OF02ICT62.18.11.A11.1.454.CMB.1.raw
  modified_base (215)..(215): a, c, t, g, unknown or other
  misc_feature (215)..(215): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctcgtgggcgagacgggccaccatcaactgacaacgtccagccagagtttgttttaanacagtcctaccaaacaaataaaccaactacttagcttcggtaccagcaacgaaaccaggacacgtaccccgtaaggtcctactactttacgtcgggactagtcccggtaacccggggtaggttccccggggtaccctaggaccgtattacgaacggacggcgacgggtccgggttacggtacgggaactacggttactttccctactccgtaccaaccgtactacccaaccgtaacccgtcgaccgtacggtaccgtaaggaacgtagttacggtacggtaaccgtttaagttttacttacgttgtacgaacgtaactaaacttacgttaacttacgttcccttaccgttcctaccgtaccgggttacgggacgggtaaccggaaccgtaaggtcggaatacgtaaaccgaacggtacgtagtacggcgtcgtaacctcgtaacggtcttacggtccttacgtaccgttacccgttacccgaccttacgttcgtaccggtacttaaccgg

SEQ ID NO: 52789 - DNA, 766 bp, Homo sapiens
  misc_feature: GYAE6OF02F1R6A.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtgccggacggggacatcgtgatcgacccagtcctccagacctccctggttgtgtctcgtgggcgaggacggcccaccatcaactgacaagtccagccagtagttgtttactacagcctaccaaacaaactaacaacttacttagtccgttacggtaccagacaacgaaaccaggaccaccgacccctaaggtcctactatttacgtaggctacttaccggtaccccggggtacgggtccccggggtcccctacggtaccgtatttaccggaaggacggtaccgagggccgggttcgtacgggtaacctacgtacgtttacccacgtttcctccgaacctaactacccgaaacctaaacccgtcggacccgtaaccgggtacgttacgggaaacgttacgtgggttaacccggggtacttttaaacgggtttttaacttacggttaccgtacgtaaccgtaaccgttaaacgttaaccgtttaacgttacccgtttccctttacccgtaccttaccgggttacggtacgggtaccgggaacggtaccggtaggtacgagtaacgtaacgtaaacgtacgttagtcggacgtacgacctaccgtacttaccgttcttaacctcctacgttccctacccgtcttacgtcctacgtacctacg

SEQ ID NO: 52790 - DNA, 541 bp, Homo sapiens
  misc_feature: GYAE6OF02FYPOY.18.11.A11.1.454.CMB.1.raw
  modified_base (288)..(288): a, c, t, g, unknown or other
  misc_feature (288)..(288): n is a, c, g, or t
  modified_base (336)..(336): a, c, t, g, unknown or other
  misc_feature (336)..(336): n is a, c, g, or t
  modified_base (344)..(344): a, c, t, g, unknown or other
  misc_feature (344)..(344): n is a, c, g, or t
  modified_base (379)..(379): a, c, t, g, unknown or other
  misc_feature (379)..(379): n is a, c, g, or t
  modified_base (400)..(400): a, c, t, g, unknown or other
  misc_feature (400)..(400): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagttgtttatacagctaccaacaataacaactacttagcttggtaccagcacgaaaccaggaccacgccccctaaggtcctacatttacnggcatctacccgggagtccgggtcctgaccgattcagaggcagcggtntggacagntttcactctacaccatcaccacctgcagctagaanagtgtgtctagtttatacgtntcagtacaagtactattgtccctctctctcgttcggcggacggacgaggtgagacgtaccgaaacgacttggtacgtcgtacgacaccgtatccgtattccttatactcccgttaccctccgtacttcctagtacctaacg

SEQ ID NO: 52791 - DNA, 751 bp, Homo sapiens
  misc_feature: GYAE6OF02HAQLW.18.11.A11.1.454.CMB.1.raw
  modified_base (206)..(206): a, c, t, g, unknown or other
  misc_feature (206)..(206): n is a, c, g, or t
  modified_base (212)..(212): a, c, t, g, unknown or other
  misc_feature (212)..(212): n is a, c, g, or t
  modified_base (250)..(250): a, c, t, g, unknown or other
  misc_feature (250)..(250): n is a, c, g, or t
  modified_base (297)..(297): a, c, t, g, unknown or other
  misc_feature (297)..(297): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctcgtgggcgaggacgggccaccatcaactgcaagtccagccagagttnttttanacacgctaccaacaataacactactagtcttgtaccanacaagaaaccgaggaccacgaccccctaaggtccctactactttcgnggtacacgtaccgtacccgggtacggtccccgggtccctcgaccgtattacgaggtacggacgacggtccgggtcgtacgggaacacggttactttacgaccttcgtaccctaacctacgtaccctaacccgaaacccttcggaccggtaacggaccgttaagaacggttacgtacgggtcgtaacgtttaacgttttactttacgttagtaactacgtactaaacttaaccgttagttaccgttccccttaccttaccgtaccggttaaccgggtttcgggacggggtaaccgggtaaccgggtaagggtaggtaaacgtacgttaaaccgaaaccgttaacggttacggtacgtacggtccgtaaccgaaccgttcgtccttaggttcccttaccgtacccttttcccgtaccccgttaccgttacctttccggtaactacccgtttaaccg

SEQ ID NO: 52792 - DNA, 675 bp, Homo sapiens
  misc_feature: GYAE6OF02GM9Y1.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgacaagtccagccagagtgttttatacagctaccaaacaataacaactacttagcttgaccagcagaaaccaggacagaccccctaaaggtcctactactttacgtgggacactaccgtacccggggaggtcccgggtaccctgaccgacttcaacggaggcgaggtccgggtacgtgggactagtattccgactcctaccaaccgataccacccaacgtgacaggctagaagtacgtggtacgactaagtttacttactgtacacgaactaatactaagttactccctacctcgtaccgtacggtttccggacgggtaacgggtaaccgtaagggttacgggaacgtagttaaacccgaaaaccggtaacttacggggtacgtaccgtacgaaccgtaacccgtaattacccgttacgtttaccctttccttaaaccgttcccgtttaccccggtaaccttaacgtttaccgaccggttaaacctaaccg

SEQ ID NO: 52793 - DNA, 739 bp, Homo sapiens
  misc_feature: GYAE6OF02HGFXN.18.11.A11.1.454.CMB.1.raw
  modified_base (207)..(207): a, c, t, g, unknown or other
  misc_feature (207)..(207): n is a, c, g, or t
  modified_base (210)..(210): a, c, t, g, unknown or other
  misc_feature (210)..(210): n is a, c, g, or t
  modified_base (216)..(216): a, c, t, g, unknown or other
  misc_feature (216)..(216): n is a, c, g, or t
  modified_base (219)..(219): a, c, t, g, unknown or other
  misc_feature (219)..(219): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatcgacccagtctccagactccgtggttgtgtctcgtgggcgaggacgggccaccagtacaactgacaacgtccagccagngtnttttanacncgctacaacaataacaactactagcttaggtaccagcaacgaaaccaggaccacgtaccccctaaggtccctactaatttacggtcggaccaacgttaccccggtacccggggacgttaccccggggtccctacggtaacccgtattccgaagggtacggtccgagggtccgggttacgacggggaactacggttatttacccgactttccactaaccacgtaccaaccctaacgtcgacgtacggcgtacgaaggacgttcggtacgtacgtttaaggtttaacttacgtacgttaaccgaacgtataaacttacgtaacgtttaccgtacctttacccgtacgttaccgtaaccgggtttaccgggaacgggtaaccgggtaaccgttaagggtacggtaactaacgtaaacgtaaaccggtacgtaggtccgtaccgtacgaccaacccgtttagtccttacgttacctacgtaccgtttcccgtacccgactacgtaccgtaccggtaacttaccg

SEQ ID NO: 52794 - DNA, 757 bp, Homo sapiens
  misc_feature: GYAE6OF02IX5T8.18.11.A11.1.454.CMB.1.raw
  modified_base (216)..(216): a, c, t, g, unknown or other
  misc_feature (216)..(216): n is a, c, g, or t
  modified_base (329)..(329): a, c, t, g, unknown or other
  misc_feature (329)..(329): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatcgacccagtctacagactccctggttgtgtctcgtggcgaggacggccacatcaaatgacaacgtccagccaagtagttcgttttaanacagtacctaccaaacaaattaaccaacttacttagtcgtttaggaacccagacctaaacgaaaccgaggtaaccaacgtacccccctaaaggtccctagtaacgtttaacgnggtactaacgtaccggtaacccggggtacgtccccggggtccctaggacctagttaccgaaggacggccgtaacggtccgggtacgtagggacctagtacgtttacacgttccacgtaccgtatacccgaaccgtaaccgtcgacgtaggaccgtagtaaacgtcggttacgtacggtaacctttaaaggtttacgttacgtcgtaacgtaacgtaaacgttaactacggttaactaaccggttccctaaccgttccgtaacgtacgggtaccggacgggtaacggaacgttaggtacgaagtaactaacccgaaagtacgtcggtaacgtaccaccgtaactacccggtagttacctacgggtttacctccgtaccgtttacccccgtacggtacccttaacgttacgtaccggtaacttaacccgg

SEQ ID NO: 52795 - DNA, 591 bp, Homo sapiens
  misc_feature: GYAE6OF02FSLIZ.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagttgttttaatacagctaccaacaataacaactacttagcttggtaccagcagaaaccaggacacgccccctaaggtcctcatttacgtggcatccgtacccgggagtcccggggtcctgaccgattcaggagcaggcgggtctgggacagtacttcactctcacactacaccacctgcagctagagatgtggctagtttatacgtgtcagacaatactatacgtccctactctcgtacgtcgggacggtaggaccgtaaggtagaagtacgtaaccgaaacggtacgttacggtggaccgttacgaccgtaacctgttaccgttcgttaccctttaccgtaccgtttccccgttaccccgtaccttacgtaccgttacgtaaccttaaccg

SEQ ID NO: 52796 - DNA, 802 bp, Homo sapiens
  misc_feature: GYAE6OF02G1SPE.18.11.A11.1.454.CMB.1.raw
  modified_base (228)..(228): a, c, t, g, unknown or other
  misc_feature (228)..(228): n is a, c, g, or t
tcagtacgagtatgcacgaccggtgctcgatttagctacgactgcaggggcagcaagatggtgttgcagacccaggtcttcatttctctgttgctctggatctctggtcgccggacgggacatcgtgatcgacccagtcctccacgtacctcccgtggttgtcgtctcgtgggcgaggacgggcccaccataccaagtcgacaacgtccacgccagtagttgttttanacgagtcctaccaaacaactaacaacctacttagtcgttacggtaccagacaacgaaaccaggacaccgtaccccgtaaggtccctactaacgttacgtcgggactaccgtccggtaaccccgggtacggttccccgggtccctcgaccgtacttacgaggtacggacgtaggtccgggttcgtaggggactacggttacttaccaccgttacctacccaaccgtcttaaccccgaaaccctaaaccgttcggaccggtaccggtacggttaacggaagttcggtcggtacggtaactttaacgtttactttaacgtaggtaccgtacgtactaaactacttaaacgttaccgttcccttacctaccttaccgtacccggtttaccgggcgggtaaacccgggtacccgggtaaaggggtacgggtaacggtaaaccttaaacgaaaaccggttagtacgggttacggtaccgtaccggacctaacccgttattcccggttacgttcccgtttaccggtacctttcccccggttaccccttacccgcgtttaccctacgtaaccctttaacccg

SEQ ID NO: 52797 - DNA, 640 bp, Homo sapiens
  misc_feature: GYAE6OF02HIYCX.18.11.A11.1.454.CMB.1.raw
  modified_base (212)..(212): a, c, t, g, unknown or other
  misc_feature (212)..(212): n is a, c, g, or t
  modified_base (276)..(276): a, c, t, g, unknown or other
  misc_feature (276)..(276): n is a, c, g, or t
tcagtacgagtatgcacgaccggtgctcgatttagctacgactgcaggggcagcaagatggtgttgcagacccaggtcttcatttctctgttgctctggatctctggtgccggacggggacatcgtgatgacccagtctccagactccctggttgtgtctcgtgggcgagacgggccaccatcaactgcaagtccagccagagttgttttanacagctccaacaataacaactactagcttggacagcaagaaacaggacacgcccctaagtcctntattacgcggacacgtaccgtacccgggacggtccggggtcccctacgaccgacttcgaggtacggcgacggccgggtcgtagggacctagtacgtttcaccttctaccaaccacttaccgaacctaacccgtgaccgacggtacgtagaagtacgtaggtggtactttagtttattaccgttgtacgagttaacaattaactagttaccgttccttctcctacgtaccggtcgggacgggtacgggaccgtaagggtcgaagtaacgtaaccgaaacgtacgttaggtcgtcgtagacctacgtacgttctccgttactcctaccgttccgtaccccgtacgtactacgtaccaacgttaccg

SEQ ID NO: 52798 - DNA, 689 bp, Homo sapiens
  misc_feature: GYAE6OF02JURSS.18.11.A11.1.454.CMB.1.raw
  modified_base (211)..(211): a, c, t, g, unknown or other
  misc_feature (211)..(211): n is a, c, g, or t
tcagtacgagtatgcacgaccggtgctcgatttagctacgactgcaggggcagcaagatggtgttgcagacccaggtcttcatttctctgttgctctggatctctggtgccggacggggacatcgtgatgacccagtctccagacctcccgtggttgtgtctcgtgggcgaggacggccaccatcaactagccaagtcccagccagttagngttatccagctaccaacaattaacacttacgttacgcttggaccaacgacgacgaaaccaccggtaaccgacgccccctaaggttcctcgatttactgggccaacgtccgtaccccgggtagtcccggggtacctgccgggaacttcgaacgtacggggtccagggaccggtacgtagggtaccaacggtacgtttcccgaaccttcgtacccaaacccgtactaccgaacccgtaaccgttacgacgtaaacgggctacgggtaagaccgttaggttacgtactacgttttataccgtagtacaacgtacgtaacttaccgtattccgttaccttccgtacgtcgtaaccgttaccgggacggtacgggaaccaagggttacgaacgacgttacgaaacgtacgtcgacgtccacgtcctaccgtattcccgttagtccttacgacttcctacccgattaccgtcgtactcgtaacg

SEQ ID NO: 52799 - DNA, 856 bp, Homo sapiens
  misc_feature: GYAE6OF02H3376.18.11.A11.1.454.CMB.1.raw
  modified_base (792)..(792): a, c, t, g, unknown or other
  misc_feature (792)..(792): n is a, c, g, or t
  modified_base (804)..(804): a, c, t, g, unknown or other
  misc_feature (804)..(804): n is a, c, g, or t
  modified_base (814)..(814): a, c, t, g, unknown or other
  misc_feature (814)..(814): n is a, c, g, or t
tcagtacgagtatgcacgaccggtgctcgatttagctacgactgcaggggcagcaagatggtgttgcagacccaggtcttcatttctctgttgctctggatctcgtggtgccggacggggacagtcgtgagtacgacccctagtcctaccacgtaccttcccgttggttggttcgtcgtcggtaggggacggaggaacgggcccacctaactaccaacgtcgaccaacgtccgaacgacctaaggtagtttagttttaactacgacgtacctaaaccaaacgtaaaactaaacctaaacctttacgttaaccgtacgtttaccggtaaccgacgaccgaaacgaaaccgaaggaaccgaccgtaaccccctaacggtacctacgttaacgttttacggtcggtaccacgttcccggttaaccccggggacgtccccgggggttacccaacgggtaccttaacgtccggaaggtacgggacgacgggtccgggttacggtcgggaacgtagtaaccgtttaccacgttacctacaacccgtactacccgtaaccctaaccgtacgaccggtaacggccttaaggacggtagttcggtacggttaacgtttaggttttaactacgttacgtaccgtagtaaacgtattaaacgttacttaccgtttaacctcccgttacgttacccgtagggttaacccgggaggggttaaacccggtaccgggtaaacggtacgggaaccgttaacgtaaaccgtaaaacggacgttacggtcgaccgtagacccttacggtnttccggtttacnccgtttaccnccgtttacccgtaccaccttacgtactaccgttaacttacgg

SEQ ID NO: 52800 - DNA, 813 bp, Homo sapiens
  misc_feature: GYAE6OF02HJO6H.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtgccggacggggacatcgtgatcgacccagtctccagactccctggttgtgtctcgtgggcgaggacgggccaccatcaactcgacgaacgtccacgccaggtagtttagtttttacacgacgacctaccaaactaaactaaaccaacttacttagtacttacggtaaccacgacaacgaaaccgaggaccaccgtaccccgtaaggttcctacttactttacgtcggtacctacgttacccggtacccggggtaccggttcccggggtcccgtacggaccgtacgttcgacggacggacggtacgggccgggtcgtacgggactaggtactttactaccttactaccgaacctactaccaaccctaaccgtcggtaccgacgggtacgaggtaacggtacgtagggttaccggtagtttaacgtttttaacgtttacgtacggtaaccacgtaaacgttaaacttacgttaaccgtttaccgtaccctttaccgttccgttaaccggttacccgggttaccgggggaacccgggaacggggttaacccgggtaaagggtacgggtaaacgttaacgttaaacccggaaaacggtaccgtttaacggggccgttaaccgacgttacctaccgttcgtttacccgttcgttacccgtttacctaccgtttcccttcccgtacctaccgtttcgtaccgtactaaccg

SEQ ID NO: 52801 - DNA, 771 bp, Homo sapiens
  misc_feature: GYAE6OF02GU23Z.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctgtgggcgagagggccaccatcaactgacaagtccagccagtacgttgtttaatacagcctaccaaacaactaaccaactacttagcttagtaccagcaagaaaccaggacacgccccctaaggtcctacatttacgcgggacacgttccgtaacccggggtacggtccccggggtacccctaggtacccgtacttacgacggacggacgacgggtcgggtcgtacgggactaacgtacgtttaccgtaccttcgacctaaccactacccaaacctacctacgactaaggtccgtaagaacgtaaggttggtacggtacttaacggttttaacttacgttcggtacgtacgtaactaaacgtacctttaacgttaccgttccccttacccgttaccgttcccggtaaccgggttttacccggggaccgggtaacgggaacccgtaagggggtacggtaaacgtaacgttaaaccgtaaaacggtcggttaacgggtcggtaccgtacggacccgtaaccgtacggttttaccttacggttaccctttacgaccgttttaccccgttcccggttaaccctaccggttttacccgtaccgtaaccgtttaacccg

SEQ ID NO: 52802 - DNA, 851 bp, Homo sapiens
  misc_feature: GYAE6OF02GZJQ9.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactcctggtgtgtctcgtgggcgagagggccacatacaactgacaagtccagccagtacgttgttttaatacgagtcctaccaaactaaactaaacctaaacttacgtttagtccgtttacgggtaaccagaccaaacggaaaaccacgggaacctaaccggtaccccccgttaacggttaccccttaccgtaagtttacggtcgggtacctaaccgttacccggtaaccccggggtaaccggttaccccggtaccggggttaccccctacggtaacccgtacgttaaccgagggacggaccggacgggtccgggggtacggtacgggaacgtaaggttaccttaccgtacgttcccgtaacctaaccgtaacctacccaaacccgttaaacccgtcggaaccgtacgggtacgtaacggaacggtaacgttcgggtacggttaacgtttaaggttttacttaacggtcgtaacgtaagtaaccgtaaactaacgttacggttaaccttcccttaccttaccgtaccggttaccgggtaccgggtaacgggggaaccggtaaacggtaaggggtaggaacgttacgtaaaccgtaaacgggtaccgtgggttaccggacgtacacccggtaacggttaccttccggttactacccggttactcccggtttacccttaccccggccttaacgttacccgtagttaacccg

SEQ ID NO: 52803 - DNA, 665 bp, Homo sapiens
  misc_feature: GYAE6OF02GL2YC.18.11.A11.1.454.CMB.1.raw
  modified_base (211)..(211): a, c, t, g, unknown or other
  misc_feature (211)..(211): n is a, c, g, or t
  modified_base (290)..(290): a, c, t, g, unknown or other
  misc_feature (290)..(290): n is a, c, g, or t
  modified_base (323)..(323): a, c, t, g, unknown or other
  misc_feature (323)..(323): n is a, c, g, or t
  modified_base (330)..(330): a, c, t, g, unknown or other
  misc_feature (330)..(330): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggcccaccatcaactgcaagtccagccagtagttgttttanacacgctaccaaacaataaccaacttacttagcttcggaccagcagaaaccaggacacgcccctaggtcctctattcgngggcactccgtacccgggtcggtccgggtcccncgaccgnttacgaggacggacaggcgggtctggacagtctttcactctccacctactaccacccactcgtcgagtcgtagaagtacgtggtacggtcttaagttttacttacgttgtacgtacgtactaacttacgtaacttacgttcccttcccttaccgttaccgtaccggtttccggggaccgggtaaccgggtaaccggtaacgggtacgggtaacgtaaccggtaaccgtaaacggtaaccgttgggtaccgtcgtaccgacctaccgtacttccgttcgttacttacccgtacgttacccgttcccgaccttacgttacttaccgtacttaacccg

SEQ ID NO: 52804 - DNA, 685 bp, Homo sapiens
  misc_feature: GYAE6OF02HXSJ4.18.11.A11.1.454.CMB.1.raw
  modified_base (214)..(214): a, c, t, g, unknown or other
  misc_feature (214)..(214): n is a, c, g, or t
  modified_base (304)..(304): a, c, t, g, unknown or other
  misc_feature (304)..(304): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtcctccagactccctggttgtgtctcgtgggcgaggacgggccaccatcaactgacaagtccagccagagttgttttanacagcctaccaaacaaataactaactacttagcttcggtaccagacaacgaaaccaggacacgacccctaaggtcctactacttttacgngggactacgtccgtaacccgggtacggttccccggggtccacggtaaccgtacttacgagggtacgggaccgacgggtccgggtaccgtaggggaacctaggttactttccgaacctccgtaccaaccctacgttacccaaacccgtaccgtacgaccgtaacggtaccgtaggaaacgtgtacggtcgtattaacggtttttctaacgtacgtacgaacgtactaacgtactacgttaacgtccctacgttcctcgtacggtacggcgggtacggaaccgtaggcgtaacgtactaacgaaccgtacgtgtacggcctcgacctacctagttccttagtctacctaccgttccctaccgccttagtctacgtattaaccg

SEQ ID NO: 52805 - DNA, 774 bp, Homo sapiens
  misc_feature: GYAE6OF02J1ERL.18.11.A11.1.454.CMB.1.raw
  modified_base (82)..(82): a, c, t, g, unknown or other
  misc_feature (82)..(82): n is a, c, g, or t
tcagtacgagtatgcacgaccggtgctcgatttagctacgactgcaggggcagcaagatggtgttgcagacccaggtcttcnctttctctgttgctctggtatctctggtgtccggacggggacatcgtgatcgaccagtcctccagactcccgtggttgtgtctcgtgggcgaggacgggacccacctatccaaccgtgaccaacgtccagccagtagttgtttagacacgcctaccaacaactaacaactacttagaccgtttaggtaccagacgaacggaaaccaggaaccaccggtacccccgttaaggtccccttacgtacttttaacgtcgggtaccaacgtaccggtaaccccggggtacggttccccgggtaccctacggtaccgtacttacgacggtcggacgacggtcgggtcgtacgggaacgtacgtacgtttccaccgtctaccgaccacgttaccgaaccttaaccggcgtaccgaacgggtacgtaagtacggtacgttggtacggtaactttacggttttaacgttacgtagtaccgtaagtaaccctaagtaaccctagttaaccgttcccggttacccttaccggttaccggtaacgggtaccggggtaacgggtacgggaaccggttaagggtacgtaacggtaaccgtaaccgtaaacgtaaccgtggtaccgtacgacgtccaacgttctaccgtcgtacccgttactcccgggttaccttcccgaccgtttacgcgttagtacccgttaacg

SEQ ID NO: 52806 - DNA, 708 bp, Homo sapiens
  misc_feature: GYAE6OF02HEX4R.18.11.A11.1.454.CMB.1.raw
  modified_base (209)..(209): a, c, t, g, unknown or other
  misc_feature (209)..(209): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagttgttttanacagcctaccaacaataacaactacttagcttggtaccagcaagaaaccaggaacacgacccccctaaggtccctcatttacgtggcatccgtacccggggacgtcccggggtccctggacccgattcaggacggcaggcgggtcgtgggacagtactttcactctcaccataccaaccctaacctcgacgtacggacctaggaaacgtagttcggtacggactttaaggtttttacttacgtgttacgaacgtactaaacttacgttaaccttacgttccccttacccttcttacccgtaccggtttccgggaaccggggtaccgggaacccgtaagggtacgggaagttaccgtaaccggaaaaccggtaccgttcgggtacgtacgtaccgtaccgtaacccgtaacgtttcccgtaggtttaccctttacccgttactttaccccgtttacccccggtaccttaccgtttcccggtaacgtaccctttaacccgg

SEQ ID NO: 52807 - DNA, 764 bp, Homo sapiens
  misc_feature: GYAE6OF02FKFGD.18.11.A11.1.454.CMB.1.raw
tcagtacgagtatgcacgaccggtgctcgatttagctacgactgcagggggcagcaagatggtgttgcagacccaggtcttcatttctctgttgctctggatctctggtcgccggacggggacatcgtgatcgacccagtctccagacctcccgtggttgtgtctcgtgggcgagagggccaccatcaactgccaagtccagccagtagttgttttactacagtcctaccaaacaactaacaacttacttagctttacggtacccagaccaacgaaaccgacggaccaccgacccccgttaaggtccctagtactttacgcggcctacgtcccggtaacccgggtcggtccggggttcctacggacctagttaccgagacggcgtacgggccggttacgcgggactagttactttccactcctccaacgtactacccgaccaaccgtcgaccgtaggaccgttaaggaacgtacgtacggtacgggtactttaacgtttaacttacgtcgtaacgtaacgtactaaacttaccgttaacgttacctcccccgtttacgtaccgttcccgtaaccggtttccggggaaccgggtaacggggtaaacccgtaggggttaacgaacgtaacctttaaccggaaaccgttacggttacgggtaccggttaccgtcgtaacccgtccttaacggttccttaaccggttaccctttcgaacccgtttccccgtacccgtaccttaccgtacggtaccgtacccttaaccg

SEQ ID NO: 52808 - DNA, 814 bp, Homo sapiens
  misc_feature: GYAE6OF02JH25B.18.11.A11.1.454.CMB.1.raw
  modified_base (213)..(213): a, c, t, g, unknown or other
  misc_feature (213)..(213): n is a, c, g, or t
  modified_base (490)..(490): a, c, t, g, unknown or other
  misc_feature (490)..(490): n is a, c, g, or t
  modified_base (568)..(568): a, c, t, g, unknown or other
  misc_feature (568)..(568): n is a, c, g, or t
tcagtacgagtatgcacgaccggtgctcgatttagctacgactgcaggggcagcaagatggtgttgcagacccaggtcttcatttctctgttgctctggatctctggtgccgacgggacatcgtgatgacccagtctccagactccctggttgtgtctctgggcgagacgggccaccatcaacgtgaccaagtccagccagacgttgttttanacacgctaccaaacaagtaaaccaactacttagtctttagggtaacccagaccgaagaaaacccgagggaacctaaccgtacccccgttaaacggtccctacttaagtttaccggtacgggaacctacgttaccccggtaacccggggtacggttccccggggtaccccttaggtaacccgtaatttacccggaaggaccgggtacgtacggggtaccgggtccgtaaggggactaacggtacttttacacccgtttacgttaccaaccgtttaacnccgtaaaccctaccgttcgaaccgacgggtacttacggaaacgtgtaggtcgtaccgttaaggtttactagtcgtaanacgtactaaacggttactaagttaccgtaccctaccggttacctacccgggttaaccgggaccgggtaccggggtaaaccgggttacggaaacgggtcggtaaagtaccgtacgtaaaccggtaacgttgggtaaccggttcgtacgttaccaaccgttacgttacctttaggtaaccctttgtaaacccccgtttccgttaccccggaacccttaacgggtttcccgtacgtaaacggttaaccc

SEQ ID NO: 52809 - DNA, 758 bp, Homo sapiens
  misc_feature: GYAE6OF02IX9TO.18.11.A11.1.454.CMB.1.raw
  modified_base (120)..(120): a, c, t, g, unknown or other
  misc_feature (120)..(120): n is a, c, g, or t
  modified_base (219)..(219): a, c, t, g, unknown or other
  misc_feature (219)..(219): n is a, c, g, or t
tcagtacgagtatgcacgaccggtgctcgatttagctacgactgcaggggcagcaagatggtgttgcagacccaggtcttcatttctctgttgctctggatctctggtgccggagggacntcgtgatgaccagtctccagaccttcctggttgtcgtctcgtggacgaggaggcccacctatacaactgactaacgtccacgcagtagtttagtttaanacacgacctaaccaaacctaaataaaccgtaaccttacgtacgtcgttacgaaccagacctaacgaaacctagaccaccgtaccccctaaaggtccctacgtaacgtttacgacgggacctaaccgttaccggtacccgggtaccggttcccgggggtaccctacggaacccgtagttaacaaggtaccggaccgtaacggcgggtacgtacgggactaacggttatttaccgacttacgtaccaacgttaacctaccgaacccgtaacgtccggaacgtaccgggaactaacggtaaacgtcgtacggtacgtaaccgttagtttaacttacgtaggtactaagtacaacgttactaactttactccctaccgttctacgtaccggcgggtaacgaacgggtaccgaagggtcgtaacgtaactaaccgaaagtcgttaaccggagtacctaccgtaactaacgtccggttacttcggttaaccttccgtaccgtttacccctacccgttaacgttctaccggttacaacgttacccg

SEQ ID NO: 52810 - DNA, 875 bp, Homo sapiens
  misc_feature: GYAE6OF02HQSJJ.18.11.A11.1.454.CMB.1.raw
  modified_base (211)..(211): a, c, t, g, unknown or other
  misc_feature (211)..(211): n is a, c, g, or t
tcagtacgagtatgcacgaccggtgctcgatttagctacgactgcaggggcagcaagatggtgttgcagacccaggtcttcatttctctgttgctctggatctctggtgccgacgggacatcgtgatgacccagtctcagactcctggttgtgtctcgtggcgagacggccaccatcaactgcaacgtccagaccagagtttgtttttaanacgacgtcctaccaaacaaactaacaaacttacttagcttaggtaaccagtcaagaaccgaggaaccacgaccccctaaggtcctactagtttacgcgggtactactaccgtaacccggggtacggttccccggggtaccctacggtacccgtaagttccgacgggtacggccgaaggtccgggtacgttacgggacctaaggtacttttaccaccttccgtaccctaccgtaaccttaccgaaccccgtaaccgttcgacggtacgggtacgttaacggaacggttacgttacggggtaccggtttaacgttaaacggttttttacgttaaccgttaacggttaaccgaacggttaaccttaaacgttaacgttaacgtttaaaccccggtccccgtttaacccgtttacccgtaacccggttaccgggttttaccggggaacgggtaacccggggtaaaccggtacggggtaacgggttaaaccgtaaccgttaaaacccgggaaaacgtttaccggaggttaccgggtaaccgtacccgggtacccttaaaccggtcgtttaccggtttaccggttacccgttttacccgtaccggttttacccccgttaccccgggtacccttaacgtttacccggttaacggtaaccccgtttaaaccg

SEQ ID NO: 52811 - DNA, 704 bp, Homo sapiens
  misc_feature: GYAE6OF02INO86.18.11.A11.1.454.CMB.1.raw
  modified_base (210)..(210): a, c, t, g, unknown or other
  misc_feature (210)..(210): n is a, c, g, or t
tcagtacgagtatgcacgaccggtgctcgatttagctacgactgcagggggcagcaagatggtgttgcagacccaggtcttcatttctctgttgctctggatctctggtgccgacgggacatcgtgatgacccagtctcagactccctggttgtgtctcgtgggcgagagggccaccatcaactgcaacgtccagccagagttgttttanacagcctaccaaacaaataaacaacttacttagtcttacggtaccagacaagaaaccagacacgcccctaaggtcctactattactggacacgtaccgtacccgggtcggttcccggggtccctacgacccgtattaccgaggacggacgacggtccgggtcgtacggggaactagtacgtttcacttccgtaccaccacttaccaaaccctaaccgtcgaccgtaggtaccgtaacgtaaggtacgttcggtaggtaccgtttaagtttttaacgttacgttacggtacaacggtactaaacgttacttaacgttaccgttacccttacccttaccttacgtaaccggtccggggtaaccgggagggtaacccgaagggtcgtaatacgttaaccgaaacggtacttgggtcggtaccgtacgtacctaccgtagttccgtagttccgttactaccgttcccgttacccgccttacgtccttagacccttacg

SEQ ID NO: 52812 - DNA, 730 bp, Homo sapiens
  misc_feature: GYAE6OF02GQ7OI.18.11.A11.1.454.CMB.1.raw
  modified_base (211)..(211): a, c, t, g, unknown or other
  misc_feature (211)..(211): n is a, c, g, or t
  modified_base (215)..(215): a, c, t, g, unknown or other
  misc_feature (215)..(215): n is a, c, g, or t
  modified_base (302)..(302): a, c, t, g, unknown or other
  misc_feature (302)..(302): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagacctccctggttgtgtctcgtgggcgagagggccaccatcaactgcaagtccagccagagttgttttanacancctaccaaacaataacaacttacttacgcttggtaccagacaacgaaaccaggaccacgaccccctaaggtccctctaactttacgngggacctactacccggtacccggggtacggtccccggggtccctaggaccgtacttcgaggacggcgaggtcgggtcgtagggacagtacttcactctaccaactactaccaacctaacgtcgacgacggacttacggaagtacgttacgggtcggtaacttttaagttttaacttacggttacgtaccgaacgttaactaacgttaacttacgttaaccttcccgttaccttccgtacgtaccgggtttccgggaacggggtaacggtaccggtaaggggtacggtaacgtaacgttaaaccgaaaccggtaagttcgggtacggtacctacgtaacccgtaacgtccgtttacgttccgttacccgttaccttcccgtttacccttcccggtaccttaaccgttccgttaacgaccctttaaccgg

SEQ ID NO: 52813 - DNA, 719 bp, Homo sapiens
  misc_feature: GYAE6OF02FOC6U.18.11.A11.1.454.CMB.1.raw
  modified_base (657)..(657): a, c, t, g, unknown or other
  misc_feature (657)..(657): n is a, c, g, or t
tcagtacgagtatgcacgaccggtgctcgatttagctacgactgcaggggcagcaagatggtgttgcagacccaggtcttcatttctctgttgctctggatctctggtgccgacggggacattcgtgatcgaccctagtctccagacctcctggttgtgtctacgtgggcgagagggtccgaccatccaactcgcgaacgtccagccagtacgttgttttacacacgcctccaaacaataaccaacttacgttagcttacggtaccagacacgaaaccgaggaaccaccgacccccgttaaggtcccgttacgtacgtttaccgtgggccacgttacccgtacccggggacggttcccggggtaccctgaaccggtattccgaacggacggtcacggtccgggttacgtcgggacgtagttacgtttacgaccgttcctaccgtaacctctaaccaacccgacgtcgacgtacgcgaacggaagtagtcgtacgcgtttaagtttacgttacttgtaccgtaagtaccctaaagttacgttaaacgttccgtttacccctccgtttaccctccggtaccgtttccgggaccgggttaaggtaaccggtaggttcggtaagtacgtaaccgtaaacgcgttagtacggcttacgaccncgttactacggtcttaccgttctaccgttcccttcccggataccgtccgttacgacttaccg

SEQ ID NO: 52814 - DNA, 766 bp, Homo sapiens
  misc_feature: GYAE6OF02JSZTA.18.11.A11.1.454.CMB.1.raw
  modified_base (162)..(162): a, c, t, g, unknown or other
  misc_feature (162)..(162): n is a, c, g, or t
  modified_base (193)..(193): a, c, t, g, unknown or other
  misc_feature (193)..(193): n is a, c, g, or t
  modified_base (240)..(240): a, c, t, g, unknown or other
  misc_feature (240)..(240): n is a, c, g, or t
tcagtacgagtatgcacgaccggtgctcgatttagctacgactgcaggggcagcaagatggtgttgcagacccaggtcttcatttctctgttgctctggatctctggtgccggacggggacatcgtgatcgaccctagtcctccacgacctcccgtggttgngtctcgtgggcgaggacgggccacatcactnacaacgtccacgccaaggtagtttagttttacacacgcctaccaaanaactaacctaacttacgtagtccttacggaccacgacaagaaccgacggtaccaccggtacccctaacggtccctacgtacgttacgtcgggactaccgtacccggttaccccgggcggttcccggggtccctacggaacccgtgttaccgggaaggtaccggaggtacccgggtcgggttcgtacgggaacttacggtactttaccggccttacgacctaccacgttaaacccaccgtaaacgtccggaacccgacgggttacaaacggtacggtaggtacggtaccgggtaactttacgtttaccggtttatccggttaacacgtaactaacgtacttacgttaccgttccttaccgttcgtaacgttcggacgggtacgggaccggtacgtagggtaggtaccgtaacgtaaacgtaccggtaagttccggtagacccgtagtaccctaccgacgtttcgtaccgttaacctcgttacccttcccggttacctaccgtaccgtaccgtaccggtacctaccgg

SEQ ID NO: 52815 - DNA, 703 bp, Homo sapiens
  misc_feature: GYAE6OF02GCCQ6.18.11.A11.1.454.CMB.1.raw
  modified_base (212)..(212): a, c, t, g, unknown or other
  misc_feature (212)..(212): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcaggacggccaaccatcaactgactaacgtcacgccagagttgtttanacagacctaccaaacaactaaacctaacttacttagacttcggaccagcaagaaaccaggtaccacgacccctaaggtcctctattacgtggcagtccgtacccggggtagtcccgggtcctgaccgtattccgagacgcaggcgggtcagggtacacggtatttacgaccttctaccacactcaacctaaccgtgtacccagggtcctaaggaacgtagttcggtgtacttagtttaacttagtcggttacacggtaactaacgtacttacgttaccttccgtcccttcgtaccttacccgggttacgggacgggtaaccgggtaaccggtaacgggtaggtaaaccgttaacgttaacccgtaaaaacggtacccgttgggaccggtacttcggaaacccttcggtaaccttccgggttaactttacccgttaccgttactttacccgttaccccgaccttaaccgtacgttaccgtaaccgttaaccg

SEQ ID NO: 52816 - DNA, 820 bp, Homo sapiens
  misc_feature: GYAE6OF02GPJHO.18.11.A11.1.454.CMB.1.raw
  modified_base (158)..(158): a, c, t, g, unknown or other
  misc_feature (158)..(158): n is a, c, g, or t
  modified_base (211)..(211): a, c, t, g, unknown or other
  misc_feature (211)..(211): n is a, c, g, or t
  modified_base (799)..(799): a, c, t, g, unknown or other
  misc_feature (799)..(799): n is a, c, g, or t
tcagtacgagtatgcacgaccggtgctcgatttagctacgactgcaggggcagcaagatggtgttgcagacccaggtcttcagtttctctgttgctctggatctctggtgccgacggggacagtcgtgatcgacccagtctccgagactccctggttntgtctctgggcgagaggccacagtcaactgcaagtcagcagtagttgttttanacagctaccaacaattaacaacttactaagtcgttcggtaccaggacaggtaaaccgaggaccaccgtaccccctaaagggttccctacgacgttttaacgcgggacctaacgttaccgtaaccccgggggtacggttcccccgggggttaccccttaggaaccccgttaaacgtttttaccggaacgggttaaccggggtaaccaacggggtacccgggggtttacccgtaaccggggggttaacctaagggttaacccgtttttacgaaccccgtttacgggttaccccaaacccgttaaacttaaaaccccgtaacccggtttacggaaccgaacggggttaccctttaaaggaaacgttaacgttcggggttacgggtaaccttaaacggtttttacggtaacctttacggtaccgtaaggtacttaaacgtacttaaaccgttaccgttccctacccgttacgttaccgtaaccggtttccggaggtaacggaccggtaagtcgaagactaccaaagtacctggtacggcctacgtaccacctagttccaggttacttacgtaacttcctacccggacttaanccgttacgtaccatttacccg

SEQ ID NO: 52817 - DNA, 696 bp, Homo sapiens
  misc_feature: GYAE6OF02FSP0R.18.11.A11.1.454.CMB.1.raw
  modified_base (172)..(172): a, c, t, g, unknown or other
  misc_feature (172)..(172): n is a, c, g, or t
  modified_base (212)..(212): a, c, t, g, unknown or other
  misc_feature (212)..(212): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagtacctccctggttgtgtctcgtgggcgagngggccaccatcaactgcaagtccagccagagttgttttanacagcctaccaaacaactaacaacttacttagcttaggtaccagcaacgaaaccaggaactacgacccccttaaggtccctctaacttttacgtcgggtactagttcccgtaacccgggggtaacgttccccgggggtaccctacggaacccgtagttccgaaggacgggtcacgggtccgggtcgtgggaacctaggtactttcacgttcctaccaaccgtactaccgtaaccgtaaccgtcgaccgtacggtacttacgggaaagtacggtggtacgtccgttaagttttactacgtcgtacacggtactaacgtacttagttacctccgttcctacgttcgtaccgtcgggtacggaccgggttacacggttggaacgtaacgtactaaaacggtcgtacggcgtactcggacctacgtactccgtttcgtcccttactaccgttccggtacccgacgttcgtaccgtagtaccgtaaccg

SEQ ID NO: 52818 - DNA, 606 bp, Homo sapiens
  misc_feature: GYAE6OF02I0CI5.18.11.A11.1.454.CMB.1.raw
  modified_base (338)..(338): a, c, t, g, unknown or other
  misc_feature (338)..(338): n is a, c, g, or t
  modified_base (347)..(347): a, c, t, g, unknown or other
  misc_feature (347)..(347): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccaaagactccctggttgtgtctctgggcgagagggccaccatcaactgcaagtccagccagagttgttttatacagctccaacaataacaactacttagcttggtaccagcagaaaccaggacacgccccctaaggtcctcatttactgggcactcgtacccgggagtcccggggtcccgtgaccgattcgagaggcgngcgggtcgngggacagtatttcactctcaccactacaccaacctcgcacggctacgaagagtagtggactagttttacttacgtcgtacaacgtactaattaactacttacgttccttccctccttcgtaccggtttccgggacgggtaccgggtaacgtaacgggtaggaacgtaacgtaccgaaaacggtacgtaggtcggacctgaaccacgtacttcgtcgttccttagtccttccgttccctcctactccgtagaccttaacg

SEQ ID NO: 52819 - DNA, 727 bp, Homo sapiens
  misc_feature: GYAE6OF02H3I6W.18.11.A11.1.454.CMB.1.raw
  modified_base (214)..(214): a, c, t, g, unknown or other
  misc_feature (214)..(214): n is a, c, g, or t
  modified_base (387)..(387): a, c, t, g, unknown or other
  misc_feature (387)..(387): n is a, c, g, or t
  modified_base (703)..(703): a, c, t, g, unknown or other
  misc_feature (703)..(703): n is a, c, g, or t
tcagtacgagtatgcacgaccggtgctcgatttagctacgactgcaggggcagcaagatggtgttgcagacccaggtcttcatttctctgttgctctggatctctggtgccggacggggacaatcgtgatcgacccagtctccagacctccctggttgtgtctcgtgggcgagcgggccaccatcaactgccaagtccagccagagttctttanacagcctacaaacaactaacaacgtattagcttacggtaccaggtacaacgaaccgtacgaccaccgtacccccgtaaggtcctacgtactttacgtggactagtacccgtaccgggacggtcccgggtccacggaccgtatacgagacggcgaggtcggtcgtacgggaacnggttacttccaacgttcaaccgacctaacgtaccaaccctaaccgtgaccgtacgggcctaagggaacgtagttacgggtacgggtaccgttttaaggtttttaacttaccggtagttaccaacggtactaaacgtttacctaacgttaccgttcccctaccgtttacccgtaccgggttaccgggttaccggggacgggaaccgggtaaccggtaagggtcggaacgttaacgtaccgtaaaaccgtcgttaggtccgtacgtacgccttaccgtatttccccgtagttaaccgttccaccgttcccgttacccncttaccgtacgtaccgacttaccg

SEQ ID NO: 52820 - DNA, 820 bp, Homo sapiens
  misc_feature: GYAE6OF02JDBOM.18.11.A11.1.454.CMB.1.raw
  modified_base (331)..(331): a, c, t, g, unknown or other
  misc_feature (331)..(331): n is a, c, g, or t
tcagtacgagtatgcacgaccggtgctcgatttagctacgactgcaggggcagcaagatggtgttgcagacccaggtcttcatttctctgttgctctggatctctggtgccgacgggacatcggtgatcgacccagtctccagactccctggttgtgtctcgtgggacgaggacgggccaccataccaactgacaacgtccacgaccgagtagttgttttaacactagcctaccaaacaaactaaccgaaccttacttaacgtcgttacggtaaccagactaaacgaaaccgaggaaccaccgtacccccgtaagtcctactactttacgnggacctaacgtacccggtacccggggaccggttaccccggggtcctacggaacccgtagttccgaaggacggtaccgtagggtccgggtacggtacggaacgtaacggttcctttacaccgttccgtaccaacctaccgtaccgtaaacccgtacgttccgaaccgtacggggtaccctaagggtaacgtaacgtcggttacggtactttaaacgttttaacgtccgttagtaaccgtaactaacgtaaccgtttacttaccgttacccgttccttaacccgttgtaccccggttaaggttacccgggacgggtaaaccggtaccggtaaggttaccggaacgttaactaaccgaaaccggttcgtacggtaccgtagttacccggacctaacccggtaacttccggttccggttaaaccgttcccgttaaccgttccccccgttaccgtaacccggttactttacccgggaactaacccctttacggg

SEQ ID NO: 52821 - DNA, 822 bp, Homo sapiens
  misc_feature: GYAE6OF02IF7G5.18.11.A11.1.454.CMB.1.raw
  modified_base (215)..(215): a, c, t, g, unknown or other
  misc_feature (215)..(215): n is a, c, g, or t
  modified_base (218)..(218): a, c, t, g, unknown or other
  misc_feature (218)..(218): n is a, c, g, or t
  modified_base (733)..(733): a, c, t, g, unknown or other
  misc_feature (733)..(733): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatcgacccagtctccagtacctcccgtggttgtgtctcgtgggcgagaggccaccatcaactgcaacgtccacgccagagttgttttanacngtctaccaaactaactaacaacttactagaccgttaggaccagacaagaaacctaggacaccgtacccccgttaaggtccctactaactttacgcggactacgtaccggtacccgggacggttcccgggttacccgaggtaccggtacttcgacggacggacgacggtcgggtcgtagggactaacgtacttttaccaccgttcgtaccctaaccgtacttacccaacccgtaaccgtcgtacgaccgggtcctaaggaacgtagttacgggttacgtacgtttaacggttttaaccgtttacgtacggttccgaaacgttaccgtaaacgttttaacgttacgtttaaacccgtttccccgtttaaccgttacccgttaccggtacccggtttacccgggggaacgggggtaaccgtaacccggggttaaagggttaccgggtaacgttaaaccgaaaccggttaaaaccggttaccggttcgggtaacgtaccggttaccgacgtaaccccgngttttacccggtacgtttacccgttaacgttacccctttcccgttaacccgtacgttaacccggtttacgtacctaacccgtttaacgg

SEQ ID NO: 52822 - DNA, 594 bp, Homo sapiens
  misc_feature: GYAE6OF02GGMP4.18.11.A11.1.454.CMB.1.raw
  modified_base (213)..(213): a, c, t, g, unknown or other
  misc_feature (213)..(213): n is a, c, g, or t
  modified_base (295)..(295): a, c, t, g, unknown or other
  misc_feature (295)..(295): n is a, c, g, or t
  modified_base (427)..(427): a, c, t, g, unknown or other
  misc_feature (427)..(427): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagacctccctggttgtgtctcgtgggcgaggagggccaccatcaactgcaagtccagccagagttgtttttanacagcctaccaaacaataacaactacttagcttggtaccagcaagaaccaggaccagccccctaaggtcctacattttacgngggacatccgtacccggggagtcccggggtcctggaccgattcaggaggcaggcgggtctgggacagtactttcactctcacatcaccaacgtgacaggctagaagatgtggactagttttactactcgtanacgctaatctaatacgtccctcttctcgtacgttcggacgggtaggaaccagggtagagtactaccgaaacgacgtgtagccgtagacctaccgtacttaccgttcgttaccgtttacctacgtttccccgttacccgtaccttaattccgtacgaaccttaacccg

SEQ ID NO: 52823 - DNA, 630 bp, Homo sapiens
  misc_feature: GYAE6OF02H6RTJ.18.11.A11.1.454.CMB.1.raw
  modified_base (213)..(213): a, c, t, g, unknown or other
  misc_feature (213)..(213): n is a, c, g, or t
  modified_base (216)..(216): a, c, t, g, unknown or other
  misc_feature (216)..(216): n is a, c, g, or t
  modified_base (240)..(240): a, c, t, g, unknown or other
  misc_feature (240)..(240): n is a, c, g, or t
  modified_base (301)..(301): a, c, t, g, unknown or other
  misc_feature (301)..(301): n is a, c, g, or t
  modified_base (573)..(573): a, c, t, g, unknown or other
  misc_feature (573)..(573): n is a, c, g, or t
  modified_base (578)..(578): a, c, t, g, unknown or other
  misc_feature (578)..(578): n is a, c, g, or t
  modified_base (594)..(594): a, c, t, g, unknown or other
  misc_feature (594)..(594): n is a, c, g, or t
  modified_base (600)..(600): a, c, t, g, unknown or other
  misc_feature (600)..(600): n is a, c, g, or t
  modified_base (627)..(627): a, c, t, g, unknown or other
  misc_feature (627)..(627): n is a, c, g, or t
tcagtacgagtatgcacgaccggtgctcgatttagctacgactgcaggggcagcaagatggtgttgcagacccaggtcttcatttctctgttgctctggatctctggtgccggacggggacatcggtgatcgacccagtctccagaccttccctggttgtgtctcgtggcgagaggcccacatcaactgcagtccagccagtagttgttttanacngacctacgaacaataacaaacttnttacgtcttaggacctagcaacgaaacaggtacacgtacccctaaggtccacttattacgnggacctatacccgtaccgggtacggttcccggggtcctacgaccggtattccgaagacgacgcgggtaccggtcgtacgggacaggtacttttaccgactcctacgacctactaccaacccgtaacctacgacgacgtactagggtaacgttagtcgtacgggtacttaagtttttactaagtcgtactaaagactacgtaataccgttagtccctactcttacccgtagtccgggaggttacggaacgtagggttgataacgtacaaacgngttancggattcgactactanccgttntacttcagttctactcactagtctaanacg

SEQ ID NO: 52824 - DNA, 767 bp, Homo sapiens
  misc_feature: GYAE6OF02HLNMB.18.11.A11.1.454.CMB.1.raw
  modified_base (698)..(698): a, c, t, g, unknown or other
  misc_feature (698)..(698): n is a, c, g, or t
  modified_base (710)..(710): a, c, t, g, unknown or other
  misc_feature (710)..(710): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatcgacccagtcctccagtacctccctggttgtcgtctcgtgggcgagacgggccacatacaactgaccaacgtaccagaccagtagttgtttatactagcctaccaaacaaataaaccaacttacttagtacgttacggtaccagcaacgaaaccacggaccaccgtaccccctaaggtccctactactttacgtgggacctacgttacccggtaccccggggtacggttccccggggtccccgtacggtacccgtagttaccgaaggacgggacgacgggtccggggtacgtacgggaccgtaacggtactttaccgacttcctaccaccgtaacctaccctaacccgaaccgtacgccggtacggtacgtagtaacgtgttacggttcggtaacgtttacgttttaacgtacgttcgacgaagtaaccttaacgtaccttattaacccgttcctaccctttacctccgttaaccgggttccgggaaccggtaaccgggtaaccgtagggacggtaactaagtacccgtaaaggtccgtacggtacgtccgttacggaacccgtaccgtntttaaccccgtnttaccttcccgtactttcccgttaacccgccctttaagcccttagtaccctaacccg

SEQ ID NO: 52825 - DNA, 661 bp, Homo sapiens
  misc_feature: GYAE6OF02F1SAA.18.11.A11.1.454.CMB.1.raw
  modified_base (226)..(226): a, c, t, g, unknown or other
  misc_feature (226)..(226): n is a, c, g, or t
  modified_base (242)..(242): a, c, t, g, unknown or other
  misc_feature (242)..(242): n is a, c, g, or t
  modified_base (587)..(587): a, c, t, g, unknown or other
  misc_feature (587)..(587): n is a, c, g, or t
  modified_base (644)..(644): a, c, t, g, unknown or other
  misc_feature (644)..(644): n is a, c, g, or t
tcagtacgagtatgcacgaccggtgctcgatttagctacgactgcaggggcagcaagatggtgttgcagacccaggtcttcatttctctgttgctctggatctcgtggtgccgacggggacatcgtgatcgacccagtctccagactccgtggttgtgtctcgtgggcggaggacgggccacctagtcaacgtcgaccaagtcccaggccaggtagttagttttanacgagtcctaccaaanaaactaactaactaacttagtccgttacggtaacccagacgaacgaaaccgaggaccacgtaccccctaaggtccctacgtacgtttagtcgggactcgtacccggtaccccggggtacggttcccggggtccctacgtcccggtaactccggacggaggtcgacgggtccgggtacgtaggggacaggttcttacaccgttccacccgtacacctacaacccgaacgtcgccgaagggtctagaggtacgtacgtgggtacttagttttaactggtctacgataactactgttaacttcggtccttacgtctacgtcggtacgggacggtacgacgttaggganagtaccacgtacaggtgacgctagactatcgactcttacgttacgccttccgtaccnccattcggtccattacg

SEQ ID NO: 52826 - DNA, 768 bp, Homo sapiens
  misc_feature: GYAE6OF02G13T4.18.11.A11.1.454.CMB.1.raw
  modified_base (217)..(217): a, c, t, g, unknown or other
  misc_feature (217)..(217): n is a, c, g, or t
  modified_base (224)..(224): a, c, t, g, unknown or other
  misc_feature (224)..(224): n is a, c, g, or t
  modified_base (540)..(540): a, c, t, g, unknown or other
  misc_feature (540)..(540): n is a, c, g, or t
  modified_base (623)..(623): a, c, t, g, unknown or other
  misc_feature (623)..(623): n is a, c, g, or t
  modified_base (685)..(685): a, c, t, g, unknown or other
  misc_feature (685)..(685): n is a, c, g, or t
  modified_base (747)..(747): a, c, t, g, unknown or other
  misc_feature (747)..(747): n is a, c, g, or t
  modified_base (754)..(754): a, c, t, g, unknown or other
  misc_feature (754)..(754): n is a, c, g, or t
tcagtacgagtatgcacgaccggtgctcgatttagctacgactgcaggggcagcaagatggtgttgcagacccaggtcttcatttctctgttgctctggatctctggtgccggacgggacatcgtgatcgaccagtctcagcttcctggttgtgtcctgtcgggacgaggacggccacctatacaacgtcgactaacgtccagccgagtacggtttnttttaanacacgtaccttaccgaaactaaacgttaaacctaacgttaaccgtttacgtccgtttacggtaaccgaacggacgtaacggtaaaccgaacggaacctacccgtacccccgttaacggttacccctacgttaacgttttaccgacgggtacctacgttacccggtaacccgggggtacggtttccccggggtccctaccgggaccgtactttacgggaacggaggtcccgttaacgggccgggttacggtacgggacgtacttacgtttaccgaacctctaccgacctataccgaccctacgtcgacgcgtacggntaacggtacttcggtactacgtttaactttaacgttcgtacgttactacgggtactaaacttacgttattacgtccctttacncgttacgtacggtcgggacggtaacgtacggtaggttaacgtaacggtaacctaaacgggtnttacgggaacttcggaactccgtaaccgtagtccttaccgtcttagtccctacgttaccccnttaccgntacgtctatacccg

SEQ ID NO: 52827 - DNA, 780 bp, Homo sapiens
  misc_feature: GYAE6OF02GKCXL.18.11.A11.1.454.CMB.1.raw
  modified_base (220)..(220): a, c, t, g, unknown or other
  misc_feature (220)..(220): n is a, c, g, or t
  modified_base (307)..(307): a, c, t, g, unknown or other
  misc_feature (307)..(307): n is a, c, g, or t
  modified_base (769)..(769): a, c, t, g, unknown or other
  misc_feature (769)..(769): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatcgacccagtctccagactccctggttgtgtctcgtgggcgaggacgggccaccatacaactggacaagtccagccaagtagttagtttttanacacgctaccaaacaaataaacgaactacttagcttagtaccagcaacgaaaccagacgacgacccctaaggtcctactatttacgnggcagtaccgtaccggggtacgtccgggtcctacgaccgtacttacgaaggacggacacgggcgggttcgtacgggactaggtactttacgaacctctaccgaacctaacgttacccaaacccgtaaacgtcgaccgtacgggtactaacggaaacggtactacgggttaacgggtactttaagggttttaacttaaccgttaggtaaccgtaacgtaaccttaaacgtttaacgtacggtttaacccgtcccctttaccgttaccctaaccgttaaccgggtttcgggtaccggggtaaaaccgggtaaccgttaaagggggttacggaaacgttaacgtaaccgggaaaaacgttacggttcgggaacggttctaccgtaaccgaacccgttagtccgtttaccggtacctttaacgtaccgtttaccccgttacccgtaccgttaacttcccggttaanaccgtttaacg

SEQ ID NO: 52828 - DNA, 782 bp, Homo sapiens
  misc_feature: GYAE6OF02I6M46.18.11.A11.1.454.CMB.1.raw
  modified_base (218)..(218): a, c, t, g, unknown or other
  misc_feature (218)..(218): n is a, c, g, or t
  modified_base (233)..(233): a, c, t, g, unknown or other
  misc_feature (233)..(233): n is a, c, g, or t
  modified_base (320)..(320): a, c, t, g, unknown or other
  misc_feature (320)..(320): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctcgtgggcgaggacgggcccaccatccaactgaccaagtccagccaggtagttgttttanacagtcctaccaaanaaataacctaacttactagtcgttacggtaaccagcaagaaaccgacggaaccacgacccccgtaacggtcctactaacgtttacgngggtacctaacgtacccggtaacccggggtacgttccccggggtaccctacggtaacccgtaacttccggaaggtaacggtccgacggtccgggttacgtacggggaactacggttaacgtttcccgaaccgtttcctaaccgtaaccctaacgttacccgaaaccgtaacccgtcggtaacgacgggtaccgttaaggaaacgtagtggtacggtacgtttaagttttaacgttaacgtcgtacgtaacgtactaactacgttagttacgtacccgttctacgtacgtacggtcgggacgggtacggtaaccggtagggtacggtaacgtaacgtaaccgtaaacggtaacgttcgggttaacgcgttaacggacctaaccgtaacttccgttacgttacccttaccgttaattacccccggttacccgaccttaaccgtccgttaacgtaacccttaacg

SEQ ID NO: 52829 - DNA, 731 bp, Homo sapiens
  misc_feature: GYAE6OF02FNVVH.18.11.A11.1.454.CMB.1.raw
  modified_base (557)..(557): a, c, t, g, unknown or other
  misc_feature (557)..(557): n is a, c, g, or t
tcagtacgagtatgcacgaccggtgctcgatttagctacgactgcagggggcagcaagatggtgttgcagacccaggtcttcatttctctgttgctctggatctctggtgccgacggggacatcgtgatcgaccagtctccagacctccgtggttgtcgtctcgtgggcgaggacgggccaccatacaactgacaacgtccacgacctagtagttgttttaacacacgtcctaccaaactaaactaaaccgtaacttacttagtaccgttacggtaccagacaacgaaacctaggaaccacgtacccccgtaggtcctactacttttacgcgggtactacgttaccggtaacccggggtcggttcccggggtaccctcggtaaccggtattacgaacggacggaccgtacgggtccgggttcggtacggtaacaacggttacgtttaccaccgttcctacccacctaacgtacccgtaaacccgaaccgtcgacgtaacggtacgttaaggaacgtacgttgggtacgtacgtttaagttttacttacgttacgtanacgtactaagtacttagttacctcctcctcgtaccgtacggttccggacgggtacggacgtaggtgaacgtacgtaacaaacgttcgtggtacgtcctagaccctaacgtacgttacctcgttaaccttactaccgttcccgttcccgtaactcgtaccgttacgaaccttacg

SEQ ID NO: 52830 - DNA, 786 bp, Homo sapiens
  misc_feature: GYAE6OF02HGYM4.18.11.A11.1.454.CMB.1.raw
  modified_base (211)..(211): a, c, t, g, unknown or other
  misc_feature (211)..(211): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctcgtgggcgagagggccaccatcaactgcaagtccagccagacgttgttttanacagctaccaacaaataaccaactacttagcttggaccagcaagaaaccaggaccacgacccccgtaaggtccctactactttacgtgggacctacgttcccgtaacccggggtacggtccccggggtccctacggaaccggtactttccgaaggacggtcaacgggtccgggtactaggggacaggtactttcgaactcctaccaaccgacttaccaacctaaccgtgaccacgggtactaacggtaaaggtacgttacgggtacggtactttaaacggtttttactttaacgttcggtaaccgtaacgtaacttaaaacgttaaccgttaacgttaccggtttccccgttaccttaccgttaaccggtaccgggtttaccggggacgggtaaaccggggttaaacccgtaagggggtacgtaacggtaacgttaaacgtaaaaccggtaacggttcgggttaacgggaccttcggaacctaacccgttaacgttccgttacgtttacccttaacgtaacccgtttcccggtccccgtaacccgttaggtttaccctacgttaaccgttaaccc

SEQ ID NO: 52831 - DNA, 761 bp, Homo sapiens
  misc_feature: GYAE6OF02I853Y.18.11.A11.1.454.CMB.1.raw
  modified_base (157)..(157): a, c, t, g, unknown or other
  misc_feature (157)..(157): n is a, c, g, or t
  modified_base (215)..(215): a, c, t, g, unknown or other
  misc_feature (215)..(215): n is a, c, g, or t
  modified_base (732)..(732): a, c, t, g, unknown or other
  misc_feature (732)..(732): n is a, c, g, or t
tcagtacgagtatgcacgaccggtgctcgatttagctacgactgcaggggcagcaagatggtgttgcagacccaggtcttcatttctctgttgctctggatctctggtgccggacgggacatcgtgatgacccagtctccagacctccctggttttntctcgtagggcgaggacgggccaccagtcaactgacaagtccagccagagttgtttanacagctccaaacaataaccaacgtacttagcttaggtaccagctaagaaaccacggacacgaccccctaaggtcctactagttacgtgggacagttccggtaacccgggacggtcccgggttccctgaacccgtattccgaggacggccgaggtccggggtactgggaacctacggtactttccgtactcctacccacgtaactccaacccgtacctagccgtagggtcctaaggaaacgtgttacgggtcggtaacgtttaacggttttaacgtttaccgttacggttacgaacgtaccgttaaaacttaaccgtaacgtttacccgttacccttcccgttcccgttaaccggacccgggttttccggggacggggttaaacccgggaacggttaacgggttacgggaacgtaacgtaaccctaaaacgggttacgtacggttcggtaccgttccggaccctaacctacgttacgttaccgtttacctcttaaccttcccgttaccgtacccgttntaccgtaccgtaaccttagttaaccccgg

SEQ ID NO: 52832 - DNA, 831 bp, Homo sapiens
  misc_feature: GYAE6OF02HPJ2J.18.11.A11.1.454.CMB.1.raw
  modified_base (224)..(224): a, c, t, g, unknown or other
  misc_feature (224)..(224): n is a, c, g, or t
tcagtacgagtatgcacgaccggtgctcgatttagctacgactgcaggggcagcaagatggtgttgcagacccaggtcttcatttctctgttgctctggatctctggtgccggacggggacatcgtgatcgacccagtctccagactccctggttgtgtctcgtgggacgaggagggccaccatacaacgtcgacaacgtccagaccagtagtttgtttttaanacgagtaccttaccaaaacaaacttaaaacctaaccttaacttaacggtctttacgggtaacccaagaccaaacggaaaacccgtaacggaaccgtaacccgtacccccccgttaaaagggttcccccttaacttaacgttttacggtcgggaccttaacgttacccggtaaccccgggggtacggttccccgggggttaccctaacggaccgtagttaccggaaggaccggtacgacgggtccgggttacgtacggggaacctaaggttactttacccgaacgtttcccgtaaccgaaccttaaccgtacccaaaccctaaccgtcgaccggtaacgtcttaagggaacttacggtggtaccgttaacgttaaggttttaacttacgttacgtacgtaacgtaacttaaaacgttcttaaacgttaccgttacccttaccgttaccgttaccggttaccggtttaaccggaccgggggtaacggtaaaccggtacgggtaacggtagtaaccgtaaacgaaacggttacgtggtcggacttcgaccgtacgtacttaccttgtaccttactaccgtcctacccgtctacgtactacgtacttaacg

SEQ ID NO: 52833 - DNA, 909 bp, Homo sapiens
  misc_feature: GYAE6OF02H7RCM.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtgccggacggggacatcgtgatcgacccagtctccacgactccctggttgtgtctcgtgggcgaggagggccaccattcaactgcaactcacgccagtagttagttttatacgacgcctaccaaacaaataaacaacttattacgtcgttaggtaccagacacgaaacacggacaccgaccccgtacgtaccttactacgtttacgtgggtaccacgtaccccgtaacccgggtcgggttaccccggggtcccgtaccggacccggttacgttaccgaacggacggtacggacgggtccggggttaccggagggtaccgaggtttacgtttaccacccgtttcctaaccccaccgtaactacccgtaaaccctaaccgtccggtaccgacgggtaccgtacgggaacgttacgttacgggttacggttaaccgttttacggttttttaacgttaaccgttcggttaaccgaacgtaaaccgttaacttttaaacccgttaacccggtttaaccccgttaccccccgtttccggttacccgggtttaacccggggttaccgggggtaaaccccggggtaaccgggggttaaaccggtaacccggggggtaaaggacccgggttaaacctaaaccgtaaaaccggttaaccgggttaggttaacccggttccggttaacccggaccccgtaccgttaaccgtccggttttaacccggtccttttaacccgttacccctttcccccgttaccccggtacccttaccggttaccccgtttaaccgggactttaaccccgttaacgg

SEQ ID NO: 52834 - DNA, 542 bp, Homo sapiens
  misc_feature: GYAE6OF02GDWJ3.18.11.A11.1.454.CMB.1.raw
  modified_base (498)..(498): a, c, t, g, unknown or other
  misc_feature (498)..(498): n is a, c, g, or t
  modified_base (512)..(512): a, c, t, g, unknown or other
  misc_feature (512)..(512): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagttgttttatacagctaccaacaataacaactacttagcttgtaccagcagaaaccaggacacgccccctaaggtcctcatttactggcatccgtacccgggagtcccggggtccctgaccgattcagaggcaggcgggtctgggacagatttcactctcaccatccaccaacctgcacggctagaagatggtgctagttttatactgtcagctaatactatacgtccttcctctcgtacgttcgggacggacgggaccgtaagggtgaacgtatacgaaacgtactggtgctgcaccnttcttgtccttacncttccgttccccgcctatccgtacactacg

SEQ ID NO: 52835 - DNA, 765 bp, Homo sapiens
  misc_feature: GYAE6OF02F35QE.18.11.A11.1.454.CMB.1.raw
  modified_base (200)..(200): a, c, t, g, unknown or other
  misc_feature (200)..(200): n is a, c, g, or t
  modified_base (210)..(210): a, c, t, g, unknown or other
  misc_feature (210)..(210): n is a, c, g, or t
  modified_base (299)..(299): a, c, t, g, unknown or other
  misc_feature (299)..(299): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctcgtgggcgagagggccaccatcaactgcaagtccagccagngttgttttanacagctaccaacaataacaactacttagcttaggtaccagcaagaaacccagggacacgaccccctaaaggtccctactactttaacgngggtacctacgtaccgtaaccccggggtaggttccccggggtcccctacggaacccgtagttccgaaggtacgggaccaacgggtccggggttaccggttacggggaacctaaggttacttttaacccgaaccgttcctacccggaaacctacgttacccaaacccgtaaacccgtcggaaccgtacgggtacctaacgggaaaacggtcgttacgggtacggtaccgtttaagtttttaaacgttaaccgttacggttacgtaaccgtaacgttaaaactaccgttaagttaaccggttcccttaccctacgtacgtaccggtttaccgggacgggtaacgggaacgtaacggggtacgaacgttaagtaaccgtaaaacgtacgtggtaccgactacgaccgtacctacgttacttacgttccttactaccgttccttacccgactacgtaccgtacactaacg

SEQ ID NO: 52836 - DNA, 712 bp, Homo sapiens
  misc_feature: GYAE6OF02FNZR0.18.11.A11.1.454.CMB.1.raw
  modified_base (215)..(215): a, c, t, g, unknown or other
  misc_feature (215)..(215): n is a, c, g, or t
  modified_base (218)..(218): a, c, t, g, unknown or other
  misc_feature (218)..(218): n is a, c, g, or t
  modified_base (303)..(303): a, c, t, g, unknown or other
  misc_feature (303)..(303): n is a, c, g, or t
tcagtacgagtatgcacgaccggtgctcgatttagctacgactgcaggggcagcaagatggtgttgcagacccaggtcttcatttctctgttgctctggatctctggtcgccggacgggacagtcgtgatcgacccagtctccagacctcccgtggttgtgtctcgtggacgagacgggccacatcaacgtgacaacgcagcagtagttgtttanacnacctaccaacaactaacacttatcgctacgaccagaccaagaaaccaggtaccaccgaccccttaaggtccctctaacgtttcgnggctacgtacccgtaacccgggggtacggtccccggtccgacgtaaccgtacttacgacggtaacggcaacggggtccgggtacgtacgggtaactacggttaacctttcctaacgtccctaccgaactactaccgaaaccctaccgtcgaaagcggtacaagtacggtacgttcggacggttaacttaagttttacgtacgttacgacttaaacggaacttaaccgtaacgttaaccggtcctccccttcgaacgtttccgaacgggtttccggaacgggaccggtaaacgtagggtacgaacgtaacgtaacccgaaaagttcgggtcacgggtaccacccgactacgtcttacgttccgtaccttacctccgttccctacccgtaatcgtttacgacagttacccg

SEQ ID NO: 52837 - DNA, 681 bp, Homo sapiens
  misc_feature: GYAE6OF02F63QC.18.11.A11.1.454.CMB.1.raw
  modified_base (214)..(214): a, c, t, g, unknown or other
  misc_feature (214)..(214): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtactccagactccctggttgtgtctcgtgggcgaggacgggccaccatcaacgtgcaacgtccagccagagttgtttanacagctaccaaacaactaacaactacttagcttggaccagacaagaaaccagacgacgaccccctaaggtccctactacttacgtggcacgtaccgtacccgggggacgtcccgggggtccctacggaccgtattacgaggacggcgacggtcgggtcgtcgggacgtacggtattccactctaccacactaccaaccacgtcgcgacggctacgaagagttggtcggtattacgtttactttaacgtcgtacactaccgtaattctaacgttaccgtccttccttaccgtccggtaccggtccgggacgggtaacggaacgtagggttacggaactacgtaacggtaaacacggtcgtacggtaccgtgtaacccgtactaacggttccgttaccgtttcgttaccctttaccgttccccgtttaccccgtaccttaccgtttaccgtaccgttaccctaacccgg

SEQ ID NO: 52838 - DNA, 987 bp, Homo sapiens
  misc_feature: GYAE6OF02I34FB.18.11.A11.1.454.CMB.1.raw
  modified_base (222)..(222): a, c, t, g, unknown or other
  misc_feature (222)..(222): n is a, c, g, or t
  modified_base (239)..(239): a, c, t, g, unknown or other
  misc_feature (239)..(239): n is a, c, g, or t
tcagtacgagtatgcacgaccggtgctcgatttagctacgactgcaggggcagcaagatggtgtgcagacccaggtcttcatttctcgtgttgctctggatctctggtgccggacgggacatcgtgatcgacccagtctcagtacctccgtggttgtcgtctcgtggcgaggacggccaccatacaacgtgactaacgtccaagccagtagttacgtttaanacgtacgcctaccaaanaactaaactaacttacgttacgtacttacggtaaccaggacctaaacggaaaccgaggtaaccaccgtaacccccgttaacggtccctacttagtttaacgtcggtactaacgttaccggtaacccggggtcggttaccccggggtacctacggtaaccgtacttacgaacgggtacggtacgtagggtccgggttacgtaacgggtacgtaaggtacctttacccgaccttaccgtaaccgtaaccctaacgtaacccgaaccccgtaaaccgtcggtaacccggtaagggtacccgtaagggaaacgtttacggggtttaaccggtaccggttaaaccggttttaaaacggtttttaacccgtttaacggttaccggttaaacccggagttaaaaccctttaaaacggttaaccgtttaaacgtttaccccgggttaccccttacccgttacccggtaaccggttaaaccccgggggtaccggggttaaaaccgggggtaccgggttaaacccgggttaaacggggtaaccgggtaaacccgttaaacgttaaaaaccccgggtaaaccgggtttaaacccggttgggttaaacccggggttcctaacccggggtaacccctttaacgggttccgtttaccggttaacccgtttttaccgaccccgttttaaaccgtaccccccggttttaacccccggaacttaaccggtttaaccccgtttacgtacccgttttaaaaccccgg

SEQ ID NO: 52839 - DNA, 693 bp, Homo sapiens
  misc_feature: GYAE6OF02HB68C.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtgccggacgggacatcgtgatcgacccagtctccagacctcccgtggttgtgtctcgtgggcgaggacgggccaccatacaactgacaacgtccacgccagtagttgttttaacacagtcctaccaaacaaactaaacaacttacttagctttacggaccagacaacgaaaccgacggaccaccgtaccccctaaggtcctactactttacgcggctacgtccggtaccgggcggtcccgggtcctacgaccgtattcgaggacggcgtacgggtcggtcgaggacagttactttcacttccaccaccgtactaccaaccctaactgacgacggtctagaacgtacgtcgtacggtactttaggtttactacgtacgtacgtaacgtaattaactacttacttaccggttcccttcccgttactacccgtacgggtccgggaacgggaacggtaacggtaggggtacgtaacgacgttaaaccgaaacggttacgaggttcgcttaccgactaaccgtcttacgttacttaccgttaccgtacgtttcccccgtacgtacttaccgttacgtaccgtaccttaacg

SEQ ID NO: 52840 - DNA, 648 bp, Homo sapiens
  misc_feature: GYAE6OF02HJN17.18.11.A11.1.454.CMB.1.raw
  modified_base (496)..(496): a, c, t, g, unknown or other
  misc_feature (496)..(496): n is a, c, g, or t
tcagtacgagtatgcacgaccggtgctcgatttagctacgactgcaggggcagcaagatggtgttgcagacccaggtcttcatttctctgttgctctggatctctggtcgccggacggggtacatcggtgatcggaccctagtcctccagtaccttccgtggttgtgtctcgtgggacgaggacggccacctatcacgtgctaacgtccacgaccaggtcgtttagttttaacacacgtacctacctaaaacaaacttaaacctaacttacgttacgtcgttacgtaaccagacaacggaaaccagaccaccgtaccctacgtcctactacgttacgcggactacgtacccggtaccggggtcggtcccgggtcctacggaccgtactacgaggacggcggtacggtcgggtacgacggactagttcttacgtctcacacctactaccaaccacgtcgacgagactagaacgtgtggtactacttagtttactacngtacgaatactaactactattccttcgtcctgtaccgtcgtcggacggtacgaggaacggtgaactcgaacgtaacgtgtggctacgccgacgtactcgttctacttaccgtctaccgttcccacgttacctaacgttcgacgtaactccgg

SEQ ID NO: 52841 - DNA, 591 bp, Homo sapiens
  misc_feature: GYAE6OF02F42EQ.18.11.A11.1.454.CMB.1.raw
  modified_base (214)..(214): a, c, t, g, unknown or other
  misc_feature (214)..(214): n is a, c, g, or t
  modified_base (359)..(359): a, c, t, g, unknown or other
  misc_feature (359)..(359): n is a, c, g, or t
  modified_base (499)..(499): a, c, t, g, unknown or other
  misc_feature (499)..(499): n is a, c, g, or t
  modified_base (569)..(569): a, c, t, g, unknown or other
  misc_feature (569)..(569): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagacctccctggttgtgtctcgtgggcgagagggccaccatcaactgacaagtccagccagagtgttttatacngctaccaaacaactaacaactacttagccttggtaccagacaagaaaccaggacacgaccccctaaggtcctctatttactgggacagtaccgtacccgggacgtcccggggcccctagaccgattcgagacggcaggccgggtntaggacagtattcactctccaccatccaccaacctgacaggcctaggaagctggtgtactagtttacttactgtacagtacaatacgtatacgtcccttcgtcctcgtacgttccgggacggtacggaccgaaggtaganacgttacgaaaccgacgtgtcggctacgtacaccgttaactcttacgtccttctaccttcccgttacccncctacttctaccgtactaaccg

SEQ ID NO: 52842 - DNA, 679 bp, Homo sapiens
  misc_feature: GYAE6OF02GNNVE.18.11.A11.1.454.CMB.1.raw
  modified_base (387)..(387): a, c, t, g, unknown or other
  misc_feature (387)..(387): n is a, c, g, or t
  modified_base (461)..(461): a, c, t, g, unknown or other
  misc_feature (461)..(461): n is a, c, g, or t
  modified_base (519)..(519): a, c, t, g, unknown or other
  misc_feature (519)..(519): n is a, c, g, or t
tcagtacgagtatgcacgaccggtgctcgatttagctacgactgcaggggcagcaagatggtgttgcagacccaggtcttcatttctctgttgctctggatctcgtggtcgccgacgggtacatcgtgatcgacccctagtcctaccagactccctgttgtgtctcgtggcgagacggtccaaccatcaactgccaagtccagccagtagttagtttttacaccgagccttaccaacaaataaccaaacttacttagacctttggtaacccagctaacggaaacctagggaacacgccccccgtaaggtccctacaatttacgtacgggtcagttcctacccggggtacgttaccccgggtccctacggtaccgactttcgaacggnggtaccagggtaccgggtgtcggggacagttacttacgactcctccgacactcaaccaccgtgcaggcagaagntcgtgtactagtttattactggttacagtactaatacgtattaacggttcctcgttcncccgtacggttccgggacggaacgggaccctaaggggtaacgacggacttaaccggtaaaaccgtacgttacgacggtcctacgggccaacctaacgttctcggttaacttccgtaactttccccgtcccgtaccttaccgtctacggtacccttaaccg

SEQ ID NO: 52843 - DNA, 721 bp, Homo sapiens
  misc_feature: GYAE6OF02GTAJ2.18.11.A11.1.454.CMB.1.raw
  modified_base (235)..(235): a, c, t, g, unknown or other
  misc_feature (235)..(235): n is a, c, g, or t
  modified_base (714)..(714): a, c, t, g, unknown or other
  misc_feature (714)..(714): n is a, c, g, or t
tcagtacgagtatgcacgaccggtgctcgatttagctacgactgcaggggcagcaagatggtgttgcagacccaggtcttcatttctctgttgctctggatctctggtcgccgacggggacatcgtagatcgacccagtcctccgagtacctccgtggttgtgtctgtgggcgagcggccaccatccaatcgacaacgtccagccaggtagttgtttacacagtcctacccaaanaaactaacctaaccttacttacgtccttacggtaacccagtccaaacggtaaaaccgaggacctaaccggtaccccccgttaaaggtccccttacgtactttaacggtcgggacctacggttcccgtacccgggggtacggtcccggggttaccctacggaccgtacttcgacggacgacggtacggtcgggtacggtacgggacaaggttacttacgtaccttcgtacccaacgtactacccgtaacccaacgtcggacccgtaacggctaacgaagtcgtcggtagtactagtttactaccgttgacgtactacgtaactacgtacttacgtaccccttctaccgtacgtaccggtcgggaccggaacggtaaccagggtacgtagtaactaacgaaacgtacgtaggtcgccgtacgtactacgtaatccttacgtccgttacctccgtacccttcccgtacctacgtctaccggnttaaccg

SEQ ID NO: 52844 - DNA, 686 bp, Homo sapiens
  misc_feature: GYAE6OF02G9P5B.18.11.A11.1.454.CMB.1.raw
tcagtacgagtatgcacgaccggtgctcgatttagctacgactgcagggcagcaagatggtgttgcagacccaggtcttcatttctctgttgctctggatctctggtgccgacggggacatcgtgatgacccagtctccagctcctggttgtgtctcgtgggcgaggacgggcccacctatacgaactggacaacgtccacgccaggacgttagtttttacacgacgtcttaccaaacaataaccaacttctagtcttcggacctagcaacgaaacaggaaccacgtaccccgtaggtcctataattacgtgggctaaggttcccgaacccgggttacgtcccggggtacctgaccgtattacgacggacgtcgaggtccggtgcgggactacggtactcacttcgacacgtaccacctaccgaacgtcgacggactaccgagaacgtcgtacggttcgtacgtttaagtttacgcgttaactgtacgtactaacgtcttacgttaacgttctcccgtagttccgacgggtacgggtacggtaccgggaaagtggaccgtaagtaccgaaacgtacgtaacgttggacgtttcgacgttaactaccggtcttaaccggttcgtaaccgtttctaccccggttaaccctcccgtacccgttactaccgtacgtacctttaaacccgg

SEQ ID NO: 52845 - DNA, 807 bp, Homo sapiens
  misc_feature: GYAE6OF02GNP1D.18.11.A11.1.454.CMB.1.raw
  modified_base (211)..(211): a, c, t, g, unknown or other
  misc_feature (211)..(211): n is a, c, g, or t
tcagtacgagtatgcacgaccggtgctcgatttagctacgactgcaggggcagcaagatggtgttgcagacccaggtcttcattttctctgttgctctggatctctggtgccgacggggacatcgtgatcgacccagtctccagactccctggttgtgtctctggcgagagggccaccatcaactgacaagtccagccagagttgttttanacagcctacaaacaaataaacaactacttagcttacggtaccagacacgaaaaccaggaaccaacgaccccctaaaggtccccttctaacgtttacgtcgggactacgtaccgtaccccgggggacggtacccggggtaccccgtacgacccggtagttccgacgaggtaccgagggtcgggtcgtgggacagttacgtttcaccttctaccacctactaccaacccgaaaccgtgaccgtaacggtcgtaacggaaagtgtaggcggttacgttaaagtttttacttaaccgttaggtaacctaggtaacttaaaccgttaacttaacgttaccgttttacccctttacccgttacccgtttaccgttaaccgggtttaccgggaccggggtaaaccgggttaaccggtaaaggggttttacggaaaacggttaccgtaaaccgttaaaaccgggtaaacgttacgggttcgtaccgtacgacccgtaaccgttaacgttacccggtttcggttaaccctttaaccgttacccgtttcccgtttaccccccggtaccttaaccggtttacccgtaacgttaacccggtttaaacc

SEQ ID NO: 52846 - DNA, 786 bp, Homo sapiens
  misc_feature: GYAE6OF02FQVKZ.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtgccgacgggacatcgtgatgacccagtcctccagacctcccgtggttgtgtcctcgtgggacgaggacgggccaccatacaacgtgcaacgtccagaccagtacgttgttttacacagtcctaccaaacaataaaccaacttacgttacgcgtttacggaacccagtaccgaacggaaaacccaggaacccaccggtaccccccgttaaggtcccctactacttttacgtcgggtcctaacgttcccggtaccccggggtacggtccccgggggttacccctacggaaccgtactttaccgaggacgacgtaccgggtcgggtcgtacggggactaacggttactttaccgaccttaccgtccaacctacgtaaccctaaaccctaaccgtcgaaccgtacggtacgtaacggtaagtacgtacggtacggtacgttaacgttttacgtttaacgtgtaccgaacgtacctaaatacgttagttaacccgtcccttccttcgaccgttacgggtacgggaccggtaacggaaccgttaggggtacgaaacgtcgtaaacgtaaaccggtaggttcggtacgtacgtacggaccttacgtccgttcttaaccggttcccttaaccgttaccgttccccgtttaacccgtaccgttaaccgtcgtaacgtcccttaacgg

SEQ ID NO: 52847 - DNA, 832 bp, Homo sapiens
  misc_feature: GYAE6OF02GGIKF.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtcgccggacggggacatcgtgatcgacccagtcctccagtacctccgtggttcgtgtctcgtcgggacgaggacgggccacatacgaagtcgactaactccgagaccaggtagtttacgtttaacaacgtacgtcctaaccaaactaaactaaacctaacttacgttacgtccgtttaggtaccaagaacctaacgaaaccgaggaacctaccggtacccccgttaacggtcctactacgtttacggtcgggactaccgtacccgggtaccgggtaccgggtcccggggttaccctacggtaccgtaacttaccggaaggcgggaccgtagggttaccgggtcggtaacgggtactacggttacttacccgtactacccgtacctaaccgtaactacccgaacctaaccgtcgaccgtagtactaacgagttagtcggtcggttaactttacgtttagtacttcgaactacgtactaacgttacgttaacgttccgttccgttacttacgtacccggtacggtaaccgggtcgggtaaacggtaccgggtaaacggtacggttaaacgtaaccggtaaacccgttaaagtacggttaacgggtttacgggaacctcggttaacccttaccgttaacggttccgttttacccgtaaccgtttaaccgttacccggtttccccgttaacggtacccttacgggtttactaacaccggttttaacccg

SEQ ID NO: 52848 - DNA, 704 bp, Homo sapiens
  misc_feature: GYAE6OF02ILBI5.18.11.A11.1.454.CMB.1.raw
  modified_base (206)..(206): a, c, t, g, unknown or other
  misc_feature (206)..(206): n is a, c, g, or t
  modified_base (338)..(338): a, c, t, g, unknown or other
  misc_feature (338)..(338): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtcagccagagtgtttanacagctacaacaataacaactactagcttggaccagcagaaaaccagacagccccctaaggtcctcaattaactcgggcaatcctaacccgggagtcccggggtccctcgaccatcaggacgcagcgggtcngggacagactttcactctacaccatacaccaacctgacacggtctacggaagtaactggtaggtacgttaagttttaagtttacctttacgaagactaaaacttactaagttaacgttcccttaccctccttacggtaaccggtttcgggaccgggtaacggggtaacccgaaaggggttcggaaacgtaacgtaacccgaaaaaccgtaaacggttcgttacgggggtacccttagggaccctaaaccgttacttacccggttacgggtttacccgttttaacgtaacccgtttacccggtttaccccccggtaaccggtaacctttacccgttaccggtaaacccgtaacgtttaaaccccggg

SEQ ID NO: 52849 - DNA, 780 bp, Homo sapiens
  misc_feature: GYAE6OF02IQLM4.18.11.A11.1.454.CMB.1.raw
  modified_base (557)..(557): a, c, t, g, unknown or other
  misc_feature (557)..(557): n is a, c, g, or t
tcagtacgagtatgcacgaccggtgctcgatttagctacgactgcagggacagcaagatggtgttgcagacccaggtcttcatttctctgttgctctggatctctggtgccggacgggacatcgtgatcgacccagtctcagacctccgttgttgtgtctcgtgggcgagacggccacactacaactgacaagtccagccgagtagttagtttatacacgcctaccaaacgtaactaaactaacttaacgttacgtacgttacggtaaccacgactaacgaaaaccgacggaaccaaccgtaccccctaacggtcccttactaatttaccggtggtacctagttacccgtaccccggggtacggttccccggggttaccctacggtacccgtttaagtccgaacggcggacgtacgggtcgggtacgtagggaccgtaagttaccttaccgaccgttcctaccaaccgtactacctaacccgaaccgttcgacggtacgtactaacgtaaggtaggtacgtaggttaccgtaagtttttaacgtcgttgaaccgtanaacgttaactaacggttacctttaaccgttcccgttaccgttccgtacgttaaccgggacggtaacgggtaaccgggtaacggtaacggtacggaacgttaacgtaaaccgtaaacggtactccgggttagtaccgtcgaaccgttccgtaacgttccttcggttacccttaccgttaccgtcccgttcccgtaatccgtttaaccgtactaacttaacccgg

SEQ ID NO: 52850 - DNA, 757 bp, Homo sapiens
  misc_feature: GYAE6OF02I21UV.18.11.A11.1.454.CMB.1.raw
  modified_base (173)..(173): a, c, t, g, unknown or other
  misc_feature (173)..(173): n is a, c, g, or t
  modified_base (217)..(217): a, c, t, g, unknown or other
  misc_feature (217)..(217): n is a, c, g, or t
  modified_base (487)..(487): a, c, t, g, unknown or other
  misc_feature (487)..(487): n is a, c, g, or t
  modified_base (702)..(702): a, c, t, g, unknown or other
  misc_feature (702)..(702): n is a, c, g, or t
tcagtacgagtatgcacgaccggtgctcgatttagctacgactgcaggggcagcaagatggtgttgcagaccccaggtcttcatttctctgttgctctggatctctggtgccgacggggacatcgtgatcgacccagtcctccagctccctggttgtgtctcgtgggcgaggngggccaccatcaactgctaacgtccagccgaagagttgttttanactagtcctaccaaactaaagtaaacctaaaccttaacgttaagccgtttaggtaacccaggaacaacgaaaccgacggaaccaccgaacccccgtaaggtacccctacgtactttaacgtcgggactaacgtaccgtaaccccggggtaccggttcccgggtcccgtacggtacctaacgttccgaaggaacgggactacggggtcgggtaccgtagggaaccgacggttaatttccgaactccttaccactattacccaccgtaaacncgtacgacgtccgtaaggaaacgtgtagggtacgtagttaacgtttacttacgtcgtgtaacgtactaacgtaaccgttagttaccttaccttccctacttccggtaaccggtttccgggacgggtaaaccgggtacggtaacggtacgggtaacggtaacgtaaccgaaacggtaaacgtccggtagtcgtaccaacggtcctatacccggttntaccgttacctcgtttaccccgtccgtaaccttaccgtgtttacccgaataccgg

SEQ ID NO: 52851 - DNA, 850 bp, Homo sapiens
  misc_feature: GYAE6OF02GQEJ9.18.11.A11.1.454.CMB.1.raw
  modified_base (200)..(200): a, c, t, g, unknown or other
  misc_feature (200)..(200): n is a, c, g, or t
  modified_base (415)..(415): a, c, t, g, unknown or other
  misc_feature (415)..(415): n is a, c, g, or t
tcagtacgagtatgcacgaccggtgctcgatttagctacgactgcaggggcagcaagatggtgttgcagacccaggtcttcatttctctgttgctctggatctcgtggtgccggacggggacatcgtgatgacccagtctccagtacctcccttggttgtgtctccgtggggcgaggacgggcccaccgatacaacgttncgtaagtccagccgaagtggttagttttacgacagtaccttaccaaaacaaacttaaaccggtaaccttacttaagtacctttcgggtaaacccagaccacgaaaaacccaggttaacccaaccgtaccccccggttaaaggttcccctaactaacgttttaccggcgggtacaacgtttacccggtacccggggtacggtcccggggtttaccnccggtaacgtacgtttcgaagggtccggaacgtcgggtaccggggttacgtacggggaaacctacggttaacttccttaacctcggttaacctaccgtaacttcccggaaaccctaaacttccggaactacgggtctaacggaagtcgttaaacgggtcgtaacgtttaaggttttaaaccgtcttcggtactacggtaaccttaaattaccggttaacgttacccgttcctccgttacttacccgggttaccggtaccgggagggtaaccgtaacgtaacggggttaccggaacgtaaacgtaccggaaaaacccgttggttccggtacggtactacccggtactaacccgtggttaaccttccggtttaacttaccgtaacccggttttccttacccgggtaacctccgttacggttaccgtaacttaacccg

SEQ ID NO: 52852 - DNA, 933 bp, Homo sapiens
  misc_feature: GYAE6OF02FXR3Y.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtgccgacggggacatcgtgatgaccagtcctccacgactccctgttgtgtctcgtggcgagaggccacactacaactgacacgtccagacagtacgttgtttatactacgctaccaaacaaactaaactaaaccttaacttacgtccgtttaggacctaggaacaacggaaaccgaacggaacctaaccggtacccccgtttaaacggtaccccttattacgtttaaccgtagggacctacgttacccggtaaccccggggtaccggtaccccggggtttaccccgtacgtaacccggtaacttaccggaaggtacgggtacccgtacgggtccgggtaaccggtacgggtacgtaacggttacctttactaccgtaccctacccaaaccgtaaccgtaaccctaacccgtaaacccgttacggaaccgtaacggtaccgttaagggtaaaccgtttaacgggttacggggtttaacgtttaaacccggttttaaaggtttttaaacctttaaccggttaacccggagtttaaaaccggttaaccgttaaaaaccgttttacccggtttaaacccgtttacccgggttttacccctttaacccgtttccccggtttaaacgggtttccccgggtttaaacccggggtaccgggggttaaacggttaaccggttaaacgggggtaacgttaaccggttaaacgtaaacccgtaaacggttacggttacgaccggttacgacgttaaccgtacttaaccgtcctttagttaacccttagtacccttccgttaccctacgttacccgtacgtacgttacccgttaacgg

SEQ ID NO: 52853 - DNA, 966 bp, Homo sapiens
  misc_feature: GYAE6OF02HA9Y8.18.11.A11.1.454.CMB.1.raw
tcagtacgagtatgcacgaccggtgctcgatttagctacgactgcagggcagcaagatggtgttgcagacccaggtcttcatttctctgttgctctggatctctggtcgccgacggggacagtcgtgatcgacccagtcctaccagacctccgtggttgtcgcctcgtgggcgaggacggccacactacaactcgacaagtccgagccgaagtagtttgttttaactacacgtacctaaccaaacaaaactaaacctaaacttacgttaagtcgttacggaacctacgacgaacgaaaccgaggaccaccgtaccccgtaacgtccctactacttacggcggactacgtaccggtacccgggtacgggttccccgggtcctcgaccgtatcgaggcgacggacggtcgggttcgacgggtacctagttacgtttctaacctcctaccgacctaactacccgtaaacccgtaacctcggaaccgtacgggtccggttaacggtaaacgtgggtttaccgggttaacggtaaccgttttaacggttttttaacgtttaaccggttacggtaccgtttaaacgaaccgtttaaacgtttaaacctttaaccggtttaaacccgttttcccccgttaacccgtttccgttaacccgggtttaacccgggggtttaccgggtaaccggggggtaaaacccggggttaaacccgggttaaggggggtttaaaacccggtaaacgggtttaaaaccccggtaaaacgggttaaaaccccggggtaaaccgggttttaacggggtaacccggtaaccccgtagggtttaacccccaaccgggtttaacccgtttaacccggttttaaccggttcccgtttttaaaccccttcccggtttttaccccccgtacccccgttaaactcccggtttttaaaacccggttacgttaaacccggttttaaccccccgggg

SEQ ID NO: 52854 - DNA, 763 bp, Homo sapiens
  misc_feature: GYAE6OF02HZYDO.18.11.A11.1.454.CMB.1.raw
  modified_base (62)..(62): a, c, t, g, unknown or other
  misc_feature (62)..(62): n is a, c, g, or t
  modified_base (192)..(192): a, c, t, g, unknown or other
  misc_feature (192)..(192): n is a, c, g, or t
  modified_base (229)..(229): a, c, t, g, unknown or other
  misc_feature (229)..(229): n is a, c, g, or t
tcagtacgagtatgcacgaccggtgctcgatttagctacgactgcaggggcagcaagatggngttgcagacccaggtcttcatttctctgttgctctggatctctggtgccggacggggacatcgtgatcgaccccacgtctacccagacctcccgtgggttgtcgtctcgtgggcgaggacgggccaccanacctaactcgcacgtccacgaccagtagttgttttanacacgtcctaccaaccaaataaacctaaccttaacgttaacgtcttacggtaccaacgcgaaacgaaaccgaacggaaccaccggtacccccgtaacggttccttaacgttactttacgcggacctacgtacccggtacccgggaccggttccccggggtccctacggtacccgtacgtcgacgggacgacgcgggtcggtacgtacgggaactagttaccgtttacgacttacgtacctacctactacccgacctacacgacgaggtaccgtacgtaggtatacggtcggtacgttaagttttacctacgtacgtacgaagtacctaagttaaccttaattaccgttcccttaccgtacgtaccgtaccggttaccggggcgggaaacgggtacccgtaagggtacgtaacgtaacgtaaccgttaaaccggtacgttacggtaggtccctaccgacaaccgtcgttaccttacgttccgtaccggtaacttcccgtacccgttactacccgtacgtaccgtaccttacccgg

SEQ ID NO: 52855 - DNA, 672 bp, Homo sapiens
  misc_feature: GYAE6OF02FPOYW.18.11.A11.1.454.CMB.1.raw
  modified_base (207)..(207): a, c, t, g, unknown or other
  misc_feature (207)..(207): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactcccgtggttgtgtctctgggcgagagggccaccatcaactgcagtccagccagagtgtttanacgagctaccaacaataacaactacttagcttggtaccagcagaaaccaggacagaccccctaaggtccctctacttactgggctagtccgtacccgggacgtccggggtcctacggaccgattcgagacggcgaggcgggttcgtgggaacgtacggactttaccgaccttcgtcctaaccactacccaacccaaccgttcgacccggtaaggtaccgttaggaaacggtaagttcggtacggtaccgttaagttttaacgtttactcggttaaccagtacctaaataccttagttaacctcccgttaccctcgttacgtaccggttacgggcgggaaccgggtacgaaggggtggaacgtagtaaccgaaaggtaccgtgtacggacttccggcaaccgtactacgttcttccgttactacgttaccctaccccggtacctagttacctaccgtaccttaacg

SEQ ID NO: 52856 - DNA, 940 bp, Homo sapiens
  misc_feature: GYAE6OF02HFA34.18.11.A11.1.454.CMB.1.raw
  modified_base (88)..(88): a, c, t, g, unknown or other
  misc_feature (88)..(88): n is a, c, g, or t
  modified_base (125)..(125): a, c, t, g, unknown or other
  misc_feature (125)..(125): n is a, c, g, or t
  modified_base (227)..(227): a, c, t, g, unknown or other
  misc_feature (227)..(227): n is a, c, g, or t
tcagtacgagtatgcacgaccggtgctcgatttagctacgactgcaggggcagcaagatggtgttgcagacccaggtcttcatttctntgttgctctggatctctggtgccggacgggacatcgngatcgaccctagtctccagacctcccgttggttgtcgtcttcgtgggacgacggaggaccaccatacaactgcaacgtccgacgacagtagttagtttttanacacggtcctaccaaactaaattaaaccaacgttaaccgttagtccgttacggtaaccacgtacgaacgtaaaacccgaggaaccgtaaccgtaccccccgttaaaggtcccttacgttaacgttttaccggtacgggtacctacgttaaccccgggttacccccgggggacggttacccccgggggtaccccgtcccggttaaacccgggtaccgtttaaccggacgtaaccggggacgtaccgggggttacccggggtacggttaacggggaactaaaccgggtttacttttaccccggtaaacccttccttaaacccggaaccctttaaccctaacccgtaaccccgtaaaccgtcgggaccgtacggtaacccggtaacggtacgtaacggtcggtacggtaacgttaacggtttaccgttaaccgtcggttaccgaagtaaccgtaaacgttaacttaaccgttacccgtttcccgttacccgttccggttaaccgtacccgggttaaccgggtaccgggtaaaccggtaacccgggttacgggtacggtaaacgttaccggtaaaccggtaaaccgtacggtagggttaccgtacgtacgacccgtaacccgtacgttaccgttacggtttacccttaacccggttaccgtttacccccgtaaccgttaccgttacccggtaccgttacccgtaacgtttaaccccg

SEQ ID NO: 52857 - DNA, 747 bp, Homo sapiens
  misc_feature: GYAE6OF02F6CEB.18.11.A11.1.454.CMB.1.raw
  modified_base (216)..(216): a, c, t, g, unknown or other
  misc_feature (216)..(216): n is a, c, g, or t
  modified_base (296)..(296): a, c, t, g, unknown or other
  misc_feature (296)..(296): n is a, c, g, or t
tcagtacgagtatgcacgaccggtgctcgatttagctacgactgcaggggcagcaagatggtgttgcagacccaggtcttcatttctctgttgctctggatctctggtgccggacggggacatcgtgatgacccagtctccagacctccctggttgtgtctcgtgggcgaggagggccaccataccaactgcaacgtccagccagagttgttttanacagctaccaacaactaacaactacttagcttgtaccagcagaaaccaggacacgaccccctaaggtcctacatttacgnggctatcccgtacccggggacgtcccggggtcccctggacccgagttccgaggaggcgaggtcgggtcgtgggacagtacttcactcctccgacctactccacctaaccgtgaccgaggtacctaggaacgtagttcggtacggactttacgttttaagttcggtaccttaggtacgacggtaacctaacgttaaaccttaacgttcccggtttaaccccttcccgttaccgttacccgttaccgggtttacccggggtaccggggtaaccgggtacccggttaaaaggggtccgggtaaagttaaaccgtaaacgtaaaacccgtaacgggttacggtccgggtacgttaccgaccgaacccgtaccggttccggtttaaccgttcccgtttaacccgtaccgtttcccccgttaacccggtccttaacgttacccgtagttaaaccccg

SEQ ID NO: 52858 - DNA, 773 bp, Homo sapiens
  misc_feature: GYAE6OF02F2FD2.18.11.A11.1.454.CMB.1.raw
  modified_base (207)..(207): a, c, t, g, unknown or other
  misc_feature (207)..(207): n is a, c, g, or t
  modified_base (210)..(210): a, c, t, g, unknown or other
  misc_feature (210)..(210): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagcagagttgtttanacngctaccaacaataacaacttacttagcttaggtaccagacaagaaccaggaccacgaccccctaaggtccctactatttacgtgggaccacgtcccgtaccccggggtacggtcccccggggtcccctacggaacccgtattaccgacggacggcgacggccggggttcgtacgggacgtaacggtacttttaccacgttacctccgaacctactacccaaccctaacccgtacgaccgtaacggtaccgtaaggtaacgtaacgttggtaacggtccgtttaaagggtttttaactttaaccgttcggtaaccgtaacggtaacctaaacgttaaccttaacttaccggttaccccttacccgttaccttaccggttacccgggttaccgggtaccggggaacgggtaaccggtaaacgggtacggtaacgtacgttaaacgaaaccggtaacgttcggtacggtacgtacggaccctaacggtacttaccgtacggtttacccttactaaccgtttccccgttaaccccggccttaacgttaccgttaccgtacttaaccg

SEQ ID NO: 52859 - DNA, 614 bp, Homo sapiens
  misc_feature: GYAE6OF02I6TXH.18.11.A11.1.454.CMB.1.raw
  modified_base (211)..(211): a, c, t, g, unknown or other
  misc_feature (211)..(211): n is a, c, g, or t
  modified_base (250)..(250): a, c, t, g, unknown or other
  misc_feature (250)..(250): n is a, c, g, or t
  modified_base (349)..(349): a, c, t, g, unknown or other
  misc_feature (349)..(349): n is a, c, g, or t
  modified_base (579)..(579): a, c, t, g, unknown or other
  misc_feature (579)..(579): n is a, c, g, or t
  modified_base (586)..(586): a, c, t, g, unknown or other
  misc_feature (586)..(586): n is a, c, g, or t
tcagtacgagtatgcacgaccggtgctcgatttagctacgactgcaggggcgagcaagatggtgttgcagacccaggtcttcatttctctgttgctctggatctctggtgccgacggggacatcgtgatgacccagtctccagactccctggttgtgtctcgtgggcgagagggccaccatcaactgcaagtccaagccagagtgttttanacagctccaacaataacaactacttagcttaggtaccancaagaaaccagacacgtccccctaaggtcctactattactgggacactccgtaccggggactccggggtaccctgaccgtatcagaggcaggcggtcgngggacagtactttcactctcaccatacaccaactgacacggactacggaagtatcggtagtacgtaagttttaattacgttgtaacacgactaacttacaagttacgtaccttccctactccgacggttacgggaccgggaacgggtaaccgtaagggtacggtagtaacgtaaccgtaaaacgaccgttggacggtctacgactaaccgtacttacgtcttcgttaccncttaccncccggtacctagtcctagtaccttaacg

SEQ ID NO: 52860 - DNA, 960 bp, Homo sapiens
  misc_feature: GYAE6OF02JQA8W.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtcgccggacggggacatcgtgatcgacccagtcctccagacctcccgtggttgtcgtctcgtgggcgaggacgggccacgatacaacgtgaccaagtccagcctagtagttagttttacacgacgtacctaccaaactaactaacctaacttacgttagtcgttacggtaaccaggacctaacggaaaaccgacggaacctaaccggacccccgttaaacggtccctacgttacgtttaaccggtcgggtacctaacgtacccggtaacccgggggtacggtccccggggtacccgtacggaccgttaccgtaccggaaggtaacgggcccgtaagggtccgggttacggtacgggtaacgtaacgttacgtttccaaaccgtccgtaaccgaacctacgtaccctaaacccgtaccgtggtaccgtaacgggtacgtaacgaacgtacgggttaccggtagtttaaaccgtttacgttttaaacccgtacggtaccgggttaacaaacgttaaccgttaaaccgttaccgttaacgtttaccccgttcccgtttaaccggtaacccgtacgggggtttacccggggaacccggggtaaaggggggtaaccccttaaagggggtacgggttaaaacccgggtacgtttaaacccggtaaaaccgggttaacggttacccgggtacgggttaaccgtaaccccgggttacccggtaaccccgttaacgttcccgggttttaacggttacccgggttttaaaccccaacccggtttttacccccggttacccccgggtaaccttaacggttaccccgtttaaaccgggttaccttaaccccgggttttaacccgg

SEQ ID NO: 52861 - DNA, 829 bp, Homo sapiens
  misc_feature: GYAE6OF02IRFQO.18.11.A11.1.454.CMB.1.raw
  modified_base (215)..(215): a, c, t, g, unknown or other
  misc_feature (215)..(215): n is a, c, g, or t
  modified_base (746)..(746): a, c, t, g, unknown or other
  misc_feature (746)..(746): n is a, c, g, or t
tcagtacgagtatgcacgaccggtgctcgatttagctacgactgcaggggcagcaagatggtgttgcagacccaggtcttcatttctctgttgctctggatctctggtcgccgacggggacatcgtgatcgacccagtctccagcctccgtgttgtgtctcgtgggcaggcggcccacactcactgacacgtccagccagtagttagtttactanacgtactaccgaaactaactaaacctaacttacttacgtcttacggtacctagaccaacgaaaaccgacggtaaccgaacccgacccccgttacggttaccctacttaattaccgtacgggtacctacgttacccggtacccgggtaccgggttcccggggttcccgtacggaccgtaccgttcgaacggcggtacacgggtcgggtacgtaggaacgtacgttacttccgtacctcctacgaacctacgtacccgtaaccaaaccggtccgtaacggtcgtacggtacgtaacgtacggtttcgggacgtaacgttttaacggtttacgttaccggttaactacgtaccgaaccgttaaccttaacggttacgtttaaccccgtcccgttttccctacgttaacccgggtttacccggttcggggaaacgggttaccggtaaccggtaaggggtaccgtaagttaaccgtaaacccgttaaacgggtcgttacgggtcgttaccgttacggaacccttaacccgggtttnttacggttacccgtttactaacccgttacccctttaccccgtccctaccgtttaacccgtggttaacccgtccttaacccggg

SEQ ID NO: 52862 - DNA, 853 bp, Homo sapiens
  misc_feature: GYAE6OF02H141L.18.11.A11.1.454.CMB.1.raw
  modified_base (219)..(219): a, c, t, g, unknown or other
  misc_feature (219)..(219): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatcgacccagtctccagacctccctggttgtgtctcgtgggcgaggacgggccaccataccaactgacaagtccagccagtacgttgttttanacacgtctaccaacaaataacaaactacgttacgtcttcggaaccagacaacgaaaccgacggaaccaccgtacccccgtaaggtaccctacgttaactttaccggtgggacctacgttacccggtaccggggtaccgggttccccgggggtcccttcggaaccgtacttaccgaggacggaccgtacgggtcgggtacggtacggggactacggttactttaccgacttccctaccgaacctaccgttaaccaaaccctaccgtacgtaccgagggtacctaagggaaagttacgtcggtacgggtacgttaagtttttaacgttacgtacggtactaaaacggacttaaaacgtttacgtttaaacgttaccgttccccgtttacctaccgtttaccggtaaccggggtttcccgggaacccgggggttaacggtaaacccgggttaagggtacggtaaaccgtaaaccgtaaaccggttaaaaccggaccggtttcggttaaccggcgggtttaccggacccgtaaaccgttacggttccgttttaccggttaccgtttaaccccgtttaccggtttaccccggtacccgttaacccttcccggtttaccggttacctacccgtttaaacg

SEQ ID NO: 52863 - DNA, 776 bp, Homo sapiens
  misc_feature: GYAE6OF02GLA6W.18.11.A11.1.454.CMB.1.raw
  modified_base (227)..(227): a, c, t, g, unknown or other
  misc_feature (227)..(227): n is a, c, g, or t
tcagtacgagtatgcacgaccggtgctcgatttagctacgactgctaggggcagcaagatcggtgttgcagacccaggtcttcatttctctgttgctctggatctctggtgccgacgggacatcgtgatgaccagtctcctagactcccgtggttagtgtctctgggcgagagggtccacccgatcaacgtcgactaacggtcacgccaggtacgttagtttttaanacgtacgactaccaaacgtaactaaccaacttacgttaacgtcctttaggtacccagcaacgaaacctaggactacgcccccgtaaagttccccgtactatttaccgtagggtactacgttacggaaccccgggtaggttacccggggtaccttacggacccgtaagtttcgaacggacgtactacgggacgggttcgttagggactacggtactttacgacttacttaccaaccgtacttccgaaccttaaacgtcgacacgggtacctaggtaacgagttggtacggtaccttagttttactacttggtactacgtacaacgttactaacgttacgtccttaccgtacgttaccgaaccgtttacgggaaccggttaagggaaccgtaacgggtaagggtaaccggaacgttaaaccgtaaaccgggtaaacgttcgggtacggtacgtaccggtacgtaccggtaaccgtttaccttaacggttccgtttaacctaacgttcccgttacccgtccgtaacgttaccggttacgtaccgttaaccgg

SEQ ID NO: 52864 - DNA, 908 bp, Homo sapiens
  misc_feature: GYAE6OF02JMC0Z.18.11.A11.1.454.CMB.1.raw
tcagtacgagtatgcacgaccggtgctcgatttagctacgactgcgaggggcagcaagatggtgttgcagacccaggtcttctatttctctgttgctctggatctctggtgccggacggggacagtcgtgatgacccagtctccagtactcccgtggttgtgtctcgtgggcgaggacgggccacctagtcaacgtcgacgtaacgtccaggccgtaggtaggtttgttttacaacgtacgtccttaaccaaactaaactaaacctaaccttacttacggtcgtttacggtaaccaacgacgaaacgtaaaacccagggaacctaaccgtacccccgttaaacggtcccttagttaacgttttacgcgggactaccgtacccgggtaacccggggtccggttccccggggttacctacggtaccgtacgtacggaggtacgggactacgggtaccgggttcgagggacttaacggttacttacgtaaccgtccgtaaccacctactacccgtaaaccgtaccgttggaccggttacgggaacgttacggaacgttaggttacgggtaccgtttacgttaacggtttttaacgtaccgtaggttaacctacgaaccgttaaattaacccgttagtttaacccggttcccctttaccggttacccgtttaccggttaaccgggggttaccggggtaaccggggttaaccgggaaacccggggttcgggttaaaccggggtaactaaacccggggttaaacggtaaacccggttaacgttccgggggtccgttaaccggtccggtaaacccgttacgtccgggttttaaccgttaccggttaccgtttaaccgtcccgttttaccctacccggtacgtaacccgtttacgttaccggtaaccgtttacccg

SEQ ID NO: 52865 - DNA, 757 bp, Homo sapiens
  misc_feature: GYAE6OF02IIXZB.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtgccggacggggacatcggtgatcgacccagtcctcacgactcccgtggttgtgtctcgtgggcgaggacggccaccagtcaactgacaacgtccagccagtagttgttttatacacgcctaccaaaacaataactaacttacgttacgacgttacggtaccagtaccgaacgaaaaccgacggacaccggtaccccctaaggtccttatacttttacgcgggactactacccggtcccggggtaccggtccggggtccctagaccgtacttacgacggacgcgacggtcgggtacgtagggacctagtacgttccacgtccacaccactccaaccactagcctaacgggctaacgaagtacgtcgtacggtacgtttaacgtttacgttaactcgtacgtacgtaacgtaacttacgtattccgttacccttaccgttaccgtttaacggtaccgggttacccggggtaacggggaaccggggttaaccggtaacgggtaacggtaacgtaacgtaaccgtaaacggttacggtaacgttgggtaacccgtccggtaaccgtacccgtggtttacccgttcgttaccccgtttacgtacccgtttcccgtacccctacccgttcgttacctccgggtaacttaacccgg

SEQ ID NO: 52866 - DNA, 881 bp, Homo sapiens
  misc_feature: GYAE6OF02FN6XC.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtgccgacggggacatcgtgatcgacccagtctccgacgacctcccgtggttgtgtctcgtgggcgagacgggcccaaccatacctaacgtgacaacgtccacgacctaggtagttcgttttaatacgtacaccgtaccaaacaaactaactaacctaacgttagtccgttacgtaaccacgacgaacgaaacccacggaaccaccggtaccccccggtaaacggttaccccttacgttaacgttttaccggtcggggtacctaacgtttaccccggggtaacccgggggttaccgggttaccccggggttccccgtacgaacccggtagttaccgaagggacgggacacgggggtccgggtttacggtacgggacgtaacggtttaactttcccaccggttactaacccaccgttaactacccgaaccctaaaccgggttcgaacggtcggtacgtaacgtaacggtacggtcgggttacgtacggttttaagttttaaccgttacttacggtacctacgtaacgttaactttaacgttacgttacccgttcccttacccgttaccgttaccgttaccgggttacccgggggaaccgggttaacggggaaccggtttaacgggtacggtaaacggttaacgtaaacccggtaaacgttacggttaacggtacggtaccgttacgaccgttaccgttacgttacgttccgttccgttacccttaccgtttacccctcccgttaaccttaccgttacgttaccgtacttaacccgg

SEQ ID NO: 52867 - DNA, 794 bp, Homo sapiens
  misc_feature: GYAE6OF02IL8KY.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtgccggacggggacatcgtgatgacccagtctccagacctccgtggttgtgtctcgtgggcgagacgggccaccatacactgacacgtccagccagtagttgttttatacagcctaccaaacaaataacaaacttactagtcgttacggtaaccacgacaacggtaaaacccgaggaaccgaccgtaccccccgtaaacggttccccgtacctaacttttaacgtacggtacctaacgttacccggtaaccccggggtaccgggttcccccggggacccccttacggacccggtacgtttacgagggtaaccggaccgtacgggtccgggttacgtacgggggtacctaaggttactttacgaaccctttccgtaccctaccgtaaccgtacccaacccgtaacccgttacggaccgtttaacggaccgttagggaaggtacgttgggttacggtaacgtttacgttttaacttagtacgttaacgtagtactaaaccgttacttaaaccgttccgttccctaccctttccgtaccgttcggtaccgggaccgggtaagggaccggtaaggtcggaacgtaactacgtaaaaccgaggtacggtagccgtagaccgtaacctctccgttccgttactacccgtaccgtttccccgttccgtacccgttatccgttcgacccttaacg

SEQ ID NO: 52868 - DNA, 792 bp, Homo sapiens
  misc_feature: GYAE6OF02JENLL.18.11.A11.1.454.CMB.1.raw
  modified_base (195)..(195): a, c, t, g, unknown or other
  misc_feature (195)..(195): n is a, c, g, or t
  modified_base (726)..(726): a, c, t, g, unknown or other
  misc_feature (726)..(726): n is a, c, g, or t
tcagtacgagtatgcacgaccggtgctcgatttagctacgactgcaggggcagcaagatggtgttgcagacccaggtcttcatttctctgttgctctaggatctctggtcgccggacggggacatcgtgatcgacccagtcctccagacctcccgtggttgtgtctcgtgggcgaggcgggccaccatactaacnggcaacggtccagccgaaggtagtttagtttaactacgactaccctaaccaaacctaaacttaaacctaaaccgttaacttaacggttaccgttacggttaacccaacggaccgaaaaccgaaaacccgacggaaccgaacccgtaacccccgttaacggtccctaccgttaatttacggcgggacctacggttcccggtaacccgggggtccggtccccggggtaccctaccggtaaccgtcgttaaccggaggaccggccgtacgggtcggtacggacggtataacgtcttacctcgtacctctaaccgctaaccctacccgtactacggtaccgaggttaacaggaacgtcggtacgggtacgttaactacgtttttaacgtacccttcgtacgaacggtaacctagtaaacttacggttacccttaccgtccttaccgtaccggttccgggagggtaccgggaacgggtacgtaagggtacgtaaccgtaacgttaaacgtaaccgtacggtagtaccgttcgaccncgtacgttcgtacttccgttaacgttctacccgtttccacgttaccgcgtacctagtaccttaccg

SEQ ID NO: 52869 - DNA, 898 bp, Homo sapiens
  misc_feature: GYAE6OF02IFTK7.18.11.A11.1.454.CMB.1.raw
  modified_base (220)..(220): a, c, t, g, unknown or other
  misc_feature (220)..(220): n is a, c, g, or t
  modified_base (825)..(825): a, c, t, g, unknown or other
  misc_feature (825)..(825): n is a, c, g, or t
tcagtacgagtatgcacgaccggtgctcgatttagctacgactgcaggggcagcaaggatggtgttgcagacccaggtcttcatttctctgttgctctggatctctggtagccggacggggacatcggtgatcgacccagtctccagacctcccgtggttgtgtctcgtgggcgagacggccacgatcaactgacaagtccagccagtagtttgttttanacgagtcctaccgaaaactaaactaaccaaaccttacgttaacggtctttacggtaacccaagacctaaacggaaaacccgacgggaaccgtaccggtaaccccccgttaaaacggttcccctaaccgttaacgttttaaccggtacggggtaccctaaccgtttaccccggtaaaccccccgggggtaacgggtttccccccggggggttacccctacgggtaacccgttagtttccggaaaggaccggtaccgacggtaccgggttacgtaacggggactaacggtaccttttaccgaaccgttcctaccgaaccctacgttacccgaaaccctaccgtacgacgtacgggtacgtaacgggaacgttagttacgggtacggtacctttaagtttttaacttaccgttaggttaacccgtaacggaaccttaaaaccgttacgttaaaccgtttaacccggtttaccccttacccttacccgttccggtttaaccggttaaccggggacgggttaaaccggggtaaaccggtacgggttacggaaacgttaacgtaaaccgtaaacgtacggttggtaccgtacgtaccgtacctaaccggtnttacccgttcgttaccctttaaccgccgtttccccgtacccgtaccacgtttaccgtaccgtacttaacccgg

SEQ ID NO: 52870 - DNA, 773 bp, Homo sapiens
  misc_feature: GYAE6OF02F3HAS.18.11.A11.1.454.CMB.1.raw
  modified_base (161)..(161): a, c, t, g, unknown or other
  misc_feature (161)..(161): n is a, c, g, or t
tcagtacgagtatgcacgaccggtgctcgatttagctacgactgcaggggcagcaagatggtgttgcagacccaggtcttcatttctctgttgctctggatctctggtcgccggacgggacatcgtagatcgacccagtctacgagacctccgtgttcgtntcctcgtgggcggaggacgggtcccaccgataccgtaacgtcgaccgtaacgtccaacggtccgaaggttacgttagtttttaccaacgtacgtcccttaaccaaaacttaaacctaaaccgttaacttactaacggtcttaccggggtaccaacgtaccgaaaccggaaaacccgaaggaccccgaaccgtaacccccgttacggttaccctacttaacttttacggcgggtactacgttaccccgggtacccgggggtacgggtccccgggtccgtacgtacgtagtaccgaggacggcggaacggtcgggtgtacggacagttacctacgtcctacctaccacgtacctaccgaacctacctggacctacgactagagtacggtagtcgttaatttagttactacgtcgtagaactactactaagttcttacggtcctttacgaccgtcggtcggtaccgggacgggaaccgggtagtaacggtcggaaacgtacgacgtaaacgttaggtcgaccgtcggtcccaagtacctccttacgttacccggttccttacttcccgtttaaccctccgggtaccctaacggttcttaacggcctttaacccgg

SEQ ID NO: 52871 - DNA, 917 bp, Homo sapiens
  misc_feature: GYAE6OF02FHGOE.18.11.A11.1.454.CMB.1.raw
  modified_base (142)..(142): a, c, t, g, unknown or other
  misc_feature (142)..(142): n is a, c, g, or t
  modified_base (903)..(903): a, c, t, g, unknown or other
  misc_feature (903)..(903): n is a, c, g, or t
tcagtacgagtatgcacgaccggtgctcgatttagctacgactgcaggggcagcaagatggtgttgcagacccaggtcttcgatttctctgttgctctggatctcgtggtcgccggacggggacatcgtgatgacccagtcnccacgtacctcccgttggttgtgtcgtcgtgggacgaggacgggccacctatccaacgtcgacaacgtccaggaccaggtagtttgtttttaacacgacgtaccttaccaaacaaacttaaacctaacttaaccgttagccgtttacgggtaaccctaggaaccaacgaaaaccgagggaaccctaccggtaccccccgttaaacggttccctacgtaacgtttacgtcggggacctacgttacccggtaaccccggggtaggtacccccgggggttacccctacggtaacccgtagtttacggaacggacgggtcgaccgggtaccggggttacggtaggggtaaaccgtaacggttaccgtttttacgaacccttccgttacccgtaaccgtaacgttacccccgtaaaccctaaaccggttcggaaccgttaacgggcccgttaaacgggtaaagtacggtttcggtacggtaccgttttaacggtttatttacccggtgtaaccgtacgtaaactaacctaacgttaccggtttaccgttaccccgttttaccgacctttaccgggtaacccggggtttacccgggggaacggggttaaccgggtaaacccgggaaagggttccgggtaaaggtaacccgtaaacgtaaaccgttacgggttgtaccgggtacgttaccggaccctaaccgttacgttcccgttcgtttaccgttaccgtaccgtttcccgtaccccgggtaattaccgtttaccgnggtttaacccaacg

SEQ ID NO: 52872 - DNA, 641 bp, Homo sapiens
  misc_feature: GYAE6OF02I1KOU.18.11.A11.1.454.CMB.1.raw
  modified_base (323)..(323): a, c, t, g, unknown or other
  misc_feature (323)..(323): n is a, c, g, or t
  modified_base (436)..(436): a, c, t, g, unknown or other
  misc_feature (436)..(436): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatcgacccagtcctccagacctcccgtggttgtgtctcgtgggcgaggacgggccaccatacaacgtcgacaacgtccacgccgagtagttgttttacacgacgtcctaccaaacaaactaaacaacttacttagcgttacggaccagacaacgaaaccacggaacaccgaccccctaagtccctactactttacgnggactacgtaccgtaacccggggtcggtcccgggtaccctacgaccgtattcgaagcgacgacggtcggtcgtaggactagtacttccactcctcactactaccaacctacgngacgacggtcagacgtgtacgtcgtatttaacgttactacgtgacacgacttatactactcttcctcgtactcgtacgtacggcggtaacggaccgtaggtacgagtactaacgtaaacgtactggtacgcctacgaacgtaccgtcgttacttcgtaccttacgttacttcccgtcccgtacctcgtaccgtactaccgtaccg

SEQ ID NO: 52873 - DNA, 829 bp, Homo sapiens
  misc_feature: GYAE6OF02G7MYX.18.11.A11.1.454.CMB.1.raw
  modified_base (243)..(243): a, c, t, g, unknown or other
  misc_feature (243)..(243): n is a, c, g, or t
  modified_base (461)..(461): a, c, t, g, unknown or other
  misc_feature (461)..(461): n is a, c, g, or t
tcagtacgagtatgcacgaccggtgctcgatttagctacgactgcaggggcagcaagatggtgttgcagacccaggtcttcatttctctgttgctctggatctctggtcgccggacgggacatcggtgactgaccctgtcctccgacgtaccttcccgtggttgtcgtctcggtgggacgaggacggcccaaccgtataccaacttcgactaacgtccacgtccgaggtagtttagttttaanaccgtaagtccctaacctaaacgtaaaactaaactaaccgtttaacgtttaccgtacgttttaacggaacctagaaccgtaaaccgaaaaccgacggaaacctacccggtacccccgtaaggttcccttacgttaaacgtttacgtcgggtacctaacgtacccgggttaccccggggtccgggtacccggggttccctacggtaccgtacgtaacgngggaaccggtcgacgggttcggtacggtcgggacctaggtacttaccgaacttcgaccacgtaacttccaaccgtacgtcacggtacgtaaccgtaggaactgtacgtcggtaacgtttacttagtacgtctacgactaacgtacttaacttcgtacgtttccctacgttaccgtaccggtaacgggttacgggaaccggtaagggtaaaccgtaggaacgtaacggttaaccgtaaacgggacgttaaccggtcggtacgggtacctacggtacccttaacggtaccgttaccggttaaccgttccgtaaccgttacccttccggtacccgtttacgaccctttacgtaaccgtaccgtttaaaccg

SEQ ID NO: 52874 - DNA, 825 bp, Homo sapiens
  misc_feature: GYAE6OF02FQ858.18.11.A11.1.454.CMB.1.raw
  modified_base (218)..(218): a, c, t, g, unknown or other
  misc_feature (218)..(218): n is a, c, g, or t
tcagtacgagtatgcacgaccggtgctcgatttagctacgactgcaggggcgagcaagatggtgttgcagacccagggtcttcatttcgtctgttgctctggatctctggtgccgacgggacatcgtgatgacccagtctaccagacctccgtggttgtgtctcgtggcgaggacggccaccatacaactgacaagtccacgccagacgttgttttanacagctaccaacaaataacctaactacttagcttaggtaccagtacaagaaaccgaggaccaccgaccccgtaaggtcctacgtactttacgtcgggactacgttacccgtaacccggggtcggttacccggggtcccgtacggtaacccgtgtttaccggacggtaggaccgtagggtccgggttacggtacgggaacgtacggttaacgtttaccaacccgttccgtacccctaacctaaccgtaacctaacccctaaccggtcggaacgaccgggtagttaacggaacgttacgtaggttacggacgtttaacgttttagttaaccttaggtactacggtaacctaacgttaccgttaacggttacccgtccgtttaacccgttccgttaccggtacccgggtttaacggggaccggggtaaaccgggtaaccgttaaacgggggtaccgtaaacggtaacccggttaaacgtaaacccggtggttaaaccgtcgggtaccgttcgtaacccgtaacgttacgttacccgttacggttccgtttaacccgtacgttaccccgttacccggtacctttaacccgccgtaaggttaccctaaccgg

SEQ ID NO: 52875 - DNA, 584 bp, Homo sapiens
  misc_feature: GYAE6OF02F9WAF.18.11.A11.1.454.CMB.1.raw
  modified_base (208)..(208): a, c, t, g, unknown or other
  misc_feature (208)..(208): n is a, c, g, or t
  modified_base (293)..(293): a, c, t, g, unknown or other
  misc_feature (293)..(293): n is a, c, g, or t
  modified_base (333)..(333): a, c, t, g, unknown or other
  misc_feature (333)..(333): n is a, c, g, or t
  modified_base (345)..(345): a, c, t, g, unknown or other
  misc_feature (345)..(345): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagacctccctggttgtgtctcgtggcgagaggccaccatcaactgcaagtccagccagagtgttttanacagcctaccaacaataacaactacttagcttaggtaccagacaagaaaccaggaaccacgaccccctaaggtcctcatttacgnggcatccgtaccgggagtccgggtcctagaccgattcagngcaggcggtcgnggacatacttcactctcaccatccaccaacctcgacaggtctagaacgatgtacggcttaagtttatacgtgtacagcaactaactacttacgtccttacctctaccgccggtttacggccggaacggtaccgaagggtcgaagtactaaccgaaacgtcgtgtaggtctcgactaacctgtcttaccggttccttacgacgttccctacccgtacctacgtcctacgaccttaaccgg

SEQ ID NO: 52876 - DNA, 746 bp, Homo sapiens
  misc_feature: GYAE6OF02HOI4S.18.11.A11.1.454.CMB.1.raw
tcagtacgagtatgcacgaccggtgctcgatttagctacgactgcaggggcagcaagatggtgttgcagacccaggtcttcatttctctgtgctctggatctctggtcgccggacgggacatcgtgactcgacccagtcctaccgacgtacctcccgttggttcgtgtccttcggtgggaccgaggaccggtcccaacacgtaccaacgtcgaccgaacgtccgagtccaggtagtttagtttaacacgacgtcctaaccaaataaactaacctaacttacgttagtccgttacgtaccagtacgaacgaaaccgtacgaccaaccgtacccccgtaaggtaccctattaacgttccgaccggtactaccgtaccgggaacccgggtcggttacccgggtcctacggacctagttacgagaccggtacgagggtccggtagtacgggactacgttacgttccgacttcaccgtacgacctaccaaccgtacgtcgacgagtcaacgagtcgtgtaccgtatttaacgttagttccgacgtacgacgtacctaaggttctacgttacccgtcctcgttacctcggtaacggtccgggaacggacggtacgtacgggtacaacgtacgaacgggttaactcggcggttacgacgttaccgacttaccggttcgtacgttccgttaacgttcccgttaaccgttcccgtaaccggttccttacccggtacgtacccgttaccgtaacgg

SEQ ID NO: 52877 - DNA, 759 bp, Homo sapiens
  misc_feature: GYAE6OF02G9UDD.18.11.A11.1.454.CMB.1.raw
  modified_base (213)..(213): a, c, t, g, unknown or other
  misc_feature (213)..(213): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactcccgtggttgtgtctcgtgggcgaggacggccacatcaactgacaagtccagccagagttagttttanacacgcctaccaaacaactaacaactacttagtcttaggaccagacaacgaaaccgaggaaccaccgaccccgtaagtcctactagtttacgcggactacgtcccggtaaccccggggtacggttcccggggtaccctacggtaccgtagttaccgaggacggctacgggcgggtacgtacgggaactagtacgttaccaccttcgacccaacctactacccaacccgtaaccgtgaaccgtacggtacgtaggaagtacggttaggtacggtacgttaacgtttaacttacgttacgtacgtacgtacgtaaacttaactacttaccgttacccttaccttaccgttaccgtaccggttaccgggtacgggtaaccgggtaaccggtaacgggtaacggtaacggtaacgtaaacgtaaaccggtaacgtacggtacggtaccgtccgaaaaaaccgtccgtaacgttccgttacggttaccgttaccgttacccgttacccgttcccgtaccgttaccgtacccgttacgtaccgttaacccgg

SEQ ID NO: 52878 - DNA, 600 bp, Homo sapiens
  misc_feature: GYAE6OF02GQ6ZW.18.11.A11.1.454.CMB.1.raw
  modified_base (291)..(291): a, c, t, g, unknown or other
  misc_feature (291)..(291): n is a, c, g, or t
  modified_base (413)..(413): a, c, t, g, unknown or other
  misc_feature (413)..(413): n is a, c, g, or t
  modified_base (501)..(501): a, c, t, g, unknown or other
  misc_feature (501)..(501): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccgagagtgttttaatacagcctaccaaacaataacaacttacttagcttaggtaccagcagaaaccaggacacgcccctaagtcctacatttacgnggcatcgtacccgggagtccggggtccctggaccgagttcgagtaggcacggcgggtcgtagggacaggtattcgaccgttctaccgaccataccaccaacttcgacgacggctaggaagtntaggtggactagttttactatacgtcagacaatacttagtaactccgtcctactcgacgtttcgggacggtaggacgaagggtgaagngttaaccaaagtacttagtcgactcgacgaactgtaccgttacgttacgtttactacgtttcccttacccgtacctacgtacccgttacgacttaaccg

SEQ ID NO: 52879 - DNA, 810 bp, Homo sapiens
  misc_feature: GYAE6OF02HHN33.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagttgtttatacagctaccaacaataacaactacttagcttggtaccagcagaaaccaggacacgaccccctaaggtcctacatttacgtggcatccgtacccgggacgtcccggggtcccctggaccgacgttcgagtacggcaggacgggtcgtgggacagtatttcacctcgtaccaccgtactaccaaccctaaccttcgaccgtaggaccgtacggtaacgtacgtcggtacggtaccttaagttttaacgtttacttacggtaccgtaaggtacccttaaaagttaacccgttaaacgtttacccggtttaccccttacccgtttacccttacccgttaacccggggttttacccggggaccggggtaaaccgggggttaaccccgggtaaaacggggttacggggtaaacggtaaccgttaaaacccgggtaaaaaccggttaaaccggttacgggttaccgggtaccgttacccggaacccgttaacccgtaaccgttacccggtttacggtttacccgtttaacccgttacccgttttccccggtttacccccggtacccttaaccggtttacccggttaaccggtaacccgttaaaccccgg

SEQ ID NO: 52880 - DNA, 692 bp, Homo sapiens
  misc_feature: GYAE6OF02IC86T.18.11.A11.1.454.CMB.1.raw
  modified_base (214)..(214): a, c, t, g, unknown or other
  misc_feature (214)..(214): n is a, c, g, or t
  modified_base (219)..(219): a, c, t, g, unknown or other
  misc_feature (219)..(219): n is a, c, g, or t
  modified_base (328)..(328): a, c, t, g, unknown or other
  misc_feature (328)..(328): n is a, c, g, or t
  modified_base (475)..(475): a, c, t, g, unknown or other
  misc_feature (475)..(475): n is a, c, g, or t
  modified_base (638)..(638): a, c, t, g, unknown or other
  misc_feature (638)..(638): n is a, c, g, or t
tcagtacgagtatgcacgaccggtgctcgatttagctacgactgcagggcagcaagatggtgttgcagacccaggtcttcatttctctgttgctctggatctctggtgccggacggggacagtcgtgatcgacccagtctccagacctcccgttggttgtgtctcgtgggacgagacggccaccatacaactgacaacgtccagccagtagttntttanacgactcctaccaaactaaactaaacctaaacttacttacgtcgttaccggaaccagacaaaacgaaaccgacggacacccgtacccctaaggtcctactactttccgnggacctacgtcccggtaacccgggtacggttcccccggggttccctaggaacccgttacgtaccgaagggcggtaacgcggtccgggtacgtcgggaactacgtacgtttcccgtaactccgtacaccgtactaccgaaccctacgngaccgagacgtacgaacgtagttcggtcgtacttactttatacgtgtaaccataccgtattaacgttactcccgttacccttccgtacgtaccgtacgggttccgggaacgtaaccggaacggtaaggtccgaagtacttaaacgaacgtaacgtcgagaccncgactacgtcttacggtctctacgtcccttaccggcctcgtactcgactatacg

SEQ ID NO: 52881 - DNA, 644 bp, Homo sapiens
  misc_feature: GYAE6OF02GADKN.18.11.A11.1.454.CMB.1.raw
  modified_base (212)..(212): a, c, t, g, unknown or other
  misc_feature (212)..(212): n is a, c, g, or t
  modified_base (435)..(435): a, c, t, g, unknown or other
  misc_feature (435)..(435): n is a, c, g, or t
  modified_base (453)..(453): a, c, t, g, unknown or other
  misc_feature (453)..(453): n is a, c, g, or t
  modified_base (458)..(458): a, c, t, g, unknown or other
  misc_feature (458)..(458): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactcccgtggttgtgtctcgtgggcgagacgggccaccatcaactgcaagtccagccagagttgttttanacagctaccaacaataacaactactagcttaggtaccagacgaagaaacccaggacgaccgacccccgtaaaggtcccctactaactttaccgtggggacctaacgttacccgtaccccgggggtacggtcccgggtcccctaggaacccgtattccgagacggacgaggccgggtcgtagggacaggttacttcgactcgtacacctataccaccgtaaccngacgtacggctacgaagngtagngtccttaagtttacgttacgtgtactacgactaacgtacttatactccttcctctaccgtacgttcgggaccggtacggaacggtaggcggtaacgactaccgaaagtaccgtaggtacgcttagaccgactagtccttacggttctaccgtacgttccttcccggattactcgtagtacctaacg

SEQ ID NO: 52882 - DNA, 821 bp, Homo sapiens
  misc_feature: GYAE6OF02FSRHG.18.11.A11.1.454.CMB.1.raw
  modified_base (199)..(199): a, c, t, g, unknown or other
  misc_feature (199)..(199): n is a, c, g, or t
  modified_base (215)..(215): a, c, t, g, unknown or other
  misc_feature (215)..(215): n is a, c, g, or t
tcagtacgagtatgcacgaccggtgctcgatttagctacgactgcagggcagcaagatggtgttgcagacccaggtcttcatttctctgttgcttctggattctctggttgccggacgggacatcgtgatcgacccagtcaccagacctcctggttgtgtctcgtgggcgacgaggccacatacaactgacaactcacncagtgtttattatacncgtctaccaactaaacaaccgtaacttacgtacgtcttaggaccaagcaaaccgaaacgacggacctaccgaccccgttaacggtcctactactttaccgcggtacacgttacccggtacccggggtacggttccggggtaccctacggtaccaagttccggagtacggacgtgggtcggttcggacggtacgtagtttaccgttcctactaccgtaacaccctaactaacccgaccctacggtacgccgtacggtaccgtaagacgttacgtacggttacgtaccgttttaattaaccggtttactacggtactaacggtaacgttaacgttacgtttaaccgttaaccggtcccttttaacccgtcgttaacccgtttaaccgggtttccgggtaaaccggggtacccggttaaacgggttaaggggtaacgggttaaacctaacgttaaaaccgtaaacccggttccgggttatacccggggtacttaccggaaccttacccggtaacgttttcccgttacggttttaacccttccccgggttttcccttaacccccggtacttcccccggaagttttaacccacgtttaaccggttaccccg

SEQ ID NO: 52883 - DNA, 806 bp, Homo sapiens
  misc_feature: GYAE6OF02GNF2X.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtcgccggacggggacatcgtgatgacccagtcctccagacctcccgtggttgtcgtctcgtgggcgaggacgggccaccatacaactcgacaacgtccacgccgagtagtttagttttaactacgacgtcctaccaaaactaaactaaacctaaacttaacgttacgtacgttacggtaaccgacgaccgaaacgaaacccgaacggaaccgaccgtaaccccccgttaacggtaccttactacgttacgtcgggtactacgtaccggtacccggggtacggttccccggggtacctcggaaccgtacgtacgtagggacggcgacgggtccgggtcgtacgggactacggtactttcgtaactcctaacctaccgtactaccgaaccctaccgtcgacctaacgggacgtaacggtaacgtacgttcgggttacggtaccttaaaggttttacttaacgtcgttacgaacgttaactaacttaccgttaagttccgtacccttccgtacttaccggtacggtttaccgggaacggggaaacgggtaccggtaacgggggtacgtaaacggtaacctaaaccggtaaaccggtacgtcggggttacggacctcggaacccgtaaccgtcgtttaccttaccgttacttacccgtaccgtttcccgtacccgtaactacttcgtacgtaacccttaaccg

SEQ ID NO: 52884 - DNA, 726 bp, Homo sapiens
  misc_feature: GYAE6OF02G5EYX.18.11.A11.1.454.CMB.1.raw
  modified_base (448)..(448): a, c, t, g, unknown or other
  misc_feature (448)..(448): n is a, c, g, or t
tcagtacgagtatgcacgaccggtgctcgatttagctacgactgcaggggcagcaagatggtgttgcagacccaggtcttcatttctactgttgctctggatctctggtgccgacggggacatcgtgatgacccagtctccagactccctggttgtgtctctgggcgaggagggcccaccgatcaactgacaagtccagccagtagttcgttttatacacgctaccaaacaataacaacttacttagcttaggtaccagcaagaaaccaggaacacgccccctaacggtcctctactttactggggcctatccgtacccggggtaggttcccggggtcccgtacgaccgtacttcgaagacgggactacggtccgggtctagggggacagttacttacactcgtccaaccagtaccaaccgaaccgtcgacgcggtacgtagtaacgngtacggtcgtacttaaggttttacttaaccgttcgtactaacgtaaccgtaattaaccttagttaaccgttccccttaccgtttacccgtaccgttaccgggttacgggaccggggttaacgggaaccgggttaacgggtacgggtaaacgtaccgtaaaccgtaaacgttaccggtaaggttacgtaccgggtcaaccgtcctaacggttcttccggttactttactaccgtttccctacccgggtaccctcgtttaccgtacgtaccgttaacccg

SEQ ID NO: 52885 - DNA, 602 bp, Homo sapiens
  misc_feature: GYAE6OF02G4LWG.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagacctccctggttgtgtctctgggcgagagggccaccatcaactgcaagtccacgccagagttgttttaatacagctaccaacaataacaactacttagcttggtacagcacaaaccaggacacgaccccctaaggtcctactatttacgtcggactatccgtacccggggagtcccggggtcccctggaccgtacttcgagacggcaggcgggtcgtgggacagtactttcactcctcacctacacacccaactcgacacggtctagaacgagtggtcgtactaagttttacttacgtgtcgacgactaatctaattcgtccttctctcgtacgtcggacggacggaccgtagggtcgaagacgtaaccgaaacgtacgtgtacggctacgacctaccgtacttcgttacgttcttacctactttccccgtcccgtaccttactacgttacgacttaccg

SEQ ID NO: 52886 - DNA, 910 bp, Homo sapiens
  misc_feature: GYAE6OF02FUSWA.18.11.A11.1.454.CMB.1.raw
tcagtacgagtatgcacgaccggtgctcgatttagctacgactgcaggggcagcaagatgtgttgcagacccaggtcttcatttctctgttgctctggatctctgtcgccgacgggacatcgtgatgacccagtctccagtactcccgttggttgtgtctcgtgggacgacgagggccaccagtacaacgtggacaaggtccaacgccagtagttacgttttactacagcctaccaacaaataaccgtaacttacgttagtccgtttaggtacccagaccgaacgaaaccaggaacctacgaccccctttaaacgggtccccttcgtaacttttaccggtacgggtactaccgttacgtaacccccggggtacgttccccgggggttacccctacggtaacccgtaagtttaccggaaggtaaccgggtcggaacgggcggggtttaccgtaggggtaaaccgtaaggttacttttacccggtaaccgtccttaaccgttaacccaccgttaacccgaaacccgtaaacccttacgggtacccgtaacgggttaccggttaaacgtaaacggtacggttaccggggttagggttaaccgtttaaaccgtttttttaagtttaccggtttaccggtaaaccttaacggtaaacccgttaaaagtttacccttaacgggttttacccttaacccgtttccccgtttaaacccgtttccggggtaaacccggtttttcggggaaacccggggttacgggaaacccgggtttaaacggggtaaggtacgttaaccggttaacgaaaccgtttaacggtcgtaacgtaccgttacgacctaaccgttcgttccgtacgtttacggttacttacccgttacgttccccgacggttcaccggttacgtccgttaacg

SEQ ID NO: 52887 - DNA, 738 bp, Homo sapiens
  misc_feature: GYAE6OF02GY5D0.18.11.A11.1.454.CMB.1.raw
  modified_base (299)..(299): a, c, t, g, unknown or other
  misc_feature (299)..(299): n is a, c, g, or t
  modified_base (316)..(316): a, c, t, g, unknown or other
  misc_feature (316)..(316): n is a, c, g, or t
tcagtacgagtatgcacgaccggtgctcgatttagctacgactgcaggggcagcaagatggtgttgcagacccaggtcttcatttctctgttgctctggatctctggtgccggacggggacatcgtgatgacccagtctccagacctcccgtggttgtgtctcgtgggcgagagggccaccatcaactgcaagtccagccagagttgttttaatacagcctaccaaacaataaccaacttacttagcttggaccagcaagaaaccaggacacgaccccctaaggtcctactatttacgnggcactcgtacccgggngtcccggggtcctgaccgtattcgagaggcaggcgggtcgtacgggactagtactttccacttctaccaaccgtactaccctaaacccaacccgttcgaccggtaaggtcccttagggaaacgtacgttagggtcgggtacctttaaggttttaactttaccgttaggtaccaaggtactaaacgttacttaacgttccgtttaccccttaccgttcttacccgtaacgggtttcccgggaacgggtaacgggtaacccgtaaaggggtcgaacggtaacgttaaccgaaaaccggtaccgttagggttaccggtacgttaccgtaccctaaccgtacgttaccctttcggttaccctttaccgtacccgtttcccgttacccccgtaccttaccgtttcccgttacgaacccgtttaaccg

SEQ ID NO: 52888 - DNA, 673 bp, Homo sapiens
  misc_feature: GYAE6OF02GCI0Z.18.11.A11.1.454.CMB.1.raw
  modified_base (455)..(455): a, c, t, g, unknown or other
  misc_feature (455)..(455): n is a, c, g, or t
  modified_base (622)..(622): a, c, t, g, unknown or other
  misc_feature (622)..(622): n is a, c, g, or t
  modified_base (639)..(639): a, c, t, g, unknown or other
  misc_feature (639)..(639): n is a, c, g, or t
  modified_base (656)..(656): a, c, t, g, unknown or other
  misc_feature (656)..(656): n is a, c, g, or t
tcagtacgagtatgcacgaccggtgctcgatttagctacgactgcaggggcagcaagatggtgttgcagacccaggtcttcatttctctgttgctctggatctctggtgccgacggggacactcgtgatgacccagtctcccagacctccctggttgtgtctctgggcgagagggccaccatcaactgcaagtccagccagagttcgttttatacagtcctaccaaactaataaaccaacttaaccttaggacctttgggtaaccagaccaagaaacccaggaccacgaccccctaaaggtcctactatttacgtcgggcactaccgtacccgggaacggtcccggggtccctgtaaccgacgttacgaggacggtcacggtcgggtctgggactacgtactttcgacttcctcgaccataccgaacccaactcgaccgtacgcgttaggaaacncggtaggtacggacgtttaagttttactactacgtccgtagtactaaacgttaaactcgttaaccgttccttacccgttctacgttacgtacggtccgggtaaggtaccgagggtacggtaagtaacccgtaagaaaccgtcgtaaggtcgtacgagacctaccggntcggttacctcgttccnccgttctaccccgtacnctcttacgacttaaccg

SEQ ID NO: 52889 - DNA, 832 bp, Homo sapiens
  misc_feature: GYAE6OF02GKZRJ.18.11.A11.1.454.CMB.1.raw
  modified_base (783)..(783): a, c, t, g, unknown or other
  misc_feature (783)..(783): n is a, c, g, or t
tcagtacgagtatgcacgaccggtgctcgatttagctacgactgcaggggcagcaagatggtgttgcagacccaggtcttcatttctctgttgctctggatctctggtgccggacggggacatcgtgatcgacccagtcctccagacctcccgtggttgtgtctcgtgggcgagacgggccaccatcactgcgaacgtccagaccagtagtttgtttactacagacctaccaaacaaactaacctaacttacttagtccttacggtaaccagaccaacgaaaaccgtacggaaccgtaaccgaccccccgttaaacggtccccttacgtacttttacggtcggtactaccgtacccgtaccccgggggtacggtccccggggttccccgtacggaaccgtacgtttaccgacggtacgggaccgagggtccggggttaccggttacgggaaccgtaggtacttttacccgaccgtttacccgacctaaccctacgtaccccgtaacccctaaccgttccgaaccgtacggtacggtaacggaaacggtacgttacggggccgtttaaagttaacgtttttaaccggtttacgttaacgtcggaaccttaacaaaccgtttattaaacgtttcccggttaccccttccgttaccccgccgtttaaccgggttcccggggtaacggaaccggggtaacccgtaaggggtacggaagttacctaaaccgggtaactaggttcggacgtcgtacgaccgaccgttaacttccggttactccgttaancccgttttacccgacccttaccgcccgttttacgtactaacccgttacg

SEQ ID NO: 52890 - DNA, 785 bp, Homo sapiens
  misc_feature: GYAE6OF01BWEPF.35.33.C11.1.454.CMB.1.raw
tcagtacagatcgtcacgaccggtgctcgatttagagtgagctcgttgggtttggggggagaggagcccagcactagaagtcggcggtgtttccatccggtgatcagcactgaacacagaggactcaccatggagtttgggctgagcttgggttttcctcgttgcttcttttaagaggtgtccagtgtcaggtgcagctggtggagtcgtggggaggcgtggtccagccgtgggacgtccctgagtactctcctgtgaagtcgtctggattcattcttacaaattactagtggacagtcgactacggtcggggtccacccgtaggcctaccgaaggcgtaaaggggacttgggaggttgggttcggacgtaggttttggtaggtaggttaagtgggtaagtagggtaaaagtttaaagtaacggtaattaacgtaagtcggacgtaacggaccgtaacccgggtagggaacgggaccgtacttacccgaaccgtacgttaccctacccgaaaggaccgaaaactaacctttaacccgaaaagttaaacccgttactttttacggttaccctacgtaaaccgtaaacgttacggaaaccgtacggtacccgtaaggaaccggaacgggaaccccgggaacgggaacccgtaaaccggggtacgttaaacgttaacgttaaaccgtttaacgtagggtaacgggtacggaaaggtaaaccggtacggtaaacggtaccgggggaaaccccgttccccccggtaaacccccggggtaggtaacccggg

SEQ ID NO: 52891 - DNA, 707 bp, Homo sapiens
  misc_feature: GYAE6OF01DMWM9.35.33.C11.1.454.CMB.1.raw
  modified_base (263)..(263): a, c, t, g, unknown or other
  misc_feature (263)..(263): n is a, c, g, or t
tcagtacagatcgtcacgaccggtgctcgatttagagtgagctcgttgggtttgggggggagaggagcccagcactagaagtcggcggtgtttccatccggtgatcagcactgaacacagaggactcaccatggagtttgggctgagctgggttttcctcgttgctcttttaagagtgtccagtgtcaggtgcagctggtggagtcgtggggagcgtggtccagccgtgggagtccctgacgacctcgtcctgtgaagcgtcnggtatcatcctacaatactatggcatgcacgtcggtccgccaggcctcgaggcgaagggctgggagtggtggctaggttgtgtaggtatgaagtaggtaaataagtagaatactagtgacgagaaccgtaccggtagggaacggtacctacgttacccgacctacttacccgtaccgaacgaacggtaactaaacgttaacccgaaacgtaaccttaccgttttacgtacccttaacgacctaaagtaaccggtaaacctacggtacccgttaaggaaccggaacggtacccggtaacgggaaccgtaaccgggtacgtaaacgttaacttaacggtttaaccggtagggtacgggaaccgggtaaacggtaaacgggtaccgggtaacgggtaacggggtaaccccggtaccccggttaaaccccccgggtgtaaacccgggg

SEQ ID NO: 52892 - DNA, 508 bp, Homo sapiens
  misc_feature: GYAE6OF01BBQAW.35.33.C11.1.454.CMB.1.raw
  modified_base (404)..(404): a, c, t, g, unknown or other
  misc_feature (404)..(404): n is a, c, g, or t
  modified_base (409)..(409): a, c, t, g, unknown or other
  misc_feature (409)..(409): n is a, c, g, or t
  modified_base (503)..(503): a, c, t, g, unknown or other
  misc_feature (503)..(503): n is a, c, g, or t
tcagtacagatcgtcacgaccggtgctcgatttagagtgagctcgttgggtttgggggggagaggagcccagcactagaagtcggcggtgtttccatccggtgatcagcactgaacacagaggactcaccatggagtttgggctgagctgggttttcctcgttgctcttttaagaggtgtccagtgtcaggtgcagctgggtggagtcgtggggggagcgtggtccagcctgggaggtccctgagactctcctgtgaagcgtctggattcatcttcaataactatggcatgcactgggtcccgcaggcctccgaggcaaggggctgggagttgggttgctaggttgtggtggtatggagtggaagtaatagatactatgcagacacgtgaggccgatcacatcncaganacatacaagactacttgtctgacaatgaacagctagacgagcgagacgacggacatatatatgtgcgagagacgagacggacgccgtacccggntacgg

SEQ ID NO: 52893 - DNA, 945 bp, Homo sapiens
  misc_feature: GYAE6OF01E0305.35.33.C11.1.454.CMB.1.raw
  modified_base (163)..(163): a, c, t, g, unknown or other
  misc_feature (163)..(163): n is a, c, g, or t
  modified_base (202)..(202): a, c, t, g, unknown or other
  misc_feature (202)..(202): n is a, c, g, or t
tcagtacagatcgtcacgaccggtgctcgatttagagtgagctcgttgggtttggggggggagaggagcccagcactagaagtcggcggtgtttccatccggtgatcagcactgaacacagaggactcaccatggagtttgggctggagtcttgggttttccncgttgcttacttttaaggaggttgtccaggtgtcaggtncagctgggtggagtcgtggggggagcgtggtccagccgtgggacgtccctgacgtctctcgtgtagaagtccgttcgtggtacttcacgttcttaactaaactaacgtagtcggactacgttcgacctaccggttccgggggtcccaccgaacggtcccctacggaagggtaccgtaaacgggggtccgtaggggtaacgggtttggggttacgcgttaggtttcggttgggtaggttaacgtggtaaacggtttacggggtaaaagtttaacgtaacggtaactttaaccgttaggtaccgtaaccgaaacgtaacccggtacccgggtagggtaaacccggggtccctaaccgtttacccaaccgttaaccgttacccgtacgaaacgggtaaacctaaaccttaacgtttaaacccgtaaaacgttaaacccgttttacccgttttaccgggtaacccttaacgggtaaaccctaaaacgtttaccggaaacccggttacggtacccggtttaaagggaaccgggttaaccgggaacccgggtaaacgggtaacccgggaaccgggttaccgtaaaaacgttttaccgttaaaccgggttttacggttaggggtaacccgggttaaacgggaaaaccggggtaacccggggtaccggggtttaaaccgggtacccccggggggttaaaaccccctaccccccccccggggtttaaacccgggaagtttaacccccggggg

SEQ ID NO: 52894 - DNA, 718 bp, Homo sapiens
  misc_feature: GYAE6OF01D8S4Q.35.33.C11.1.454.CMB.1.raw
  modified_base (173)..(173): a, c, t, g, unknown or other
  misc_feature (173)..(173): n is a, c, g, or t
  modified_base (176)..(176): a, c, t, g, unknown or other
  misc_feature (176)..(176): n is a, c, g, or t
  modified_base (181)..(181): a, c, t, g, unknown or other
  misc_feature (181)..(181): n is a, c, g, or t
  modified_base (185)..(185): a, c, t, g, unknown or other
  misc_feature (185)..(185): n is a, c, g, or t
  modified_base (203)..(203): a, c, t, g, unknown or other
  misc_feature (203)..(203): n is a, c, g, or t
  modified_base (283)..(283): a, c, t, g, unknown or other
  misc_feature (283)..(283): n is a, c, g, or t
  modified_base (297)..(297): a, c, t, g, unknown or other
  misc_feature (297)..(297): n is a, c, g, or t
  modified_base (323)..(323): a, c, t, g, unknown or other
  misc_feature (323)..(323): n is a, c, g, or t
  modified_base (652)..(652): a, c, t, g, unknown or other
  misc_feature (652)..(652): n is a, c, g, or t
  modified_base (662)..(662): a, c, t, g, unknown or other
  misc_feature (662)..(662): n is a, c, g, or t
  modified_base (674)..(674): a, c, t, g, unknown or other
  misc_feature (674)..(674): n is a, c, g, or t
  modified_base (705)..(705): a, c, t, g, unknown or other
  misc_feature (705)..(705): n is a, c, g, or t
tcagtacagatcgtcacgaccggtgctcgatttagagtgagctcgttgggtttgggggggagaggagcccagcactagaagtcggcggtgtttccatccggtgatcagcactgaacacagaggactcaccatggagtttgggctgagcgtgtttcgcgtagctcttaagagtntcngtgcnggtncagcgtggtggagtcggngggggagtcgtcggtccagccgtgggacgtcctgacgtctctacgtgtagacgtcgttcgtggtattcctattaccttanaacgttaatgcgancgttcgccgtacgttcggcccgtacncggccgtccggaggacggacgggtagtggttagggttggttacgacttagtttagaagtttggaatcgtagagtaaccgttataaaggtaacttacgacgtcccgactaaacggtttaccgcggggtaaacggtaccgggacccttaaccgtaccggaacctttaccgaccccgggaactaaccggggtactaaaccgtttaaccgaaccccggaaaatccccgtaacggtttaacctcgggtttaatacgtaacgtaaaccgtaagttaacccgaacgtaccggtaccgaggtaacccggacgttaacccggacgacgtaccgggttntaccgggttnttaccgggttancggtaacgaagttcgaaccttaggactacgngttacgtaaccgg

SEQ ID NO: 52895 - DNA, 968 bp, Homo sapiens
  misc_feature: GYAE6OF01EOEHU.35.33.C11.1.454.CMB.1.raw
tcagtacagatcgtcacgaccggtgctcgatttagagtgagctcggttggggtttgggggggagaggagcccagcactagaagtcggcggtgtttccatccggtgatcagcactgaacacagagacctcaccagtgggagtttgggctgagtcgttcgggttttcctcgttgtccttacgtttttaaggaggttcgtacctaggttcgttcgaggttcgaccgtaggtcgtggggtagggtacggttcgggtagggggggacggtccggttcgggtcccgagggtcccggttaggggtacggttcccctaggacgtccgttccgtaccgtggtacggtaacgtccggttcgtacggtactttaccgactttaccttaacgtaaaatttaaccgtaggttacggaccttaagtccggtaccggttaccgggttccggggtaccccgaccggtaccgggttacccgaccgggtacgggaaccggtaaacggggtccggttagggtaacgggtttcggggttacggtacggtttaggggttttcggttggggttaacggttaaggtaggtaaaggttaacgggttaaaaggtttaacgttaaaggtaaccgtttaacgttaggtacggtaaccggtaacgggtaaaccggttaccggggttaaccggggaaccgggttacccggttaaccgttaccccgtaacccgttacgttaaccccttaaaccccggaaggttaaacccgaaaaccgtttaaaccgtaacccgtaaacgttaaacccgttttaccggtttaaccggtttaccctaaggttaaccgaaacgttaccgaacgtaccgacgtacgaacggtacggaccggaacggtacgaacgtacgtacgttaagttacggttacgtaggcggtaacggtacggaaccggtacgggtacggacccggggtacccttaaccccgggtaccgtgaaacccgg

SEQ ID NO: 52896 - DNA, 825 bp, Homo sapiens
  misc_feature: GYAE6OF01DWALV.35.33.C11.1.454.CMB.1.raw
  modified_base (210)..(210): a, c, t, g, unknown or other
  misc_feature (210)..(210): n is a, c, g, or t
  modified_base (816)..(816): a, c, t, g, unknown or other
  misc_feature (816)..(816): n is a, c, g, or t
tcagtacagatcgtcacgaccggtgctcgatttagagtgagctcgttgggtttggggggggagaggagcccagcactagaagtcggcggtgtttccatccggtgatcagcactgaacacagaggactcaccatgggtagtttgggctgagtcgttgggtttttcctcgtttgcttacgttttaaggaggttgtccaggtgtcgaggtgcngtcgtgggtggagtcggtggggggaggcggtggtccgagccggtggggtacggtccctagacgtacctcctccgtgtaggaacgcgtcgtaggtacttactacttcttaacctaaattaaactagtcggtacaagtcgtaccgtaacggttccggggtccccgacggtaacgggccttacccggaagggaccgaaggggtccgtaggggttagggttgggttacggagttagggttggtagggtttaggttaagtagggaaggttaaggtaaacgtttaaagtaacggtaacttactaaggtcgaaccgaaacgggtaaacccgtaccgggtaaggggaaacccggtacccgtacttacccgaaccttacgttacccacgaaacgtaacgtaacaaccgtttaacaaaacgttaccttacgttttccgtacctaagaacctaaataccggaacacggttaccgaggaaacggaccggtaccggaacggaacggtaaacccgggattaaacgttaacgttaacgtttaacggtaggtaacggaaacgggtaaagaacgggtacccggtaagggtaccgggtaacccgaacccccggtaacccgggtntaacccggg

SEQ ID NO: 52897 - DNA, 804 bp, Homo sapiens
  misc_feature: GYAE6OF01BXSEE.35.33.C11.1.454.CMB.1.raw
  modified_base (181)..(181): a, c, t, g, unknown or other
  misc_feature (181)..(181): n is a, c, g, or t
  modified_base (185)..(185): a, c, t, g, unknown or other
  misc_feature (185)..(185): n is a, c, g, or t
tcagtacagatcgtcacgaccggtgctcgatttagagtgagctcgttgggtttggggggagaggagcccacgcactagaagtcggcggtgtttccagtccggtgatcagcactgaacacagaggactcaccagtggagtttgggctgagcttgggttttcctcgttgcttcttttaaaggnggtntccagtgtcaggtcgcagcgtgggtggagtcggtgggggagtcgtggtccaggccgtgggacgtccctgacgccttctcctaggtagacgtcgttctggtaacttccaattcctttaacgaaactttaacctattcgggctaagtggtccaccggttcgggggtacccgaccgtacgggcctaccggaagggacgtaaaacggggtccttggggaacggttcggggtttacggacttaagggttttggaggtttggtaacgttaggaaagttagggtaaaaattaacgtaaggtaatttaacccggttaaagtcggaccgaaacgggtaaacctaacccggggtagggtaaaccggggacccgttacttacccgaaccgtaacttacccgtaaccgaacgtaaacgaaaccgtaaccttaccgaaacgtaaccgtttactttacgttacctacggtaacaaacgttacgaacacgtaccgtagaacggacgaaccggacggacccgtacgggtaacctagtaacgtttacgtacggttacggacggtaaccggtaggaaacgggtcgtaacgggtacgggtaacccggtccccggttaacccccgggtggttacccggg

SEQ ID NO: 52898 - DNA, 961 bp, Homo sapiens
  misc_feature: GYAE6OF01CIE30.35.33.C11.1.454.CMB.1.raw
  modified_base (270)..(270): a, c, t, g, unknown or other
  misc_feature (270)..(270): n is a, c, g, or t
tcagtacagatcgtcacgaccggtgctcgatttagagtgagctcggttggggtttgggggggagaggagcccagcactagaagtcggcggtgtttccatccggtgatcagcactgaacacagaggactcaccagtgggtagtttgggctggacgtcgtttcggggtttttcctcggtttagtccgtttactttttaaaggaggttcgtacctaggttcggtccgaagggttgcgtaggtcgtttgggtgggtacggtcggggtggggggnggtcggttcgggtccgaacggtcccgggttacgggggtaccggttccccgtaggtaaccgtaccctttcccgttacggttggttacgggaacggttcccggtttacgttagggttaacttttcctaacgttttaccctttaaactaaaagtttaaacggttacgtcggggtaccctaaggttcggtaaccccgtaccggggtttccgggggaccccgaccggttaccgggtcccgtacccgggaacgggtaacgggaaccgggggtagttggggtaaggggtttcggggttacggaccgtttagggttttggttaaccggggttgtttaacggtaggttaaaggttaaggggttaaaagttaacggttagtaacgtttaaacgtcgtaacggcggtaaacggtaacccgaacgggttaccggggtaaacggtccggttaccctaacctaaccgtcccttaccgaaccgtaacgggtaaacctaacgttaaacccgtaacccgttaaacggtaacctttaccggttttaccgttaacgtacgtaaaccgtaacgtacggaacaccggtccgtaaggaccgagaccggaccgacgtacggtagtaaacttacgttacgtacgtcggtaacggtcggtaaggacggaccggtaagggtacccgggacccgtaaccccggtcggtcggaaccggg

SEQ ID NO: 52899 - DNA, 680 bp, Homo sapiens
  misc_feature: GYAE6OF01EQ0GM.35.33.C11.1.454.CMB.1.raw
tcagtacagatcgtcacgaccggtgctcgatttagagtgagctcgttgggtttgggggggagaggagcccagcactagaagtcggcggtgtttccatccggtgatcagcactgaacacagaggactcaccatggagtttgggctgagtctgggttttcctcgttgcttctttaagaggtgtccagtgtcaggtcgcagtcgtgggtggagtcggtgggggagcggtggtccaggtccgtgggacgtcccgtgacgtactctccgtgtgaacgtcgtcgtggtattcatacttacaaagtaactgtgctatcgactacgtcgggtccgcgaggcctcgaggacgaagggtctggagtggtgcgtagttggtgtgtatggacgtaggaagtaactagaacttacgtagtcgacagtaccgtacggtacgggacgggaccttacttaccgaacgtctacccgtaacgtaacgaaaccggtaaccttaaacttaaccgaaaacgttaacccgtttacgtttaccgtacctagtaacctaaagtccgtaaacgacgtccgtaacggacgacgggtaccgaagggaacccgaggtcgtaaagttaaagttacgttaacgtggtacgcggtaaaggaacggacgtacggtaacgggacccgtacccggtccccggtaagtaaccggg

SEQ ID NO: 52900 - DNA, 504 bp, Homo sapiens
  misc_feature: GYAE6OF02JMVZQ.35.33.C11.1.454.CMB.1.raw
  modified_base (299)..(299): a, c, t, g, unknown or other
  misc_feature (299)..(299): n is a, c, g, or t
tcagtacagatcgtcacgaccggtgctcgatttagagtgagctcgttgggtttggggggagaggagcccagcactagaagtcggcggtgtttccatccggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgaagcgtctggattcatcttcaataactatggcatgcactgggtccnccaggctccaggcaagggctggagtggtgcagttgtgtggtatgatggaagtatagatactatgacagacacgtgaagggcatcaccatctccagagacaattccaagtacacttgtactgactaaatgaacagcctagagtacgccgagacgacgacatatatacgtgtgacgagaagcgagtggacgaccgtacccggatcgg

SEQ ID NO: 52901 - DNA, 500 bp, Homo sapiens
  misc_feature: GYAE6OF02FPYU1.35.33.C11.1.454.CMB.1.raw
  modified_base (295)..(295): a, c, t, g, unknown or other
  misc_feature (295)..(295): n is a, c, g, or t
tcagtacagatcgtcacgaccggtgctcgatttagagtgagctcgttgggtttggggtagaggagcccagcactagaagtcggcggtgtttccatccggtgatcagcactgaacacagaggactcaccatgagtttgggctgagctggttttcctcgttgctctttaagaggtgtccagtgtcaggtgcagctggtggagtctggggtaggcgtggtccagcctggaggtcccctgagactctcctgtgaagcgtctgattcatcttcatactatggcatgcactggtccgcagntcaggcaaggactgagtgttggcagttgtgtggtatgatggaagtaatagatactatgcagacacgtgaaggccgattcaccatctccagagacaattccaagaacactttagtcctgcaaatgaacagacctgagacgccgaggacacgggcgatatagttaactgtgcgagaagcgagtgggacgcccgtaccccggatacgg

SEQ ID NO: 52902 - DNA, 539 bp, Homo sapiens
  misc_feature: GYAE6OF02JGOMU.35.33.C11.1.454.CMB.1.raw
tcagtacagatcgtcacgaccggtgctcgatttagagtgagctcgttgggtttgggggggagaggagcccagcactagaagtcggcggtgtttccatccggtgatcagcactgaacacagaggactcaccatggagtttgggctgagctgggttttcctcgttgctcttttaagaggtgtccagtgtcaggtgcagctggtggagtctgggggaggcgtggtccagcctggggaggtccctgagactctcctgtgtagcctctggattcaccttcaatatgtatagcatgacctgggtccgccaggctcctgggaaggggctgggagtgggtctcatctattggaagtagtgttgtttatacatattatggagacggcggtggggggccgtattcaccatctccagagacaacgccaagaacgcagtatttctgacaaatgaacagctgcgagacgaggacacggctgtgtattactgtgcgagagtggagggcgagggtccggttcccccgggtttagtcgggtacgtcgtgggaccg

SEQ ID NO: 52903 - DNA, 617 bp, Homo sapiens
  misc_feature: GYAE6OF02JDV75.35.33.C11.1.454.CMB.1.raw
  modified_base (313)..(313): a, c, t, g, unknown or other
  misc_feature (313)..(313): n is a, c, g, or t
tcagtacagatcgtcacgaccggtgctcgatttagagtgagctcgttggggtttgggggggagaggagcccagcactagaagtcggcggtgtttccatccggtgatcagcactgaacacagaggactcaccatggagtttgggctgagcttgggttttcctcgttgctcttttaagaggtgtccagtgtcaggtgcagctggtggagtcgtgggggaggcgtggtccagccgtgggacggtccctgagactctcctgtgaagcgtctggattcatcttacaataactagtggcatcgctacgtcggggtcccnccgaggcctccggaggacgaagggtctgggaggttggtgacgtagttgtgtggtatgtagtaggtaagtaatagatactagtgacagaccaccggtaggaacggccgtacttaccaacctatccgtacgaaggtaacgtaacctaaacttaccgaaacgtaaccttacgtttcgtcctaacgtactaaatacggaactacgctaaggacgacgaccggacgaaccgacggtacagttactacgttcgagtcgacgaagacgacggtaggtaccgggaccgtaccccggtacccggtagtaccgg

SEQ ID NO: 52904 - DNA, 888 bp, Homo sapiens
  misc_feature: GYAE6OF02HXCY7.35.33.C11.1.454.CMB.1.raw
tcagtacagatcgtcacgaccggtgctcgatttagagtgagctcgttgggtttgggggggagaggagcccagcactagaagtcggcggtgtttccatccggtgatcagcactgaacacagaggactcaccatggagtttgggctgagctggtattttccttgctactaattttaaaaggtgtccagtgtgaggtgcagctggtggagtcggtgggggaggtcgtttagggtaaacggccggtcgggggggtcccctcgagtacctccttcctgtactagttcctcgtaggtacttcgtagttactaagtcgacgtccgtggataggaacgtcgggtccgccgacggcctccgacgggccggacggggcgtagggtaggttcggggttacggtaccggttaaaacgttaaaaaccgaagggtacggttaggggaacggggtacgggaaaccaaaccgtaacggtaaccgtaacggtccggtacgggtaacccggttaaggaaacgggtccgtaacggttaccaacccgtagtacctaacggaaagacggtatacggtaacttaaccggaaaacggttaaaacccgttccctttaagtccgtaagaaacttaaaacgtcgaaaacgtaccgtaacccgtaaaggaaaaacccgggtagaaccctaacgttacccgttaacccctttttaagttaaccgtttaccccggtaaaccccttaaacccgtttaaacgtaacccgtttaacttttaccgtaacggttaaaccgtaacggttaccggggtttaaccgggggttaacccgtttaaccggggtacggggggtaacccctaaagggggttaaaccccttacccggggttaacgggttacccctaacccccggttacccg

SEQ ID NO: 52905 - DNA, 905 bp, Homo sapiens
  misc_feature: GYAE6OF02HBKZI.35.33.C11.1.454.CMB.1.raw
tcagtacagatcgtcacgaccggtgctcgatttagagtgagctcgttggggtttgggggggagaggagcccagcactagaagtcggcggtgtttccatccggtgatcagcactgaacacagaggactcaccatggagtttgggctgagcttgggttttcctcgttgcttactttaagaggtgtcctagtgtcaggtgcagctgggtggacgtcggtggggggagcggtgggcctaggccgtggggacggtccctggacgtacctccttccgtggtcggaacgtcgttacgtgggttaacttctaattccttttacgaaaacttaacttacgtggaacctattacggcctacggttcggggtcccgtaccgacgggtcctacccgaagggaccggaaagggtacccgttaggggtacggggtttacgggttacgggaccgtttaagggtttcgggtagggtttagggttaacgtggggtaaagggtttaagggtaaaaacggtttaaagttaccgggtaaatttacgttaacggtacggaactaaccggtaaccggtaacgggtaaggggaaaccggggtcccttaaaggttaccccaaacgttacgtacccttaaccgggaacgtaaacggtaaccttaaacgtttaaccccaaaaggtttaaccctttacggttttacgttacccgtaaaggaccttaaaacggtaacggtaaccctaacggtaccgtttaacggggaacggaaaccgggttcccggggaaacggtaaacccccggtaagggtaccgggtaacgtttaatttaccggttaaacggttccggttagggaacccgggtaaggtaaccgggtacggtaacgggttaacccgggaaccccgtcccccggttaacgggtactaacgggg

SEQ ID NO: 52906 - DNA, 780 bp, Homo sapiens
  misc_feature: GYAE6OF02GO34R.35.33.C11.1.454.CMB.1.raw
  modified_base (266)..(266): a, c, t, g, unknown or other
  misc_feature (266)..(266): n is a, c, g, or t
tcagtacagatcgtcacgaccggtgctcgatttagagtgagctcgttgggtttgggggggagaggagcccagcactagaagtcggcggtgtttccatccggtgatcagcactgaacacagaggactcaccatggagtttgggctgagtctgggttttcctcgttgcttacttttaagaggtcgtaccagtcgtcaggtgcaggctggtggacgtcgtgggggaggcgtggtccagccgtagggacggtccctgacgacctctctgngacgcgtcgtgattcatcttacaataactgtggcagtcgacgtacgtcgggtccgaccgaggtcctaccgaggtaccgaaacggggtcgtagggtacgggtgggttcggacgtagggtttggtcggttaggttaagttaggtaggttaaggggtaaaagttaaagtaacggtaatttaaccgtaagtccggactaaacggtaccccgaacgggttaagggaaccgggtacctaacgtttacccgaaccttacttaccgttacccgaaaggtaaccgtaaaccgtaaaccgttaacccgaaaacggttaaacctttccgttttacgtaaccgtaacgtaaacgtaaacgttacggaaaacctaccgtacctagggaacgaccggggacccggtaaaggaacccggtaacgggtaactaagttaactttaacgtacgtacggttacggaacggtaaacacggggttaccgaacggttcgggaaccccggtaccccgtaacccgggagttaacccgg

SEQ ID NO: 52907 - DNA, 803 bp, Homo sapiens
  misc_feature: GYAE6OF02I9OI4.35.33.C11.1.454.CMB.1.raw
tcagtacagatcgtcacgaccggtgctcgatttagagtgagctcgttgggtttggggggagaggagcccagcactagaagtcggcggtgtttccatccggtgatcagcactgaacacagaggactcaccatggagtttggctgagcttgggttttcctcgttgcttacgttttaagagtgtccagtgtcaggtgcagcgtggtaggagtcggtggggaggtcggtggtccaggcccgtggggtacgtccctagacgtccgttctccgtgtacgaagtcgttgtcggtatttccgatttaccttactaaattaaccttagtcggtactaatcggtacctaccgggttccggggttaccccgaccggtaacgggtccctaccggtaaggaccgggtaaaacggggtaccgttaggggtaacggttttcgggttgggacctttaggggttttggtgggtttaggtagtagttaaggtagggtaaaagtttaacgagtttaacgtaacgttagtacgtacgaaacggaaccgtaccggtaggaacgggtaccgtacgtaccactacgtcctacgtacgaatacctaacgggttaacaacgttaacgttacgtttacgtaccgtacgtaacgtaaacgtaacgaaccgtaacgtaccgtaggaacggtaccggtaaccggaaaccggtaacgaaccgggtaacgtaaccgttttaagttaaccgtttccggttaaggtcggaaaggtaacgtaacggacggtacgggtaccgggaccccggtaacccccggttacccggtagtaccgg

SEQ ID NO: 52908 - DNA, 864 bp, Homo sapiens
  misc_feature: GYAE6OF02I672G.35.33.C11.1.454.CMB.1.raw
tcagtacagatcgtcacgaccggtgctcgatttagagtgagctcgttggggtttgggggggagaggagcccagcactagaagtcggcggtgtttccatccggtgatcagcactgaacacagaggactcaccatggagtttgggctgagctgggttttcctcgttgctcttttaagaggtgtccagtgtcaggtgcagcgtggtggagtcgtgggggaggcgtggtccagccgtgggacggtccctgagactctcctgtgagcgtctggattcatcttcaataactatggcatgcctacgtcgggtcccgccgacggcctaccgacgggaccgaaacggggacgttgggaagggttgggttcgggcgtaagggtttggtagggttggttaagtaggaagttaacggggtaaaagttaaaggttaaggtaaacttaaccgtttaagtacggacgtaaacggtaaccgtaacccggggttaagggaaaccgggggtaccccgttaaacgtttaaccccgaaccccgttaacgttaccccgttaaccgaaacgggaaacgttaaacccgtaaaaccgtttaaaccccgtaaaaaggttaaaacccctttaacgttttttaccggtttaacccccttaacggtaaaccgttaaaaaaccggttacggtaaaaacccgttaccggtaacccgtttaaggaacgggaaccgggttaacccggaaacgggtaaaccggaaccggggtaaccgtaatttaacggttaaacgtttaacccggtaggttacgggtaaacggtaaccgggaaagggtaccggtaacggttaccggggaacccgtccccccgggtaaaccccgggtagtaaccgggg

SEQ ID NO: 52909 - DNA, 662 bp, Homo sapiens
  misc_feature: GYAE6OF02F5JPK.35.33.C11.1.454.CMB.1.raw
  modified_base (195)..(195): a, c, t, g, unknown or other
  misc_feature (195)..(195): n is a, c, g, or t
  modified_base (271)..(271): a, c, t, g, unknown or other
  misc_feature (271)..(271): n is a, c, g, or t
  modified_base (294)..(294): a, c, t, g, unknown or other
  misc_feature (294)..(294): n is a, c, g, or t
  modified_base (297)..(297): a, c, t, g, unknown or other
  misc_feature (297)..(297): n is a, c, g, or t
  modified_base (301)..(301): a, c, t, g, unknown or other
  misc_feature (301)..(301): n is a, c, g, or t
  modified_base (312)..(312): a, c, t, g, unknown or other
  misc_feature (312)..(312): n is a, c, g, or t
  modified_base (319)..(319): a, c, t, g, unknown or other
  misc_feature (319)..(319): n is a, c, g, or t
  modified_base (375)..(375): a, c, t, g, unknown or other
  misc_feature (375)..(375): n is a, c, g, or t
  modified_base (386)..(386): a, c, t, g, unknown or other
  misc_feature (386)..(386): n is a, c, g, or t
tcagtacagatcgtcacgaccggtgctcgatttagagtgagctcgttgggtttggggggggagaggagcccagcactagaagtcggcggtgtttccatccggtgatcagcactgaacacagaggactcaccatgggagtttggggctgagctgggttttcctgttgctcttttaagaggtgtccagtgtcaggtncagctggtggagtcgtgggggaggcgtggtccagtccgtggggacgtccctgacgacttctcgtgtagagtccgtntggattcattcctacaataactnggnagtnccagtgggccncgagccncgaggacgagggctggagtggtgctaggttgtggtggtatggtataggtaagtaangtaactacgtnacggacaagcgtaacgggaggtacgggtacgtacttacgaccctagtacctacgaacgaacgtaataaccgttaacgaaacgtaacttacgtttacgttcccaagtaactaaacgtaacgtaacgtacgaccgtagacgaccggaccgaaacggaccgaacgggactacttaacgttaacgttaacggtacggttaacggaccggtaaaggaacggtacggtacgggtaaccgggtaccccggtaacccgggttaacccccggtagtaacccgggg

SEQ ID NO: 52910 - DNA, 651 bp, Homo sapiens
  misc_feature: GYAE6OF02H1QK0.35.33.C11.1.454.CMB.1.raw
  modified_base (175)..(175): a, c, t, g, unknown or other
  misc_feature (175)..(175): n is a, c, g, or t
tcagtacagatcgtcacgaccggtgctcgatttagagtgagctcgttgggtttgggggggagagggagcccagcactagaagtcggcggtgtttccatccggtgatcagcactgaacacagaggactcaccatggagtttgggctgagctggttttcctcgttgctcttttaagnggtgtccagtgtcaggtgcagctggtggagtcgtgggggagcgtggtccagcctggggacgtcctggacgactcgtccgtgtagaacgtcgtcgtggattcgaattcttacaaagttaactagtggcctaattggacctacgtcgggtcccgcaaggcctccgaggacgaagggactgggagttggttaggctagttggtgtaggtactggagtaggtaaattagaggtaattaccgtaatggacgtaagacggtaccggtaaggaacgggtccgtacgttaccgaacctagtacctacgaggaacgaacgtaaactaaccgaaacgtaacgttacgtttccgttacacgtaaccgaaacgtagaaccgacgtaccgtaggacgtaacgaccgagaccgtaggactagtacttacgtacgttgacgtacgaagacggtacgaggttacggaccgtaccggtacccgtagtaacggg

SEQ ID NO: 52911 - DNA, 673 bp, Homo sapiens
  misc_feature: GYAE6OF02I473R.35.33.C11.1.454.CMB.1.raw
  modified_base (179)..(179): a, c, t, g, unknown or other
  misc_feature (179)..(179): n is a, c, g, or t
  modified_base (328)..(328): a, c, t, g, unknown or other
  misc_feature (328)..(328): n is a, c, g, or t
  modified_base (360)..(360): a, c, t, g, unknown or other
  misc_feature (360)..(360): n is a, c, g, or t
  modified_base (529)..(529): a, c, t, g, unknown or other
  misc_feature (529)..(529): n is a, c, g, or t
  modified_base (642)..(642): a, c, t, g, unknown or other
  misc_feature (642)..(642): n is a, c, g, or t
  modified_base (668)..(668): a, c, t, g, unknown or other
  misc_feature (668)..(668): n is a, c, g, or t
tcagtacagatcgtcacgaccggtgctcgatttagagtgagctcgttgggtttgggggggagaggagcccagcactagaagtcggcggtgtttcatccggtgatcagcactgaacacagaggactcaccatggtagtttgggctgagcgttgggttttcctcgttgcttcttttaaagnggtcgtcagtgtcaggtgcagtgtgggtcggacgtcgtgggggagcgtggtaccagccgtggggcgtccctggacgtacctcgtcctggtagacgtcgtcgtggtattcattcttacaattaactgtcggctatcgctacgttcggccnccgtagcctccgaggccgtaacgggtctgggngttcggttcggacttaggttgtggtgtatgtagtaggtaatacgtaagtacttacgtagtggtaccgaacgtaaccgcgggtaaggacgggtaaccgtactttacccaaccgtacgtttcccaagacggactaaaccgttaacccgttaacccgaaaagttaacctttntttaccgttcccaagtaacctaaagtacgaaacctacggtacgtcggaggtaaccggacccggtaaggaccgtaacggtgttatacgttacgtacgtagtcgacgaaggacgnggacgtcggaccaccccggtacggtntacgg

SEQ ID NO: 52912 - DNA, 727 bp, Homo sapiens
  misc_feature: GYAE6OF02FVN9W.35.33.C11.1.454.CMB.1.raw
  modified_base (281)..(281): a, c, t, g, unknown or other
  misc_feature (281)..(281): n is a, c, g, or t
tcagtacagatcgtcacgaccggtgctcgatttagagtgagctcgttgggtttgggggggagaggagcccagcactagaagtcggcggtgtttccatccggtgatcagcactgaacacagaggactcaccatggagtttgggctgagctgggttttcctcgttgctcttttaagaggtgtccagtgtcaggtgcagcgtggtggagtcgtgggggagcgtggtccagcctggggagtccctgacgctctcctggtgaagcgtcgtggtattcattccttanaaattaactatggccagtcgacacgtcggggtaccgccgtaggcctccgaagggccaaagggggctagggacggttgggttcggactaggttcgtaggtggttagtggtagtagggtaaaagtaagtacgagtaactagtacggacgaaaggaccgaaccgggttagggaaacgggtaccgtaacgtttaccgaaaccctacgttaccgtacccgtaaaggaaaccggtaactaaaccgtttaacccaaaacggttaaaccttaaccgtttttacgtaccctaaggtaaccctaaagtacgaaaccgacgtaccgtaaggaacgtacggaaccgaacgggaaccgacgggtaccaagttaacgtagtttaaccgtaggtacgaaccggtaaggaaccggtaggaacggtcggggtaaccgtacccccggtaacccggagtaaccgg

SEQ ID NO: 52913 - DNA, 246 bp, Homo sapiens
  misc_feature: GYAE6OF01D533P.52.57.F02.1.454.CMB.1.raw
  modified_base (244)..(246): a, c, t, g, unknown or other
  misc_feature (244)..(246): n is a, c, g, or t
tcagcgcagtacgacacgaccggtgctcgatttagctcgatatagttgggtttgggattcacgttgcagatgtaggtctgggtgcccaagctgctggagtgggtctcagcctccaccaagggcccatcggtcttccccctggcaccctcctccaagagcacctctgggggcacagcggccctgggctgcctggtcaaggactacttcctatacgatcgctgagcgggctggcaaggcgcatagnnn

SEQ ID NO: 52914 - DNA, 245 bp, Homo sapiens
  misc_feature: GYAE6OF01BTTZL.52.57.F02.1.454.CMB.1.raw
  modified_base (244)..(245): a, c, t, g, unknown or other
  misc_feature (244)..(245): n is a, c, g, or t
tcagcgcagtacgacacgaccggtgctcgatttagctcgatatagttgggtttgggattcacgttgcagatgtaggtctgggtgcccaagctgctggagtgggtctcagcctccaccaagggcccatcggtcttccccctggcaccctcctccaagagcacctctgggggcacagcggccctgggctgcctggtcaaggactacttcctatacgatcgctgagcgggctggcaaggcgcatagnn

SEQ ID NO: 52915 - DNA, 246 bp, Homo sapiens; identical to SEQ ID NO: 52913
  misc_feature: GYAE6OF01EXZJ0.52.57.F02.1.454.CMB.1.raw
  modified_base (244)..(246): a, c, t, g, unknown or other
  misc_feature (244)..(246): n is a, c, g, or t

SEQ ID NO: 52916 - DNA, 244 bp, Homo sapiens
  misc_feature: GYAE6OF01AXVST.52.57.F02.1.454.CMB.1.raw
  modified_base (243)..(244): a, c, t, g, unknown or other
  misc_feature (243)..(244): n is a, c, g, or t
tcagcgcagtacgacacgaccggtgctcgatttagctcgatatagttgggtttgggattcacgttgcagatgtaggtctgggtgcccaagctgctggagtggtctcagcctccaccaagggcccatcggtcttccccctggcaccctcctccaagagcacctctgggggcacagcggccctgggctgcctggtcaaggactacttcctatacgatcgctgagcgggctggcaaggcgcatagnn

SEQ ID NO: 52917 - DNA, 247 bp, Homo sapiens
  misc_feature: GYAE6OF01ANYEZ.52.57.F02.1.454.CMB.1.raw
  modified_base (244)..(247): a, c, t, g, unknown or other
  misc_feature (244)..(247): n is a, c, g, or t
tcagcgcagtacgacacgaccggtgctcgatttagctcgatatagttgggtttgggattcacgttgcagatgtaggtctgggtgcccaagctgctggagtgggtctcagcctccaccaagggcccatcggtcttccccctggcaccctcctccaagagcacctctgggggcacagcggccctgggctgcctggtcaaggactacttcctatacgatcgctgagcgggctggcaaggcgcatagnnnn

SEQ ID NO: 52918 - DNA, 733 bp, Homo sapiens
  misc_feature: GYAE6OF01BKNEL.52.57.F02.1.454.CMB.1.raw
  modified_base (239)..(239): a, c, t, g, unknown or other
  misc_feature (239)..(239): n is a, c, g, or t
tcagcgcagtacgacacgaccggtgctcgatttagctcgatatagttgggtttggggggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcacatctctgcactggatccagcagtgacgttggncttatgtactttgtctctggtaccaacaccacctggacaaacgccccaactcatctattttgacgtcacgtaacgccggtccctcgacgggtccctgtactccggtcctttccgtcgtcggtccgttacgaacgttccgtacggtaccaaaccggacccggtccccttcccgtacggtacccgttctcggtacggcctcccgagggtcctaggacggtagtaggacggtcctaggtaacttaccgtacgtacgtccctaacccgtctaactacggttcgaccgtaacgggtaccgtaaaccgttaaacggttaccggggtttttcgggggggttaacccggacggggtaacggggtaacccgtaagggttccgggtaaccccggttaccgttaaccggtaccggacccggtaccccggaaacgggttccccgtacccccggtaccccccggttcgttacccctaccgtttcccgttccccgtttaacccccccg

SEQ ID NO: 52919 - DNA, 615 bp, Homo sapiens
  misc_feature: GYAE6OF01AQS4Z.52.57.F02.1.454.CMB.1.raw
  modified_base (246)..(246): a, c, t, g, unknown or other
  misc_feature (246)..(246): n is a, c, g, or t
  modified_base (411)..(411): a, c, t, g, unknown or other
  misc_feature (411)..(411): n is a, c, g, or t
tcagcgcagtacgacacgaccggtgctcgatttagctcgatatagttgggtttggggggggttcggtcgaggaggcgagcgctctcaggacgtcaccaccatggcctgggctctgctcctcctcacctcctcactcagggcacagggtcctgggcccagtctgccctgactcagcctccctccgcgtccgggtctcctggacagtcagtcaccatctcctgcactggatccagcagtgacgttggncttatgtacttgtctctcggtaccacaccacctggacaacgccccaactcatctattttgacggtcacgtaacgcggccctcgacgggtcctgactcgtcttctctggctcgagtctgcaacgaccgcctcctcgcctctcgtcgggctccgagtcgtgaggtanggtacgacgttagacttactacgtcgtaccaccgtctatacgtcgacagggacaacgtaagttaacgggttttcggggtttacggacggggtacggtaaccgacgggtaccggtacccgttacgtaccgtcgaccggtcccgaaccggtcctcccggtacccccggttacggtaccgtacccgtttccgtcccgtttacccccg

SEQ ID NO: 52920 - DNA, 600 bp, Homo sapiens
  misc_feature: GYAE6OF01BZGS6.52.57.F02.1.454.CMB.1.raw
  modified_base (244)..(244): a, c, t, g, unknown or other
  misc_feature (244)..(244): n is a, c, g, or t
  modified_base (361)..(361): a, c, t, g, unknown or other
  misc_feature (361)..(361): n is a, c, g, or t
tcagcgcagtacgacacgaccggtgctcgatttagctcgatatagttgggtttggggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctcctgcactggatccagcagtgacgttggtncttatgactttgtctcctggtaccaacaccacctggcaacgcccccaaactcatcattttgagtcactaagcggcctcagggtccctgatcgcttctctgctcgaagtctggcaacncgcctccctgaccgtctcgtgggctccgaggctggacggatggaggtctgatttactacgtgctacctcatatcgcacggaccgtaacgtaacgtaaggttttcggggggtttacggacgggtaacggggaccgtaacggggtcgtaacccggttcccgtaaccggttcacggtccccgtaaagggtccctcccggtccccccgtcgggtacctacccgttccgttccggttccccccg

SEQ ID NO: 52921 - DNA, 596 bp, Homo sapiens
  misc_feature: GYAE6OF01DOPVT.52.57.F02.1.454.CMB.1.raw
  modified_base (199)..(199): a, c, t, g, unknown or other
  misc_feature (199)..(199): n is a, c, g, or t
  modified_base (242)..(242): a, c, t, g, unknown or other
  misc_feature (242)..(242): n is a, c, g, or t
  modified_base (248)..(248): a, c, t, g, unknown or other
  misc_feature (248)..(248): n is a, c, g, or t
  modified_base (457)..(457): a, c, t, g, unknown or other
  misc_feature (457)..(457): n is a, c, g, or t
tcagcgcagtacgacacgaccggtgctcgatttagctcgatatagttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacngtcagtcaccatctcctgcactggatccagcagtgacgttggngcttangactttgtctcctggtaccaacaccaccctggaccaaagcccccaaactcatctattttgaggtcactaagcggccctcgacgggtccctgatcgtcttctctggctcgaagtctggcaacacggcctccctgacccgttctcgtcggggcctcccgaggtcctggaagggattggaaggtcttggatttacgtactgcctacctcatntgcaggacgaactaacgttaaggttttcggggtttacggcgggtaacgggtacctaagggtccgtaccgtccgtaacggtcacggccccgaaggtcctaccggtccccccttggtacctacctcgtccgttaccccccg

SEQ ID NO: 52922 - DNA, 758 bp, Homo sapiens
  misc_feature: GYAE6OF01CXLI8.52.57.F02.1.454.CMB.1.raw
  modified_base (250)..(250): a, c, t, g, unknown or other
  misc_feature (250)..(250): n is a, c, g, or t
tcagcgcagtacgacacgaccggtgctcgatttagctcgatatagttgggtttggggggggtctcaggaggcagcgctctcaggacgtcaccaccatggcctgggctctgctcctcctcaccctcctcactcagggcacaggtcctgggcccagtctgccctgactcagcctccctccgcgtccgggtctcctggaccagtcagtcaccatcctcctgccacgtggactccagcagtcgtacggtttggntctttagtcgtacttttcggtcttccgtacggtaacccaaaccaacccacccgtggaaccaaaaccgacccccctaaaactcctaacttaccttaagttttttcggaacggttaccctaaaccggttaacggtcccgggtacccccgttacggtaaccgggggttcccctaggtaccgttcccggtcctttcctcgtcggtctacggtaacgttcgtcggaaccaaccgtacccggtcccttcccgtcggtacccgttcgtcgttcgggccttccgaggtccgtaggacggtatcggacggtctagtacgttacctacgtcgaccctaccgtacattagtacgaccgtaagggaccgtaaacgttaacgtttaaggggtttttcggggggttaccggacgggtaacgggtaaaccgtaggttccggtaccgtccgttacgaccgaccggtaccacggtacccgtcccgtcccccgtaggtacctacccgttcgttccccggtaccccc

SEQ ID NO: 52923 - DNA, 778 bp, Homo sapiens
  misc_feature: GYAE6OF01CQC1F.52.57.F02.1.454.CMB.1.raw
tcagcgcagtacgacacgaccggtgctcgatttagctcgatatagttgggtttggggggggtctcaggaggcagcgctctcaggacgtcaccaccatggcctgggctctgctcctcctcaccctcctcactcagggcacgaggtcctgggcccagtctgccctgactcagcctccctccgcgtccgggtctcctggacagtcagtcacatctcctgcactggactccagcagtgtacgttggtgcttatgtactttgtcttccgtacggttaaccaacctacccacccgtggaaccaaaccgacccccaaatcactaccttagtttttgacggttcaactaacgccgtccctgtaccgggtccctgacttccgtcttctcgtcggcctacggaacgttcgtcggaccaaccgtaccggtccctacccgtacggtacccgtcgtaccgtcgggtacccttaccggacggtccgttaggaacggtacgttacgggaacggtccgtttaggtaaccttttaaccgtacgtaccgtaccctaaccccttagtaacgttacgttacggtaccgaaccgggtacctaaaccgttaacggtttaaaggggtttttccggggggttttacggaccggggtaaacgggttaaccgtacggggttaccgtaacccggttacccggtaacggttacccgaacccggtaccccggtaacgggtccccttacccgggtacccccccgttacgggtacccctacgttaccccgttcccggtttaaccccccc

SEQ ID NO: 52924 - DNA, 425 bp, Homo sapiens
  misc_feature: GYAE6OF01BECQB.52.57.F02.1.454.CMB.1.raw
  modified_base (416)..(425): a, c, t, g, unknown or other
  misc_feature (416)..(425): n is a, c, g, or t
tcagcgcagtacgacacgaccggtgctcgatttagctcgatatagttgggtttgggggccttgccagggtggtgttggtgcttatgactttgtctcctggtaccaacaccaccctggcaaagcccccaaactcatcatttttgaggtcactaagcggccctcaggggtccctgatcgcttctctggctcgaagtctggcaacacggcctccctgaccgtctctgggctccaggctgaggatgaggctgattactactgcacctcatatgcaggcgaacaacgtaagttttgggggtttcgcggagggaccaagggtcgaccgtctacgcacggcccaaggctcgcccctggtcactctcgttccccgcctctctatacgatcgctggacggcggtctaggcaaggtccacgatagnnnnnnnnnn

SEQ ID NO: 52925 - DNA, 842 bp, Homo sapiens
  misc_feature: GYAE6OF01C24WC.52.57.F02.1.454.CMB.1.raw
  modified_base (251)..(251): a, c, t, g, unknown or other
  misc_feature (251)..(251): n is a, c, g, or t
  modified_base (257)..(257): a, c, t, g, unknown or other
  misc_feature (257)..(257): n is a, c, g, or t
tcagcgcagtacgacacgaccggtgctcgatttagctcgatatagttgggtttggggggggtctcaggaggcagcgctctcaggacgtcaccaccatggcctgggctctgctcctcctccaccctcctcactcgagggcacgagggtcctgggcccagtctgccctgactcagcctccctccgcgtccgggtctccgtggacagtcagtcaccatctcctgcacgtggactccgagcaggtgacggttggntcttangttactttgtctccgtacgtaaccaaccacctaccgtgaccaaaccgacccccaaactctacttcttagtttcggacgtaccaacgtaacggcccggtaccctacggaccggggttccctagtaccgttccgtctttaccgtcgtcggtaccgttacggtaacgttccgtacggaaccaaccggtacccggtcccttcccgtaccggtacccgttcgtaccggttcggggtccctaccgggtacgggtaccggttagggaacgggtaacggtcgggtaacgggttaccttaggttaacctttaacccggaaccggttaccgacccctaacctttacggtaacttcgttaccgaacgggaaccggtaacccggtaacgttaacggggttttaacggggttttttaccgggggggttaccgggaaccgggtaacggggttaacccggttaaacggggttcccgggtaacccgtttaacccggtaccgtacccgggtaaaccggaccccgttaacggttccccgtaccccgggtacccccgttacggttacccttacccggttccccgtttaaccccggttacccccc

SEQ ID NO: 52926 - DNA, 645 bp, Homo sapiens
  misc_feature: GYAE6OF01AY4BR.52.57.F02.1.454.CMB.1.raw
  modified_base (243)..(243): a, c, t, g, unknown or other
  misc_feature (243)..(243): n is a, c, g, or t
  modified_base (299)..(299): a, c, t, g, unknown or other
  misc_feature (299)..(299): n is a, c, g, or t
tcagcgcagtacgacacgaccggtgctcgatttagctcgatatagttgggtttggggggggtctcaggaggcagcgctctcaggacgtcaccaccatggcctgggctctgctcctcctcaccctcctcactcagggcacagggtcctgggcccagtctgccctgactcagcctccctcgcgtccggtctcctggacagtcagtcaccatctcctgcactggactccagcagtcgacgttggtncttatgacttgtctcctggtaccaacaccacctcgacaacgccccaaactcatctnttttgacgtcactaacgccgtcctcgacgggtcctgactcgtcttctcgtcggctcgacgtcgtcggacacgaccggtcctcccgtcgtacccgtctcgtcggtcctcgaggctggacggtagtacggacgtacgtacgtactttacgtactcgtactacctactactacgtcgtacgacggtacgaaccgtaaccggtttaacgggtttcggggggttttaccggacgggtaaccgggaccgtaaacgggtccgtaccggttaccgtacggtaccgaaccggtcccgaacgggtcccgtcccgtacccccgttcggtacctacccgttccgtttcccgttccccg

SEQ ID NO: 52927 - DNA, 799 bp, Homo sapiens
  misc_feature: GYAE6OF01B6PZL.52.57.F02.1.454.CMB.1.raw
  modified_base (246)..(246): a, c, t, g, unknown or other
  misc_feature (246)..(246): n is a, c, g, or t
tcagcgcagtacgacacgaccggtgctcgatttagctcgatatagttgggtttggggggggtctcaggaggcagcgctctcaggacgtcaccaccatggcctgggctctgctcctcctcaccctcctcactcgagggcacagggtcctgggcccagtctgccctgactcagcctccctcgcgtccgggtctccgtggacagtcagtccacatcctcctgcatgactccgagcaggtcgacgttggngtcttatcgtactttcgtctcgtcgtaccaacacccaccgtgaccaaaccgccccaaactctacttactagttttacggacgtactactaacggccggtaccctacggtaccggggtacctggtaacgtccggtcttccgtaggtcggtaccgttacggaacgttcgtacgggacctaaccgaccggtccctacccgtacggtaccccgtctaccggttcgggaccctaccgggtacgtccggtaggaacgggtacgtacggtacggtacgttaggttaactttaaccgtacgtaccggtaccctaaccttacgtaacgttacgtcggtacccgtaaggtaacccggtaaacgtttaaaaccgggtttacgggtttttaggggggtttaacccggaccggggtaaccgggtaaccggtaacgggttacccggtaccccggtttaccgtaacggtaacccggacggtaacccccggtacgggtcccgtaccccgggttacccccgttaccgggttacccttaaacggttcccccgttacccgtttaaccccccg

SEQ ID NO: 52928 - DNA, 928 bp, Homo sapiens
  misc_feature: GYAE6OF01D0V2X.52.57.F02.1.454.CMB.1.raw
  modified_base (246)..(246): a, c, t, g, unknown or other
  misc_feature (246)..(246): n is a, c, g, or t
tcagcgcagtacgacacgaccggtgctcgatttagctcgatatagttggggttggggggggtctcaggaggcagcgctctcaggacgtcaccaccatggcctgggctctgctcctcctcaccctcctcactcgacgggcacgtagggtcctgggccctagtctcggccctgacctacgacgtccctccctccggccggttcccgggtccttcccgtacgggacctacggtccacgtaccaaccctnttcccttaccgtcggacctaacgttcgggaaccttccgaagtccgaacgggttacggttaccggtttgggggtcctttaacgtttacgttacggtttaccgttttcggtacccgtttaccggttaaccggttaaaccccaaacccgttaacccccgtaccggtaacccggaaacccgtaaaaaccccggtaccccccctaaaagttcctaacgtttaccgttttaagttttacgggaaccgttaccgtaaaccggttaccgggcccggtacccttacgggtacccgggttacctagtccgttcgttaccgtttccgttcgtaccgggtactttaaccgggaacgttcggttacccggaaaccttaacccgggcccggtacccttccgtaaccggttcccgttcggttccgtccgggtacctaccgggtgaccgggtaggacggttacgggagccggttataacggttacctttaccgtaacggtcctaacctcgttaacaatttaccggcgaaccgggtaacggtaccgttaaacggtttaccggggttaggggttttccgggggtaacgggacgggtaaacggaccgttaaggtaccccgtaccggttaacggtaccacccgggtaacgtcccgacggtcccgtcccgtacccgtgtacccctcggtcccttccccgtccg

SEQ ID NO: 52929 - DNA, 653 bp, Homo sapiens
  misc_feature: GYAE6OF01DFUHM.52.57.F02.1.454.CMB.1.raw
  modified_base (200)..(200): a, c, t, g, unknown or other
  misc_feature (200)..(200): n is a, c, g, or t
  modified_base (210)..(210): a, c, t, g, unknown or other
  misc_feature (210)..(210): n is a, c, g, or t
  modified_base (215)..(215): a, c, t, g, unknown or other
  misc_feature (215)..(215): n is a, c, g, or t
  modified_base (239)..(239): a, c, t, g, unknown or other
  misc_feature (239)..(239): n is a, c, g, or t
  modified_base (245)..(245): a, c, t, g, unknown or other
  misc_feature (245)..(245): n is a, c, g, or t
tcagcgcagtacgacacgaccggtgctcgatttagctcgatatagttgggtttggggggggtctcaggaggcagcgctctcaggacgtcaccaccatggcctgggctctgctcctcctccaccctcctcactcgagggcacgagggtcctgggcccagtctgccctgactcagccctcctccgcgtccggtctctggacngtcagtcacntctcngcactgactcagcagtgacgttgntcttangtactttgtctcgtacgtaccaacaccaccgtgacaacacccaatcatcttatttagagtcactacgcgtcctgcgggtcctgacgtctcttctcgtgctacgagttcgtacgaccgaacgtaccggcccttccgtacgtaccgttccgtacgtcggtccctaccgacggtcgtacggaggtacgtcggacggtcttagtaactttacgtacgtacgtaccgtacctacaacgtacgtcgacgtaacggacgtaacgttaacggttacggggtttttccgggggttacggacgggtaacgggaaccgttaacgggtccgtaaccgtccgtaaccgtccgaaccggtcccgaacgggttccctaccccgggtcccgttacggtaccctcctcccgtttcccgtaccccc

SEQ ID NO: 52930 - DNA, 712 bp, Homo sapiens
  misc_feature: GYAE6OF01DT80O.52.57.F02.1.454.CMB.1.raw
  modified_base (246)..(246): a, c, t, g, unknown or other
  misc_feature (246)..(246): n is a, c, g, or t
tcagcgcagtacgacacgaccggtgctcgatttagctcgatatagttgggtttggggggggtctcaggaggcagcgctctcaggacgtcaaccaccatggcctgggctctgctcctcctcaccctcctcactcgagggcacgagggtcctgggcccagtctgccctgactcacgccctcctccgcgtccggtctccgtggacagtcagtcacatctcctgcacgtgatccagcagtcgtcgttgtntcttagtgtctttcgtactccgtacgtaaccaaccaccaccgtacgaaccaaaccgaccccctaactactacttcttaacgttttcggacgtacgtaacgtaacggtccgtacctcgggtaacgggtccctagtactcgtcttcgtcgtcggtctacgtacgtcgtacgacaaccgtccggtcctccgtcgtaccgttcgtacgtcgggtcctacgacggtcgtaggaggtactggtacggtactacgtaacttacgtaacgtccgtacctaacgtctactcgtcgacgacggtaacgaacgttaggtttacggggtttcgggggttaccgggacgggtaaccgggaacgtaacgggtacccgtaccggttaccgtaaccggttaccggaccggtacccgtaaccggtccgtccccggttaccccccggtaggttacccctaccgttcccgttccccttacccccg

SEQ ID NO: 52931 - DNA, 797 bp, Homo sapiens
  misc_feature: GYAE6OF01AK4S8.52.57.F02.1.454.CMB.1.raw
  modified_base (577)..(577): a, c, t, g, unknown or other
  misc_feature (577)..(577): n is a, c, g, or t
tcagcgcagtacgacacgaccggtgctcgatttagctcgatatagttgggtttgggggggggtctcaggaggcagcgctctcaggacgtcaccaccatggcctgggctctgctcctcctcaccctctcactcgagggcacagggtcctgggcccagtctgccctgactcagccctccctccgcggtcccgggtctccgtggacagtcacgtccaccatcctcctgcactggactccagcctaggtcgtacggttggtcgtctttagtcgtacttttgtccttccgtacggtaacccaaccacccgtaccctaggaccaaaaccgacccccctaaaactcctaacttacctttagttttacggacggttaccaacgtaacggcccggtaccctacggaccggggttccctagtacttccgtacttccgtcgtacggctacggtaacgtcgtcggaaccaccggtacccgtccctcccgtacggtacccgtcgtcgtcgggtccctaccggaaggtcgttagggacgtacgtacggtacggtcttagtaactttaccgtacgtaccgacctaaccgttntaacgtagtacggaccgtacggtaaccgtaaacgttaaaccggtttaacggggttttccgggggtttaaccgggaccgggtaaccgggttaaccggtaacgggttacccggtaacccgttaccggtaaccgtaccggaaccgggtacccggaacggtccccggtcccgttacccccggttacggttaccctacccgtttccgttccccgttaaccccccg

SEQ ID NO: 52932 - DNA, 722 bp, Homo sapiens
  misc_feature: GYAE6OF01BQA1I.52.57.F02.1.454.CMB.1.raw
  modified_base (506)..(506): a, c, t, g, unknown or other
  misc_feature (506)..(506): n is a, c, g, or t
  modified_base (521)..(521): a, c, t, g, unknown or other
  misc_feature (521)..(521): n is a, c, g, or t
  modified_base (542)..(542): a, c, t, g, unknown or other
  misc_feature (542)..(542): n is a, c, g, or t
  modified_base (703)..(703): a, c, t, g, unknown or other
  misc_feature (703)..(703): n is a, c, g, or t
tcagcgcagtacgacacgaccggtgctcgatttagctcgatatagttgggtttggggggggtctcaggaggcagcgctctcaggacgtcaccaccatggcctgggctctgctcctcctcaccctcctcactcgagggcacgagggtcctcgggcccagtctgccctgactcacgtccctccctccgccggtccgggtctccgtggactagtcagtccaacctatcctcctgcaccgtggactccagctaggtcgacggttggtctacgttagtcgtactttcgtccttccgtacggtaacccaaccacccgtacccgtacggaaccctaaacccgacccccctaaacttccgtaacgtttaccgtttaggtttttacggaacggttacctaaccggtaaacggtcccggtacccgttccgggtaccggggttccctgtacgttccgttccttcgtacgtcggtcctacgtacgtcgcgaaccacgtaccgccctcgtacgaccgtntcgggtcgctacggngtcgaggtagtagtgacggtntacgtacgttactcgtcgaccgttactactacgtacgtacgacggaacgtacgtaaccgttaagggttccgggggttttagggccgggacgggtacgtaacggtacggtcgtaccgtcgaacgtacccgacggtccgacgtcccgacccgtccgtaccggnttcctccggtcccgtcccc

SEQ ID NO: 52933 - DNA, 714 bp, Homo sapiens
  misc_feature: GYAE6OF01DAA3O.52.57.F02.1.454.CMB.1.raw
  modified_base (226)..(226): a, c, t, g, unknown or other
  misc_feature (226)..(226): n is a, c, g, or t
tcagcgcagtacgacacgaccggtgctcgatttagctcgatatagttgggtttggggggggtctcaggaggcagcgctctcaggacgtcaccaccatggcctgggctctgctcctcctccaccctcctcactcgaggcacgacgggtcctcgggcccagtctcgccctgactcagccctccctccgcggtccggtctcgtagacagtcagtcaccactcctccgtnactacgttggaactccgagcgaggttcgtacggtttggcgtactttacgtcgttacgttttcgtccttccgtacggttaacccaacgtaccctaccggtacgaccgaaaccctacccctaaactctactacgtttagtttcggacgtacctaacgtaacgtccgtaccgtacggtcgggtacctacgtacgtcctcgttcgtcgacgtcgtacggtatcgcgtacaccgccgtacctccgtaggaccttcgcggtcgtaccgccgtacggtcgtacggtaggtagtcggagtacttcgtacttacgtcgtacgacctcttacgaagtcgtacgaccgtacggtaccgtaaacgtttagggttaacgggtttcggggttacggacgggtaaccgtaacgggtacggtccgttaacccggtcggtaaccgccggtaaaccgtcgtaaccgtcccgtaccgccgttactcggtccttcgttccccgtaccc

SEQ ID NO: 52934 - DNA, 662 bp, Homo sapiens
  misc_feature: GYAE6OF01DYVBH.52.57.F02.1.454.CMB.1.raw
  modified_base (205)..(205): a, c, t, g, unknown or other
  misc_feature (205)..(205): n is a, c, g, or t
  modified_base (517)..(517): a, c, t, g, unknown or other
  misc_feature (517)..(517): n is a, c, g, or t
  modified_base (523)..(523): a, c, t, g, unknown or other
  misc_feature (523)..(523): n is a, c, g, or t
tcagcgcagtacgacacgaccggtgctcgatttagctcgatatagttgggtttggggggggtctcaggaggcagcgctctcaggacgtcaccaccatggcctgggctctgctcctcctcaccctcctcactcagggcacgagggtcctgggcccagtctcgccctgactcacgcctccctccgcggtcccgggtctccgtggacncgtcacgtcaccatcctcctgcacgtggactccagcagtggacggtttggtcgtctttagtgtacttttcgtccttccgtacggtaacccaaaccaccctaaccgtacggaaccaaaaccgaccccccaaactaccattcttagttttacgacgttacaaccgtaacgccggtcccgtacgtacgggtcctagctcgtcttcgcgtgactcgtacgtcgtcgacaacgtaccgtccctccgtcgtccgtctcggtcggtcctccgaggtcgtaggacgtagtggacggcttatacttacgtctcgcaccgtnaagtcngacgacggactaacgtaagtttaacgggtttcgggttacgggacgggtaacggacggtacggtaccgtaccgtaccgtcgacgacggtacccgacggtccctccgccccgttacgccttacgttcccgttccgtccccg

SEQ ID NO: 52935 - DNA, 279 bp, Homo sapiens
  misc_feature: GYAE6OF02HNSN7.52.57.F02.1.454.CMB.1.raw
  modified_base (244)..(279): a, c, t, g, unknown or other
  misc_feature (244)..(279): n is a, c, g, or t
tcagcgcagtacgacacgaccggtgctcgatttagctcgatatagttgggtttgggattcacgttgcagatgtaggtctgggtgcccaagctgctggacgtgggtctcagcctccaccaagggcccatcggtcttccccctggcaccctcctccgaagagcacctctgggggcacagcggccctggctgcctggtcaaggctacttcctatacgatcgctgagcgggctggcaaggcgcatagnnnnnnnnnnnnnnnnnnnnnnnnnnnnnnnnnnnn

SEQ ID NO: 52936 - DNA, 411 bp, Homo sapiens
  misc_feature: GYAE6OF02FY61U.52.57.F02.1.454.CMB.1.raw
  modified_base (261)..(261): a, c, t, g, unknown or other
  misc_feature (261)..(261): n is a, c, g, or t
  modified_base (294)..(294): a, c, t, g, unknown or other
  misc_feature (294)..(294): n is a, c, g, or t
  modified_base (401)..(411): a, c, t, g, unknown or other
  misc_feature (401)..(411): n is a, c, g, or t
tcagcgcagtacgacacgaccggtgctcgatttagctcgatatagttgggtttgggggccttgccagggtggtgttggtgcttatgactttgtctcctggtaccaacaccaccctggcaaagccccaaactcatcattttgaggtcactaagcggccctcaggggtccctgatcgcttctctggctcgaagtctggcaacacggcctccctgaccgtctctgggctccaggctgaggatgaggctgattacactgcacctnatatgcaggcgacaacaatttgggggtttcggnggagggaccaaggtgaccgtcctacgtcagcccaaggctgccccctcggtcactcttgttcccacctcctctatacgatcgctgagcgggctggcaaggcgcatagnnnnnnnnnnn

SEQ ID NO: 52937 - DNA, 406 bp, Homo sapiens
  misc_feature: GYAE6OF02HVXXP.52.57.F02.1.454.CMB.1.raw
  modified_base (263)..(263): a, c, t, g, unknown or other
  misc_feature (263)..(263): n is a, c, g, or t
  modified_base (383)..(383): a, c, t, g, unknown or other
  misc_feature (383)..(383): n is a, c, g, or t
  modified_base (392)..(392): a, c, t, g, unknown or other
  misc_feature (392)..(392): n is a, c, g, or t
  modified_base (398)..(406): a, c, t, g, unknown or other
  misc_feature (398)..(406): n is a, c, g, or t
tcagcgcagtacgacacgaccggtgctcgatttagctcgatatagttgggtttgggggccttgccagggtggtgttggtgcttatgactttgtctcctggtaccaacaccaccctggcaaagcccccaaactcatcattttgaggtcactaagcggccctcaggggtccctgatcgcttctctggctcgaagtctggcaacacggcctccctgaccgtctctgggctccaggctgaggatgaggctgattactactgcacctnatatgcaggcgacaacaagtttgggggtttcgcggagggaccaaggtgaccgtcctacgtcagcccaaggctgcccctggtcactctgttcccacctctctatacgatcgctgagcgggntggcaggcncatagnnnnnnnnn

SEQ ID NO: 52938 - DNA, 522 bp, Homo sapiens
  misc_feature: GYAE6OF02F80BS.52.57.F02.1.454.CMB.1.raw
tcagcgcagtacgacacgaccggtgctcgatttagctcgatatagttgggtttggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggatccagcagtgacgttggtgcttatgactttgtctcctggtaccaacaccaccctggcaaacgcccccaaactcatcattttgaggtcactaagcggccctcagggtccctgatcgcttctctgctcgaagtctggcaacacggcctccctgaccgtctctgggctccaggctgaggatgaggctgattactactgcacctcatatgcaggcacaactaagttttggggtttcgcggaggaccgaggtcgaccgtccgtacgtcacgccaaggctcgccccgtcggtcactctcgttcccc

SEQ ID NO: 52939 - DNA, 577 bp, Homo sapiens
  misc_feature: GYAE6OF02F13QY.52.57.F02.1.454.CMB.1.raw
tcagcgcagtacgacacgaccggtgctcgatttagctcgatatagttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggatccagcagtgacgttggtgcttatgtactttgtctcctggtaccaacaccaccctggcaaacgcccccaaatcatctattttgaggtcactaagcgccctcgagggtccctgatcgcttctctggctcgagtctggcaacgcgcctcctgaccgtctcgtggcctccaggtctgaggatgaggtctgtacttactactgccacctcatagtcgacgacggcaacgaacgttaggttttcgggggttttacggcgggtagggaccgtaagggtcgtacccgtccgtaacgtccgacgtcccgaacggtccgtaccggtcccccttacggtcctaccgttccgtccgttaccccc

SEQ ID NO: 52940 - DNA, 585 bp, Homo sapiens
  misc_feature: GYAE6OF02G98XF.52.57.F02.1.454.CMB.1.raw
tcagcgcagtacgacacgaccggtgctcgatttagctcgatatagttgggtttggggggggtcgtcaggaggcagcgctctcaggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcaatgacattggtacttataattctgtctcctggtaccaacaactaccccggacaaacgtaccccaaactcactgatctttgagtcagtgatcggcccgcgtaggggttctcgatcgtcttctccggctacaacgtctgcgagcgacggcctccctgaccatctcgtgggctccgaggctgaggacggagcgtagacttattaactcgcagcctcaattaactaaacaaacaacgaaacctacgttggggttacgttccgggcgggtaccgggaaccaaacgtcggaacccgttacccgtaccgtccgaacggaccctaacggcctccgtaccccccgtcggtacctacttcccg

SEQ ID NO: 52941 - DNA, 563 bp, Homo sapiens
  misc_feature: GYAE6OF02GEEAH.52.57.F02.1.454.CMB.1.raw
  modified_base (243)..(243): a, c, t, g, unknown or other
  misc_feature (243)..(243): n is a, c, g, or t
  modified_base (410)..(410): a, c, t, g, unknown or other
  misc_feature (410)..(410): n is a, c, g, or t
  modified_base (444)..(444): a, c, t, g, unknown or other
  misc_feature (444)..(444): n is a, c, g, or t
tcagcgcagtacgacacgaccggtgctcgatttagctcgatatagttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggatccagcagtgacgttggtncttatgacttttgtctcctggtaccaacaccaccctggcaaacgcccccaaactcatctattttgaggtcactaagcgccctcacggggtccctgatcgcttctctcgctcgaagtctgcaacacgccctccctgaccgtctcgtcgggcctccgaggctggacggntggagtctgtacttactactgcctacctcattcngcgaggccaacaacgttaggttttcggggtttaccggcggtaacgggaccgaggtcgaccgtcgtaacgtcacggcccgtaaggcctccggcccctcggtccacgtcttccggtccccg

SEQ ID NO: 52942 - DNA, 686 bp, Homo sapiens
  misc_feature: GYAE6OF02JGKEY.52.57.F02.1.454.CMB.1.raw
  modified_base (243)..(243): a, c, t, g, unknown or other
  misc_feature (243)..(243): n is a, c, g, or t
tcagcgcagtacgacacgaccggtgctcgatttagctcgatatagttgggtttggggggggtctcaggaggcagcgctctcaggacgtcaccaccatggcctgggctctgctcctcctcaccctcctcactcagggcacagggtcctgggcccagtctgccctgactcagcctccctcgcgtccgggtctcctggacagtcagtcaccatcctcctgcactggactccagcagtgacgttggngcttatgtactttgtctctcggtacctaacaccaccgtggacaaacgccccaaactcactctacttttgacggttacacgtaacgccgtccctgtacggggtcctcgactccgtcttctctgctacgacgtcgtcggacaacgacgtccctaccgtcgaccgtctcgtcggtcctccgacggtctacggtacggtagtacggaacggtcgtacgtacgttaccgtaacgttccgaaccttaccgtacgtaactagtaccgacgtacggtaaccgtaacgtaaccggtttaacgggttttcgggggttttaccgggacgggtaacgggtaaccggtaacgggttaccgtaccggtacccgtaacggtaccgtaccggtaacccgtacggtaccgtcccggtaccccgtccggttaccgtcccgtttaccgtccggttacccccg

SEQ ID NO: 52943 - DNA, 644 bp, Homo sapiens
  misc_feature: GYAE6OF02HJ8VM.52.57.F02.1.454.CMB.1.raw
  modified_base (242)..(242): a, c, t, g, unknown or other
  misc_feature (242)..(242): n is a, c, g, or t
  modified_base (248)..(248): a, c, t, g, unknown or other
  misc_feature (248)..(248): n is a, c, g, or t
  modified_base (350)..(350): a, c, t, g, unknown or other
  misc_feature (350)..(350): n is a, c, g, or t
tcagcgcagtacgacacgaccggtgctcgatttagctcgatatagttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggatccagcagtgacgttggngcttangtactttgtctcctggtaccaacaccacctggccaaacgcccccaaactcatcattttcgagtcactaacgccggcctcgacggggtccctgactcgcttcnctggctcgaagtctggacaacacggtccctccgtcgacccgtctccgtggggccttccgacggtcgtaggacggtatggaggtctaggtacttacgtcgttcgccacctcatatgacaggacaacgaactaagggttttcggggtttaccggacgggtaacgggtaccgtaaacgggtcggtaacccggttaccgtacgggttaccgaaccgggaccccgtaaacgggcccgttaccggtccccccggttacggttacccgtaacccgtttcccttccccgggtttaacccccc

SEQ ID NO: 52944 - DNA, 434 bp, Homo sapiens
  misc_feature: GYAE6OF02H06VB.52.57.F02.1.454.CMB.1.raw
  modified_base (416)..(434): a, c, t, g, unknown or other
  misc_feature (416)..(434): n is a, c, g, or t
tcagcgcagtacgacacgaccggtgctcgatttagctcgatatagttgggtttgggggccttgccagggtggtgttggtgcttatgactttgtctcctggtaccaacaccaccctggcaaagcccccaaactcatcatttttgaggtcactaagccggccctcaggggtccctgatcgcttctctggctcgaagtctggcaacacggcctccctgaccgtctctgggctccaggctgaggatggaggctgattactactgccacctcatatgcaggcaacaactaagttttgggggtttcgcgggaggaccaaggtgaccgtctacgtcacgcccagcctcgcccctcggtcactctcgttcccaccttcctctatacgctcgtcgtgacggcgggtctcggcaacggcacatagnnnnnnnnnnnnnnnnnnn

SEQ ID NO: 52945 - DNA, 248 bp, Homo sapiens
  misc_feature: GYAE6OF02IMTYD.52.57.F02.1.454.CMB.1.raw
  modified_base (244)..(248): a, c, t, g, unknown or other
  misc_feature (244)..(248): n is a, c, g, or t
tcagcgcagtacgacacgaccggtgctcgatttagctcgatatagttgggtttgggattcacgttgcagatgtaggtctgggtgcccaagctgctggagtgggtctcagcctccaccaagggcccatcggtcttccccctggcaccctcctccaagagcacctctgggggcacagcggccctgggctgcctggtcaaggactacttcctatacgatcgctgagcgggctggcaaggcgcatagnnnnn

SEQ ID NO: 52946 - DNA, 609 bp, Homo sapiens
  misc_feature: GYAE6OF02GU704.52.57.F02.1.454.CMB.1.raw
  modified_base (339)..(339): a, c, t, g, unknown or other
  misc_feature (339)..(339): n is a, c, g, or t
  modified_base (443)..(443): a, c, t, g, unknown or other
  misc_feature (443)..(443): n is a, c, g, or t
  modified_base (449)..(449): a, c, t, g, unknown or other
  misc_feature (449)..(449): n is a, c, g, or t
tcagcgcagtacgacacgaccggtgctcgatttagctcgatatagttgggtttggggggggtctcaggaggcagcgctctcaggacgtcaccaccatggcctgggctctgctcctcctcaccctcctcactcagggcacagggtcctgggcccagtctgccctgactcagccctcctccgcgtccgggtctcctggacagtcagtcacatctcctgcactggatccagcagttgacgttggtgcttatgtactttgtctcctggtaccaacaccacctggacaaacgccccaaaatcatctatttttgaggtcactaacgcgtccctcgacgggtcccngactcgtcttctctggctcgagtctcgacaacacgcctccgtcgaccgtctcgtcggctcgagctagaggatggacgtctagtacttacttactcgactacctnattacncgtcgacggtaccgaactaacgttaaggttttcgggggtttaccggacgggtaacgggaccgtaacgggtacgtacccggttacgtccggtacgaccggtaccctaacggtccttacccggtccccggttcggtaccctacttccgttcccgttcccccg

SEQ ID NO: 52947 - DNA, 773 bp, Homo sapiens
  misc_feature: GYAE6OF02FFW3L.52.57.F02.1.454.CMB.1.raw
  modified_base (156)..(156): a, c, t, g, unknown or other
  misc_feature (156)..(156): n is a, c, g, or t
  modified_base (209)..(209): a, c, t, g, unknown or other
  misc_feature (209)..(209): n is a, c, g, or t
  modified_base (242)..(242): a, c, t, g, unknown or other
  misc_feature (242)..(242): n is a, c, g, or t
tcagcgcagtacgacacgaccggtgctcgatttagctcgatatagttgggtttgggggggtctcaggaggcagcgctctcaggacgtcaccaccatggcctgggctctgctcctcctcaccctcctcactcagggcacagggtcctggcccagtcngccctgactcagccctccctccgcgtccgggtctcctggacagtcagtcaccntctcctgcactggatccagcagtcgacgttggncttagtgtactttgtctccgtcggtaaccaacctacccacccctggacctaaaccgccccccctaaactcctaacttaccttatttttacggaacggttaccaaccgtaacggccggtaccccttacggtaacgggggttcccctaggtaaccttccgtcctttaccgtccgtcggtcccgtacggtaacgttccgtacggtaccgaaccgacccggtccccttccccgtacggtacccggtccttccggtacgggtccttacccggaacggtccgtagggtaacggtagtcgggtaacggtccgttacgtaacctttaaccgttacgtccgacctaacccgtactataccgtacgacgaacggtaccgaaacttaacggttaacgggtttttcgggggtaccggacggggtacggtaaccgtaaggtccgacccgttaccggtaaccgccgtaaccggtacccgtaacggttccctcccgggttaccccgttaccggtaccgtacccttacccgttcccggttacccccg

SEQ ID NO: 52948 - DNA, 704 bp, Homo sapiens
  misc_feature: GYAE6OF02HUNQT.52.57.F02.1.454.CMB.1.raw
  modified_base (219)..(219): a, c, t, g, unknown or other
  misc_feature (219)..(219): n is a, c, g, or t
  modified_base (495)..(495): a, c, t, g, unknown or other
  misc_feature (495)..(495): n is a, c, g, or t
tcagcgcagtacgacacgaccggtgctcgatttagctcgatatagttgggtttgggggggggtctcaggaggcagcgctctcaggacgtcaccaccatggcctgggctctgctcctcctcaccctcctcactcagggcacagggtcctgggcccagtctgccctgactcacgcctccctcgcgtccgggtctcctggacagtcagtcaccatcctcctncactggatccagcagtggtacgttggtctcttagtcgtacttttcgtcttccgtacggtaacccaaccaccctacccgtcggaccaaaccgacccccaaaactctactactagtttttacggacgtacaacgtaacggccggtccctcgacggggttccctggtactccgtcgttctacgtcggtacttcgaacgttcgtacggaccaaccgaccggtccctcccgtacgtacccggttcgtcggtcgggtccttccggacggtcgtaggtacggngtacggaggtcgttacgtacttaaccgtctaccgtactaacctctaagtacgtcggacgtaacggccgtaaacgtacggtttaagggtttcggggtttacgggacgggtacggtaaccgtaggtccgtaccgtaccgtacggtaccgaccgaccggtacggtccgtcccggtccccgtacggtcccgtacttccgttacccgtaccccg

SEQ ID NO: 52949 - DNA, 766 bp, Homo sapiens
  misc_feature: GYAE6OF02G1N2E.52.57.F02.1.454.CMB.1.raw
tcagcgcagtacgacacgaccggtgctcgatttagctcgatatagttgggtttggggggggtctcaggaggcagcgctctcaggacgtcaccaccatggcctgggctctgctcctcctcaccctcctcactcgagggcacgagggtcctgggcccagtctgccctgacctcacgccctccctccgcgtccgggtcctccgtaggactagtcacgtccaccatcctcctgcacgtggactccgaagctagtcggtacgttggtcgtacttagtcgtactttgtcctaccgtacggtaaccaaccacccgtaccgtacggaaccaaaacccgtacccccaaacgtcctacttaccttagttttacggacgttaccaacgtaccggaccgtcccgtacgggtaccgggtccctaggtaaccttccgttcttcctcgtcgtaccgtacggtacgtcgtcgaactaaccgccgtcccgtaccgtcggtacccgttcgtacggtccggtactacggtacgcgtaggacgtgtcgtacgtctaacgttacttcgtctaccgtacctactacgtaatcccgaggtaccgaacggaccgttaacgttaacgggtttacgggttttccgggggtaacgggcggtaaaacccgggtacggtaaccgggttcccggaacccgttacggttacccggaaccgtaccggtacccggtaccgtcccggtaccccgttacctccgggtaacccttccggttcccgtacccggttaccccccg

SEQ ID NO: 52950 - DNA, 643 bp, Homo sapiens
  misc_feature: GYAE6OF02GEI1F.52.57.F02.1.454.CMB.1.raw
  modified_base (201)..(201): a, c, t, g, unknown or other
  misc_feature (201)..(201): n is a, c, g, or t
  modified_base (247)..(247): a, c, t, g, unknown or other
  misc_feature (247)..(247): n is a, c, g, or t
  modified_base (252)..(252): a, c, t, g, unknown or other
  misc_feature (252)..(252): n is a, c, g, or t
  modified_base (381)..(381): a, c, t, g, unknown or other
  misc_feature (381)..(381): n is a, c, g, or t
  modified_base (432)..(432): a, c, t, g, unknown or other
  misc_feature (432)..(432): n is a, c, g, or t
tcagcgcagtacgacacgaccggtgctcgatttagctcgatatagtttgggtttggggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacngtcagtcaccatcctcctgcactggactccagcagtgacgttggtncttangtactttgtctcctcggtaccaaccaccacccgtgacaaacgcccccaaatcatctattttgagtcactaacgcgcctcgacgggtccctgactcgcttctcgtgtctacgtaacgtcgtacgacaacnccggtcctcccgtcgtaccgtctcgtcggtctacccgagtcgtacgaggtntacggacggtcgttacgtaacttaccgttactccggacctaccgtctaacttacgtcgaccgtaacggaccgaaacttaaacggttacgggttttacggggggtttccgacgggtaacgaccggtaaggtccgacccgttaccgtacgtaccgaccgaaccgtaccggccgtccgtccccggttacgcctaccgttccgtccgttaccccc

SEQ ID NO: 52951 - DNA, 891 bp, Homo sapiens
  misc_feature: GYAE6OF02HLDA0.52.57.F02.1.454.CMB.1.raw
tcagcgcagtacgacacgaccggtgctcgatttagctcgatatagttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctgaacagtcagtcaccatctcctgcactggactccagcagtgacgttggtgcttagtgtactttgtccttccgtacggttaaccaaaccgtacccaccccgtaggaccaaaaccggacccccccaaaacgtcctaacttacttagttttttacggacggttacctaaccgttaacggccggtaccccttacggtaaccgggggttccccttaggtaaccttccgggtccttttccgtccgttcgggtaccttacggtaaacggttccgtacgggaccgtaaacccgtaacccggggtccccttacccccggttacggtaccccggttacccgttaccggttaccggggtcccttacccggaacgggtccgttacggggtaacggtacggttacgggaaccgggtcttaggtaacctttaaccgtaccgttccggaacccttaccctacgtacttaccgttacgaccggtaaccgggaccgtaaaccgtaaacgggttttaacgggtttttaccgggggggttttaccggggaacccgggtaaacggggtaacccgtaacggggttcccgtaaacccggtttcccggttaaacccgggaaccctaacccggggtaaccccgtaaaccgggtccccgttaccccgggtcccccgttaccgggtacccttaacccgttcccgttaccccgttaaccccccg

SEQ ID NO: 52952 - DNA, 720 bp, Homo sapiens
  misc_feature: GYAE6OF02HJOEG.52.57.F02.1.454.CMB.1.raw
  modified_base (246)..(246): a, c, t, g, unknown or other
  misc_feature (246)..(246): n is a, c, g, or t
tcagcgcagtacgacacgaccggtgctcgatttagctcgatatagttggggtttggggggggtctcaggaggcagcgctctcaggacgtcaccaccatggcctgggctctgctcctcctcaccctcctcactcaggcacagggtcctgggcccagtctgccctgactcagcctccctcgcgtccgggtctcctggacagtcagtcacctatcctcctgcactggactccagcagtgacgtttggtntcttagtgtacttttgtccttccgtacggtaacccaaccaccacccgtggaccaaaccgacccccaaactcactcttattttgacggtacacgtaacgccgcctcgacgggtcctgactcgtcttcgtacgtgtctacgtacgtcgtacggacaaccgaccggtccctacccgtcggtacccgttccgtccggtacgggtccctaccgggacggtccgttaggaacggtacgtaggacggtcgtaagtacgttaacttaccgtcgtaacctaccgtactacgtatacggaccgtaacggtacccgaacgttaaacggtttaacggggttttcgggggttaacgggtacgggtaacgggtaaccgtacgggtaccgtacccggttaccgtaacggtccgtacggtaccccgtaacggtcccgtaccccggttcccgtccggtaccgtacccgttccggttacccgttccccccgg

SEQ ID NO: 52953 - DNA, 322 bp, Homo sapiens
  misc_feature: GYAE6OF02FM9I4.52.57.F02.1.454.CMB.1.raw
  modified_base (232)..(232): a, c, t, g, unknown or other
  misc_feature (232)..(232): n is a, c, g, or t
  modified_base (248)..(248): a, c, t, g, unknown or other
  misc_feature (248)..(248): n is a, c, g, or t
  modified_base (251)..(251): a, c, t, g, unknown or other
  misc_feature (251)..(251): n is a, c, g, or t
  modified_base (253)..(266): a, c, t, g, unknown or other
  misc_feature (253)..(266): n is a, c, g, or t
  modified_base (268)..(322): a, c, t, g, unknown or other
  misc_feature (268)..(322): n is a, c, g, or t
tcagcgcagtacgacacgaccggtgctcgatttagctcgatatagttggggtttgggattcacgttgcagatgtaggtctgggtgcccaagctgctggagtgggtctcagcctccaccaagggtcccatcggtcttccccctggcaccctcctccaagagcacctctgggggcacagcggccctggggctgcctggtcaaaggctacttccgtatacgatcgctgagcgggntggcaaggcgcatagntantnnnnnnnnnnnnnngnnnnnnnnnnnnnnnnnnnnnnnnnnnnnnnnnnnnnnnnnnnnnnnnnnnnnnn

SEQ ID NO: 52954 - DNA, 330 bp, Homo sapiens
  misc_feature: GYAE6OF02H8BW0.52.57.F02.1.454.CMB.1.raw
  modified_base (174)..(174): a, c, t, g, unknown or other
  misc_feature (174)..(174): n is a, c, g, or t
  modified_base (241)..(241): a, c, t, g, unknown or other
  misc_feature (241)..(241): n is a, c, g, or t
  modified_base (247)..(250): a, c, t, g, unknown or other
  misc_feature (247)..(250): n is a, c, g, or t
  modified_base (253)..(253): a, c, t, g, unknown or other
  misc_feature (253)..(253): n is a, c, g, or t
  modified_base (260)..(330): a, c, t, g, unknown or other
  misc_feature (260)..(330): n is a, c, g, or t
tcagcgcagtacgacacgaccggtgctcgatttagctcgatatagttgggtttgggattcacgttgcagatgtaggtctgggtgcccaagctgctggagtgggtctcagcctccaccaagggcccatcggtcttccccctggccaccctcctccaagagcacctctgggggcanagcggccctgggctgcctggtcaaggactacttcctagtacgatcgctggagcgggctggcaaggcncatagnnnngcntgatcannnnnnnnnnnnnnnnnnnnnnnnnnnnnnnnnnnnnnnnnnnnnnnnnnnnnnnnnnnnnnnnnnnnnnn

SEQ ID NO: 52955 - DNA, 756 bp, Homo sapiens
  misc_feature: GYAE6OF02GNYQA.52.57.F02.1.454.CMB.1.raw
  modified_base (246)..(246): a, c, t, g, unknown or other
  misc_feature (246)..(246): n is a, c, g, or t
  modified_base (251)..(251): a, c, t, g, unknown or other
  misc_feature (251)..(251): n is a, c, g, or t
tcagcgcagtacgacacgaccggtgctcgatttagctcgatatagttggggtttgggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatcctcctgcactggactccagcagtgacgttggncttangtactttgtctccgtggtaaccaaccaccacccgtggaccaaaccgacccccaaacgtccactcttagttttcggacggttccaacgtaacgccggtaccctcggtacggggtccctagtactcgtcttcgtcgtcggtcctacggtaacgttcgtacggactaaccggaccggtaccctcccgtacggtacccgttccgtccgtccggggtaccctacccggtacgggtacgttacgggaacggttacgtacgggtacggtcgttaacggtaactttaaccgttaccgtacgtaccctaccctagtacttacgtcgtacgaacggtaccgtaacgttaaacggtttacggggttttacgggggttaccggtaacggggtaaggtacccggtaacggttccggtaacccgttaccggtaccggtacgaacccgtaacccggtacggtacccgtcccggtaccccgttaccggacctacccggtttccgtaccccgttacccccgg

SEQ ID NO: 52956 - DNA, 886 bp, Homo sapiens
  misc_feature: GYAE6OF02H87NZ.52.57.F02.1.454.CMB.1.raw
tcagcgcagtacgacacgaccggtgctcgatttagctcgatatagttgggtttgggggggggtctcaggaggcagcgctctcaggacgtcaccaccatggcctgggctctgctctcctcaccctctcactcaggcacagggtcctgggcccagtctgccctgactcagccctccctccgcgtccgggtctccgtggacaggtcacgtccaccatcctccgtgcactggactccgagtcaggtcgtacgttggtagtcttagtcgtacgtttaccgtcttccgttacggtaaccccaacgtaccccgtaacccgttacggaaccctaaacccggtaacccccctaaaaccgttccgtaaaccgtttaccgtttaacgtttttttaccgggaacggttaccgttaaaccgtaccggtaccccgggtacccccgttacgggtaaccggggttccccgttacgtaaccgttccgtaccgtttccgtaccggtcgggtccgttacggtaacggttcggtacggtaaccgtaacccggtaccggtcccgtttacccggtaccggtaccccgttccgtttaccgggtaccgggttaccctacccgggttaccgggtacgttacggaacgggtacggttaggaccggttacgtaacggttaaccgtttaacgtaccgttccgtaccttacgttacgtactaggtacgtacggaacggtactaaccgtaacggtttacggttttcgggggttaccgacggggttaacggtaaccggtaagggttacccggtaaccggttaccggtacggtaaccgtaccggtacccggtaacggtcccgtaccccggtttcccggtaccggttacctccggtttacccgtcccggtttacccccg

SEQ ID NO: 52957 - DNA, 711 bp, Homo sapiens
  misc_feature: GYAE6OF02IR3TH.52.57.F02.1.454.CMB.1.raw
  modified_base (554)..(554): a, c, t, g, unknown or other
  misc_feature (554)..(554): n is a, c, g, or t
tcagcgcagtacgacacgaccggtgctcgatttagctcgatatagttgggtttgggggggggtctcaggaggcagcgctctcaggacgtcaccaccatggcctgggctctgctcctcctccaccctcctcactcagggcacgagggtcctgggcccagtctgccctgactcacgcctccctccggcgtccgggtctcctggacagtcagtccacctatcctcctgactacgtggactccagtcgtagtcggtcgttggtcgtcttaagtgtactttcgtcctccgtacgtacccaaccaccaccgtgaaccaaacccgacccctaaatcctatactttagtttcgacggtactaacgacggccgtaccgtaccggacgggttccagtacttcgtccttcgtccgtcggacgtacggtacgttcgacggtaaccaccggccgtaccctccgtaaccggtccgttccgtcggtacggtcccaccgtacggtcggagggtacgcggtaggtgaacttcggtaccttacgtacgcgtacctactacgtagtcggtaancccgaaggactaaaccgttaagggtttcggggtttccggggttaggaccgggaacgggtaccgtacgggtaccgttacgggttacctacggaccgtccggaacgttccggccctacccgggtcgtcccgttactaccgtccttaccccgtacccccg

SEQ ID NO: 52958 - DNA, 707 bp, Homo sapiens
  misc_feature: GYAE6OF02H35FL.52.57.F02.1.454.CMB.1.raw
  modified_base (130)..(130): a, c, t, g, unknown or other
  misc_feature (130)..(130): n is a, c, g, or t
  modified_base (254)..(254): a, c, t, g, unknown or other
  misc_feature (254)..(254): n is a, c, g, or t
  modified_base (260)..(260): a, c, t, g, unknown or other
  misc_feature (260)..(260): n is a, c, g, or t
tcagcgcagtacgacacgaccggtgctcgatttagctcgatatagttgggtttggggggggtctcaggaggcagcgctcgtcagggacgtcaccaccatggcctgggctctgctcctcctcaccctcctnactcagggcacagggtcctgggcccagtctgccctgactcacgccctccctccgcgttccgggtctccgtggacagtcagtcaccatctctgcagtggactccgagcctagtgtacgttgggtncttagngtactttcgtctccgtacggtaccaaccacccgtaccgtacggacctaaacgacccctaaacctcacttcttagttttggacgtactacgtaacggccgtccgtacggtacggtcctgtactcgtcttctacgtcgtctacgtagtcgtacgacgtaacgaccggtcctccgtacgtaccgtcgtccgtcgggtacctaccgaggtcctaggacggtaacgtaggacggtacgttagtacgttaactaccgttgacctaccgtactaagtcgttacggccgtaggtaaccgaacgtaaaccggtttaaggggttttccggggttaccgggaccgggttaaacgggaccgttaagggtaccgttacccgtaccggtaaccgtaccggtaccgaaccgttacggtaccgtcccgttcccggacgttccctcgttccctacccggtcccc

SEQ ID NO: 52959 - DNA, 613 bp, Homo sapiens
  misc_feature: GYAE6OF02HAQ2W.52.57.F02.1.454.CMB.1.raw
  modified_base (202)..(202): a, c, t, g, unknown or other
  misc_feature (202)..(202): n is a, c, g, or t
  modified_base (213)..(213): a, c, t, g, unknown or other
  misc_feature (213)..(213): n is a, c, g, or t
  modified_base (275)..(275): a, c, t, g, unknown or other
  misc_feature (275)..(275): n is a, c, g, or t
  modified_base (416)..(416): a, c, t, g, unknown or other
  misc_feature (416)..(416): n is a, c, g, or t
tcagcgcagtacgacacgaccggtgctcgatttagctcgatatagttgggtttgggggggggtctcaggaggcagcgctctcaggacgtcaccaccatggcctgggctctgctcctcctcaccctcctcactcagggcacgagggtcctgggcccagtctcgccctgactcagcctccctccgcgtccgggtctcctgaacngtcagtcaccntctctgcactggactcagcagtgacggttggtgcttatgtactttgtctctaggtaccaacnccacctgacaacgaccccaatcatctatttgacgtacacgtacgccgtcctcgcgggtcctgactcgtcttctcgtgcgtgacgtcgtgacacgtacgccctccgtcgaccgttctcggtcggcctcgcggcgtgaggtanggagtctagtacttacgcttcgcctacgtactagtgtcgacgacggaccgtaacttaacggttacgggttttcgggggttaccggtacgggaaccgggtaccggtagtaccggtacccgttaccgaacgtacgaccggtacccgacggtcctacccggtccccttcgtaccctaccgttaccgttccccgtaccccg

SEQ ID NO: 52960 - DNA, 420 bp, Homo sapiens
  misc_feature: GYAE6OF01DN3PL.47.60.F05.1.454.CMB.1.raw
  modified_base (413)..(420): a, c, t, g, unknown or other
  misc_feature (413)..(420): n is a, c, g, or t
tcagagctcacgtacacgaccggtgctcgatttagtacgtcatcagggaagggactggagtggattggctatctgtattacggtgggagttcaaacttcaacccctccctcaagagtcgagtcaccatttcaggagacacgtccaagaatcaggtctccttgaacctgaggcagacgaccccagcggacacggccgtctattattgtgcgagaggtcttcttgatgacgatgccctggacgactggggccagggagtccttgtcaccgtctcctcagcctccaccaagggcccatccggtcttccccctggccaccctcctccaagagcacctctggggcacagcggccctgggctgcctggtcaaggactacttcctacgtgagctctgagcgggctggcaaggcgcatagnnnnnnnn

SEQ ID NO: 52961 - DNA, 412 bp, Homo sapiens
  misc_feature: GYAE6OF01CC5OA.47.60.F05.1.454.CMB.1.raw
  modified_base (411)..(412): a, c, t, g, unknown or other
  misc_feature (411)..(412): n is a, c, g, or t
tcagagctcacgtacacgaccggtgctcgatttagtacgtcatcagggaagggactggagtggattggctatctgtattacggtgggagttcaaacttcaacccctccctcaagagtcgagtcaccatttcaggagacacgtccaagaatcaggtctccttgaacctgaggcagacgaccccagcggacacggccgtctattattgtgcgagaggtcttcttgatgacgatgccctggacgactggggccagggagtccttgtcaccgtctcctcagcctccaccaagggcccatcggtcttccccctggcaccctcctccaagagcacctctggggcacagcggccctgggctgcctggtcaaggctacttcctacgtgagctctgagcgggctgggcaaggcgcatagnn

SEQ ID NO: 52962 - DNA, 431 bp, Homo sapiens
  misc_feature: GYAE6OF01CUDV2.47.60.F05.1.454.CMB.1.raw
  modified_base (422)..(431): a, c, t, g, unknown or other
  misc_feature (422)..(431): n is a, c, g, or t
tcagagctcacgtacacgaccggtgctcgatttagtacgtcatcagggaaagggactggagtggattggctatctgtattacggtgggagttcaaacttcaacccctccctcaagagtcgagtcaccatttcaggagacacgtccaagaatcaggtctccttgaacctgaggcagacgaccccagcggacacggccgtctattattgtgcgagaggtcttcttgatgacgatgccctggacgactggggccagggagtccttgtcaccgtctcctcagcctccaccaagggcccatcggtcttccccctggccacccctcctccaacgcgcacctcgtcggggcacacgcggcccgtgggctgcctggtcaaggacctacttcctacgtgagctctgagcgggctggcaaggcgacagtagnnnnnnnnnn

SEQ ID NO: 52963 - DNA, 421 bp, Homo sapiens
  misc_feature: GYAE6OF01BC80O.47.60.F05.1.454.CMB.1.raw
  modified_base (416)..(421): a, c, t, g, unknown or other
  misc_feature (416)..(421): n is a, c, g, or t
tcagagctcacgtacacgaccggtgctcgatttagtacgtcatcagggaaagggactggagtggattggctatctgtattacggtgggagttcaaacttcaacccctccctcaagagtcgagtcaccatttcaggagacacgtccaagaatcaggtctccttgaacctgaggcagacgaccccagcggacacggccgtctattattgtgcgagaggtcttcttgatgacgatgccctggacgactggggccagggagtccttgtcaccgtctcctcagcctccaccaagggcccatcggtcttccccctggccaccctcctccaagagcacctctgggggcacagcggccctgggctgcctggtcaaggactacttcctacgtgagctctgagcgggctgggcaaggcgcagtagnnnnnn

SEQ ID NO: 52964 - DNA, 422 bp, Homo sapiens
  misc_feature: GYAE6OF01ENPKU.47.60.F05.1.454.CMB.1.raw
  modified_base (416)..(422): a, c, t, g, unknown or other
  misc_feature (416)..(422): n is a, c, g, or t
tcagagctcacgtacacgaccggtgctcgatttagtacgtcatcagggaaagggactggagtggattggctatctgtattacggtgggagttcaaacttcaacccctccctcaagagtcgagtcaccatttcaggagacacgtccaagaatcaggtctccttgaacctgaggcagacgaccccagcggacacggccgtctattattgtgcgagaggtcttcttgatgacgatgccctggacgactggggccagggagtccttgtcaccgtctcctcagcctccaccaagggcccatcggtattccccctggcaccctcctccaagacgcaccctctcggggcacagcggccctgggctgcctggtcaaggactacttcctacgtgagctctgaggcggctggcaaggcgcagtagnnnnnnn

SEQ ID NO: 52965 - DNA, 496 bp, Homo sapiens
  misc_feature: GYAE6OF01AQJYZ.47.60.F05.1.454.CMB.1.raw
  modified_base (315)..(315): a, c, t, g, unknown or other
  misc_feature (315)..(315): n is a, c, g, or t
  modified_base (470)..(471): a, c, t, g, unknown or other
  misc_feature (470)..(471): n is a, c, g, or t
  modified_base (473)..(496): a, c, t, g, unknown or other
  misc_feature (473)..(496): n is a, c, g, or t
tcagagctcacgtacacgaccggtgctcgatttagtacgtcatcagggaagggactggagtggattggctatctgtattacggtgggagttcaaacttcaacccctccctcaagagtcgagtcaccatttcaggagacacgtccaagaatcaggtctccttgaacctgaggcagacgaccccagcggacacggccgtctattattgtgcgagaggtcttcttgatgacgatgccctggacgacgtgggggccagggagtccgttgtcaccgtctcctcagccctccaccaacggcccagtccggtccttcccccnggccacccctcctcctaacgacgccaccgtcgtcgggggaccacgacggccggcccgtgggcctcggccgtcggtacgaacgggtactacgttcccgtacgtcgacgtcctcgtggacggtccgggcgtcgggacgaagggccgactagtaggcnngnnnnnnnnnnnnnnnnnnnnnnnn

SEQ ID NO: 52966 - DNA, 501 bp, Homo sapiens
  misc_feature: GYAE6OF01C1LKH.47.60.F05.1.454.CMB.1.raw
  modified_base (346)..(346): a, c, t, g, unknown or other
  misc_feature (346)..(346): n is a, c, g, or t
  modified_base (475)..(476): a, c, t, g, unknown or other
  misc_feature (475)..(476): n is a, c, g, or t
  modified_base (478)..(501): a, c, t, g, unknown or other
  misc_feature (478)..(501): n is a, c, g, or t
tcagagctcacgtacacgaccggtgctcgatttagtacgtcatcagggaagggactggagtggattggctatctgtattacggtgggagttcaaacttcaacccctccctcaagagtcgagtcaccatttcaggagacacgtccaagaatcaggtctccttgaacctgaggcagacaccccagcggacacggccgtctattattgtgcgagaggtcttcttgatgacgatcgccctaggacgacggtggggccagggtacgtcgttgtcctaccgtctcctcacgcctccaccgacggccacgtccggtccctccccgtaggccctacccgtcctaccgaacgccnccgacctcggtggggaccacgtacggccggacccgtgggcctggccgtggtacgaacgtacctacttcctaacggtcgtacgtttcgtggacggcgggtctagggacgtaacgggccgacgacgtaggnngnnnnnnnnnnnnnnnnnnnnnnnn

SEQ ID NO: 52967 - DNA, 455 bp, Homo sapiens
  misc_feature: GYAE6OF01DIK9E.47.60.F05.1.454.CMB.1.raw
  modified_base (316)..(316): a, c, t, g, unknown or other
  misc_feature (316)..(316): n is a, c, g, or t
  modified_base (449)..(455): a, c, t, g, unknown or other
  misc_feature (449)..(455): n is a, c, g, or t
tcagagctcacgtacacgaccggtgctcgatttagtacgtcatcagggaagggactggagtggattggctatctgtattacggtgggagttcaaacttcaacccctccctcaagagtcgagtcaccatttcaggagacacgtccaagaatcaggtctccttgaacctgaggcagaccgaccccagcggacacggccgtctattattgtgcgagaggtcttcttgatgacgatcgccctggacgacgtggggccaggggagtccttgtccaccgtctcctcacgcctccaccaacggcccatccggtccttcccccnggccacccctcctccaagcgccaccctccgagacgcacgacgccggcccgtgggctcgccgtggtacaaacggccttacgttccgtacgtgaacgctcgtggacggcgggctgggacgaagggcgacagtagnnnnnnn

SEQ ID NO: 52968 - DNA, 478 bp, Homo sapiens
  misc_feature: GYAE6OF01CAX1K.47.60.F05.1.454.CMB.1.raw
  modified_base (454)..(455): a, c, t, g, unknown or other
  misc_feature (454)..(455): n is a, c, g, or t
  modified_base (457)..(478): a, c, t, g, unknown or other
  misc_feature (457)..(478): n is a, c, g, or t
tcagagctcacgtacacgaccggtgctcgatttagtacgtcatcagggaagggactggagtggattggctatctgtattacggtgggagttcaaaacttcaacccctccctcaagagtcgagtcaccatttcaggagacacgtccaagaatcaggtctccttgaacctgaggcagacgaccccagcggacacggccgtctattattgtgcgagaggtcttcttgatgacgatgccctggacgacgtggggccaggggacgtccttgtccaccgtctcctcacgcctccaccaacggcccactcggtccttcccccgtcggccacccctcctccaacgacgaccacctcgtcgggggcacgaggccggccctgggcctcggcctggtcaacgggtaccttacgttccgtacgtcgagtctcgtggaggcgggcgtggacgaagggcgcagtcganngnnnnnnnnnnnnnnnnnnnnnn

SEQ ID NO: 52969 - DNA, 422 bp, Homo sapiens
  misc_feature: GYAE6OF02II0AQ.47.60.F05.1.454.CMB.1.raw
  modified_base (414)..(422): a, c, t, g, unknown or other
  misc_feature (414)..(422): n is a, c, g, or t
tcagagctcacgtacacgaccggtgctcgatttagtacgtcatcagggaaagggactggagtggattggctatctgtattacggtgggagttcaaacttcaacccctccctcaagagtcgagtcaccatttcaggagacacgtccaagaatcaggtctccttgaacctgaggcagacgacccccagcggacacggccgtctattattgtgcgagaggtcttcttgatgacgatgccctggacgactgggggccagggagtccttgtcaccgtctcctcagcctccaccaagggcccatcggtcttccccctggcaccctcctccaagacgcacctctggggcacagcgccctgggctgcctggtcaaggactacttcctacgtgagctctgagcgggctggcaaggcgcatagnnnnnnnnn

SEQ ID NO: 52970 - DNA, 427 bp, Homo sapiens
  misc_feature: GYAE6OF02H74VG.47.60.F05.1.454.CMB.1.raw
  modified_base (305)..(305): a, c, t, g, unknown or other
  misc_feature (305)..(305): n is a, c, g, or t
  modified_base (332)..(332): a, c, t, g, unknown or other
  misc_feature (332)..(332): n is a, c, g, or t
  modified_base (418)..(427): a, c, t, g, unknown or other
  misc_feature (418)..(427): n is a, c, g, or t
tcagagctcacgtacacgaccggtgctcgatttagtacgtcatcagggaaagggactggagtggattggctatctgtattacggtgggagttcaaacttcaacccctccctcaagagtcgagtcaccatttcaggagacacgtccaagaatcaggtctccttgaacctgaggcagacgaccccagcggacacggccgtctattattgtgcgagaggtcttcttgatgacgatgccctggacgactggggccagggtagccttgcaccgtctcctcagcctcaccaagggcccatcggcttccccnggcacccctcctccaagacgcacctcnggggcacagcggcctggggctgcctaggtcaaaggactacttcctaatcgtatacttcagagcgggctggcaaggcgtcaatagannnnnnnnnn

SEQ ID NO: 52971 - DNA, 427 bp, Homo sapiens
  misc_feature: GYAE6OF02GVF0C.47.60.F05.1.454.CMB.1.raw
  modified_base (420)..(427): a, c, t, g, unknown or other
  misc_feature (420)..(427): n is a, c, g, or t
tcagagctcacgtacacgaccggtgctcgatttagtacgtcatcagggaagggactggagtggattggctatctgtattacggtgggagttcaaacttcaacccctccctcaagagtcgagtcaccatttcaggagacacgtccaagaatcaggtctccttgaacctgaggcagacgaccccagcggacacggccgtctattattgtgcgagaggtcttcttgatgacgatgccctggacgactggggccagggagtccttgtcaccgtctcctcagcctccaccaagggcccatcggtcttccccctggccacccctcctccaacgacgccacctcctgggggcacgacgcggccctgggctgcctggtcaaggactacttcctacgtgagctctgagcgggctggcaaggcgcatagnnnnnnnn

SEQ ID NO: 52972 - DNA, 438 bp, Homo sapiens
  misc_feature: GYAE6OF02GE3VZ.47.60.F05.1.454.CMB.1.raw
  modified_base (424)..(425): a, c, t, g, unknown or other
  misc_feature (424)..(425): n is a, c, g, or t
  modified_base (427)..(438): a, c, t, g, unknown or other
  misc_feature (427)..(438): n is a, c, g, or t
tcagagctcacgtacacgaccggtgctcgatttagtacgtcatcagggaagggactggagtggattggctatctgtattacggtgggagttcaaacttcaacccctccctcaagagtcgagtcaccatttcaggagacacgtccaagaatcaggtctccttgaacctgaggcagacgaccccagcggacacggccgtctattattgtgcgagaggtcttcttgatgacgatgccctggacgacgtggggccagggagtccttgtccaccgtctcctcagcctccaccaaggcccatcggtcttccccctggccaccctcctccaagacgcacctctcgggggcacgagccggcccgtgggctcgcctggtcaaggactacttccgtacgtgacgctctgaggcggctggcgaaggcgcagtagnngnnnnnnnnnnnn

SEQ ID NO: 52973 - DNA, 415 bp, Homo sapiens
  misc_feature: GYAE6OF02HV9KK.47.60.F05.1.454.CMB.1.raw
  modified_base (327)..(327): a, c, t, g, unknown or other
  misc_feature (327)..(327): n is a, c, g, or t
  modified_base (384)..(384): a, c, t, g, unknown or other
  misc_feature (384)..(384): n is a, c, g, or t
  modified_base (412)..(415): a, c, t, g, unknown or other
  misc_feature (412)..(415): n is a, c, g, or t
tcagagctcacgtacacgaccggtgctcgatttagtacgtcatcagggaagggactggagtggattggctatctgtattacggtgggagttcaaacttcaacccctccctcaagagtcgagtcaccatttcaggagacacgtccaagaatcaggtctccttgaacctgaggcagacgaccccagcggacacggccgtctattattgtgcgagaggtcttcttgatgacgatgccctggacgactggggccagggagtccttgtcaccgtctcctcagcctccaccaaggcccatcggtcttccccctggccaccctcctccaagacncacctctgggggcacagcggccctgggctgcctggtcaaggctacttcctacgtganctctgagcgggctggcaaggcgcatagnnnn

SEQ ID NO: 52974 - DNA, 447 bp, Homo sapiens
  misc_feature: GYAE6OF02H64AX.47.60.F05.1.454.CMB.1.raw
  modified_base (440)..(447): a, c, t, g, unknown or other
  misc_feature (440)..(447): n is a, c, g, or t
tcagagctcacgtacacgaccggtgctcgatttagtacgtcatcagggaagggactggagtggattggctatctgtattacggtgggagttcaaacttcaacccctccctcaagagtcgagtcaccatttcaggagacacgtccaagaatcaggtctccttgaacctgaggcagacgaccccagcggacacggccgtctattattgtgcgagaggtcttcttgatgacgatgccctggacgacgtggggccagggagtccttgcaccgtctcctcagcctccaccaacggcccatccggtccttccccctcggccaccccctcctcccaagacgccacctctcgggggcacgagccggcccgtgggctcgccgtggtaccgaaggactacgttcctacgtgagtcctctgacggcgggctcggcgaaggcgacagtacgnnnnnnnn

SEQ ID NO: 52975 - DNA, 426 bp, Homo sapiens
  misc_feature: GYAE6OF02GPE3T.47.60.F05.1.454.CMB.1.raw
  modified_base (419)..(426): a, c, t, g, unknown or other
  misc_feature (419)..(426): n is a, c, g, or t
tcagagctcacgtacacgaccggtgctcgatttagtacgtcatcagggaagggactggagtggattggctatctgtattacggtgggagttcaaacttcaacccctccctcaagagtcgagtcaccatttcaggagacacgtccaagaatcaggtctccttgaacctgaggcagacgaccccagcggacacggccgtctattattgtgcgagaggtcttcttgatgacgatgccctggacgactggggccagggagtcctgtcaccgtctcctcagcctccaccaagggccccatcggtcttcccccctggcaccctcctccaagacgcacctctcgggggcacgagcggcccctgggcctcgcctggtcaaggactacttcctacgtgagctctgagcgggctggcaaggcgcatagnnnnnnnn

SEQ ID NO: 52976 - DNA, 524 bp, Homo sapiens
  misc_feature: GYAE6OF02IGOA9.47.60.F05.1.454.CMB.1.raw
  modified_base (494)..(494): a, c, t, g, unknown or other
  misc_feature (494)..(494): n is a, c, g, or t
  modified_base (497)..(524): a, c, t, g, unknown or other
  misc_feature (497)..(524): n is a, c, g, or t
tcagagctcacgtacacgaccggtgctcgatttagtacgtcatcagggaagggactggagtggattggctatctgtattacggtgggagttcaaacttcaacccctccctcaagagtcgagtcaccatttcaggagacacgtccaagaatcaggtctccttgaacctgaggcagacgaccccagcggacacggccgtctattattgtgcgagaggttcttcttgatgacgatcgccctggacgacgtcgggggccaggggacgttccttgtcaccgtctcctcacgcctccaccgaacggcccagtccggtccttccccctcggccacccctccctccaacgacgccacctcgtcgggggccacgacggcccgggtcccgtcggggctcggtccgtggtaccgaacggtaccttaccgttccgttaacggtcgacgtccttacgtcggacgggccggggcgttcgggacgtaacggcggacgagtaaggcagtncgnnnnnnnnnnnnnnnnnnnnnnnnnnnn

SEQ ID NO: 52977 - DNA, 547 bp, Homo sapiens
  misc_feature: GYAE6OF02IW6T3.47.60.F05.1.454.CMB.1.raw
  modified_base (503)..(503): a, c, t, g, unknown or other
  misc_feature (503)..(503): n is a, c, g, or t
  modified_base (505)..(507): a, c, t, g, unknown or other
  misc_feature (505)..(507): n is a, c, g, or t
  modified_base (509)..(547): a, c, t, g, unknown or other
  misc_feature (509)..(547): n is a, c, g, or t
tcagagctcacgtacacgaccggtgctcgatttagtacgtcatcagggaagggactggagtggattggctatctgtattacggtgggagttcaaacttcaacccctccctcaagagtcgagtcaccatttcaggagacacgtccaagaatcaggtctccttgaacctgaggcagacgaccccagcggacacggccgtctatattgtgcgagaggtcttcttgatgacgatgaccctggacgactgggggaccaggggtagtcctggtcaccgtcctctacacgtcctccaaccaagggccccatccggtccttacccccgtggccctacccctcctccaaacgacgccctaacctcgtcgggggtcaaccgcggaccggtccgtggggacttcggccgtcggtaccgaaagggtacccttaacgtttcccttaacggacggtaacgtcctcgttaggacggtaccgggggctcggggacgaaacgggcgtaccaagtaacggnannnannnnnnnnnnnnnnnnnnnnnnnnnnnnnnnnnnnnnnn

SEQ ID NO: 52978 - DNA, 583 bp, Homo sapiens
  misc_feature: GYAE6OF02I0DTZ.47.60.F05.1.454.CMB.1.raw
  modified_base (157)..(157): a, c, t, g, unknown or other
  misc_feature (157)..(157): n is a, c, g, or t
  modified_base (502)..(502): a, c, t, g, unknown or other
  misc_feature (502)..(502): n is a, c, g, or t
  modified_base (511)..(511): a, c, t, g, unknown or other
  misc_feature (511)..(511): n is a, c, g, or t
  modified_base (515)..(515): a, c, t, g, unknown or other
  misc_feature (515)..(515): n is a, c, g, or t
  modified_base (518)..(518): a, c, t, g, unknown or other
  misc_feature (518)..(518): n is a, c, g, or t
  modified_base (521)..(522): a, c, t, g, unknown or other
  misc_feature (521)..(522): n is a, c, g, or t
  modified_base (524)..(524): a, c, t, g, unknown or other
  misc_feature (524)..(524): n is a, c, g, or t
  modified_base (526)..(527): a, c, t, g, unknown or other
  misc_feature (526)..(527): n is a, c, g, or t
  modified_base (529)..(529): a, c, t, g, unknown or other
  misc_feature (529)..(529): n is a, c, g, or t
  modified_base (534)..(534): a, c, t, g, unknown or other
  misc_feature (534)..(534): n is a, c, g, or t
  modified_base (537)..(537): a, c, t, g, unknown or other
  misc_feature (537)..(537): n is a, c, g, or t
  modified_base (542)..(542): a, c, t, g, unknown or other
  misc_feature (542)..(542): n is a, c, g, or t
  modified_base (547)..(547): a, c, t, g, unknown or other
  misc_feature (547)..(547): n is a, c, g, or t
  modified_base (549)..(549): a, c, t, g, unknown or other
  misc_feature (549)..(549): n is a, c, g, or t
  modified_base (551)..(551): a, c, t, g, unknown or other
  misc_feature (551)..(551): n is a, c, g, or t
  modified_base (558)..(558): a, c, t, g, unknown or other
  misc_feature (558)..(558): n is a, c, g, or t
  modified_base (561)..(561): a, c, t, g, unknown or other
  misc_feature (561)..(561): n is a, c, g, or t
  modified_base (563)..(563): a, c, t, g, unknown or other
  misc_feature (563)..(563): n is a, c, g, or t
  modified_base (565)..(566): a, c, t, g, unknown or other
  misc_feature (565)..(566): n is a, c, g, or t
  modified_base (568)..(568): a, c, t, g, unknown or other
  misc_feature (568)..(568): n is a, c, g, or t
  modified_base (570)..(570): a, c, t, g, unknown or other
  misc_feature (570)..(570): n is a, c, g, or t
  modified_base (574)..(574): a, c, t, g, unknown or other
  misc_feature (574)..(574): n is a, c, g, or t
  modified_base (576)..(576): a, c, t, g, unknown or other
  misc_feature (576)..(576): n is a, c, g, or t
  modified_base (578)..(578): a, c, t, g, unknown or other
  misc_feature (578)..(578): n is a, c, g, or t
  modified_base (582)..(582): a, c, t, g, unknown or other
  misc_feature (582)..(582): n is a, c, g, or t
tcagagctcacgtacacgaccggtgctcgatttagtacgtcatcagggaagggactggagtggattggctatctgtattacggtgggagttcaaacttcaacccctccctcaagagtcgagtcaccatttcaggagacacgtccaagaatcaggtcnccttgaacctgaggcagaccgacccccagcggacacggccgtctagttattgtgcgagaggtcttcttgatgacgatgccctggaccgacgtcggggaccaggggtacgtcccgttgccgaccgtacctacctcacgccctcccacccgaacgggcccactcggtccttcccccctggccaccctcctccgaagcgccaccgtcgtacggggtcacgtacgcggtaccccgtggggtacctgcccgtggttacgaaacgggaacccgttacttaccgtaacggttcgaagtcctacctgaacgggtccgggacgttcgggaccgaaacgggtcgaacgagtaagngtcgagacngacngancannangnngngacancgngtagnacagngnanagacgancgngnanncngnctanananacanc

SEQ ID NO: 52979 - DNA, 533 bp, Homo sapiens
  misc_feature: GYAE6OF02JLMLO.47.60.F05.1.454.CMB.1.raw
  modified_base (230)..(230): a, c, t, g, unknown or other
  misc_feature (230)..(230): n is a, c, g, or t
  modified_base (491)..(491): a, c, t, g, unknown or other
  misc_feature (491)..(491): n is a, c, g, or t
  modified_base (493)..(493): a, c, t, g, unknown or other
  misc_feature (493)..(493): n is a, c, g, or t
  modified_base (498)..(499): a, c, t, g, unknown or other
  misc_feature (498)..(499): n is a, c, g, or t
  modified_base (503)..(533): a, c, t, g, unknown or other
  misc_feature (503)..(533): n is a, c, g, or t
tcagagctcacgtacacgaccggtgctcgatttagtacgtcatcagggaagggactggagtggattggctatctgtattacggtgggagttcaaacttcaacccctccctcaagagtcgagtcaccatttcaggagacacgtccaagaatcaggtctccttgaacctgaggcagacgaccccagcggacacggccgtctattattgtgcgagaggtctttctgatgacgntgccctggacgacgtggggccaggggactccttgccaccgtcctcctcacgcctccaccgaacgggcccactccggttcccttccccccgtggccctacccctccctacccgaacggacctccgacctccggtcgggggaccaccgacggcccggcccgtcggggcctcgccgtcggtaccgaacgtaccgtaccgttcccgtacgtcgtacgctaccgtcggagggcggcgtcgggacgtaacgggccgcgaagtcgagngnactcnncagnnnnnnnnnnnnnnnnnnnnnnnnnnnnnnn

SEQ ID NO: 52980 - DNA, 580 bp, Homo sapiens
  misc_feature: GYAE6OF02JGUYT.47.60.F05.1.454.CMB.1.raw
  modified_base (337)..(337): a, c, t, g, unknown or other
  misc_feature (337)..(337): n is a, c, g, or t
  modified_base (487)..(487): a, c, t, g, unknown or other
  misc_feature (487)..(487): n is a, c, g, or t
  modified_base (490)..(490): a, c, t, g, unknown or other
  misc_feature (490)..(490): n is a, c, g, or t
  modified_base (510)..(510): a, c, t, g, unknown or other
  misc_feature (510)..(510): n is a, c, g, or t
  modified_base (516)..(516): a, c, t, g, unknown or other
  misc_feature (516)..(516): n is a, c, g, or t
  modified_base (519)..(520): a, c, t, g, unknown or other
  misc_feature (519)..(520): n is a, c, g, or t
  modified_base (523)..(523): a, c, t, g, unknown or other
  misc_feature (523)..(523): n is a, c, g, or t
  modified_base (533)..(533): a, c, t, g, unknown or other
  misc_feature (533)..(533): n is a, c, g, or t
  modified_base (540)..(540): a, c, t, g, unknown or other
  misc_feature (540)..(540): n is a, c, g, or t
  modified_base (544)..(544): a, c, t, g, unknown or other
  misc_feature (544)..(544): n is a, c, g, or t
  modified_base (569)..(569): a, c, t, g, unknown or other
  misc_feature (569)..(569): n is a, c, g, or t
  modified_base (575)..(575): a, c, t, g, unknown or other
  misc_feature (575)..(575): n is a, c, g, or t
tcagagctcacgtacacgaccggtgctcgatttagtacgtcatcagggaagggactggagtggattggctatctgtattacggtgggagttcaaacttcaacccctcctcaagagtcgagtcaccatttcaggagacacgtccaagaatcaggtctccttgaacctgaggcagacgaccccagcggacacggccgtctattattgtgcgagaggtcttctgatgacgatgcctggacgactcgggggccaggggacgtccttgtccaaccgtctcctcacgcctccaccaacgggccactccggtccttccccgtcggccaccctcctccaacgacnccgacctcgtcggggcacgacgaccggccgtggggtcgtcgcctcggtcgaacggtacgttacgttaccgtacgtcggacgtccgtcgtacggacgggaccggggtcgtacgggtaccgtaacgggccgaacgtagttaacggcagtcgntcncgtgacgcgtagcttagctnacgctnacnncgngcgcgtgtcncgagtcncgcncgcgcgcgtcgagtgtcgtcgacgngtagtntgacg

SEQ ID NO: 52981 - DNA, 370 bp, Homo sapiens
  misc_feature: GYAE6OF01ARGDS.36.26.C04.1.454.CMB.1.raw
  modified_base (364)..(370): a, c, t, g, unknown or other
  misc_feature (364)..(370): n is a, c, g, or t
tcagtacgctgtctcacgaccggtgctcgatttagtctagcgactttgggtttgggcagggagtgggctaaggtgacgcaggtggcgccagccaggcgcacacccaatgcccgtgagcccagacactggaccctgcctggaccctcgtggatagacaagaaccaagggcctctgcgccctgggcccagctctgtcccacaccgcagtcacatggcgccatctctcttgcagcttccaccaagggcccatcggtcttcccctggcgccctgctccaggagcacctctggggcacagcggccctgggctgcctggtcaaggactacttccagacagcgtactgagcgggctggcaaggcgcatagnnnnnnn

SEQ ID NO: 52982 - DNA, 506 bp, Homo sapiens
  misc_feature: GYAE6OF01DPRAF.36.26.C04.1.454.CMB.1.raw
  modified_base (411)..(411): a, c, t, g, unknown or other
  misc_feature (411)..(411): n is a, c, g, or t
  modified_base (492)..(492): a, c, t, g, unknown or other
  misc_feature (492)..(492): n is a, c, g, or t
  modified_base (498)..(506): a, c, t, g, unknown or other
  misc_feature (498)..(506): n is a, c, g, or t
tcagtacgctgtctcacgaccggtgctcgatttagtctagcgactttgggttggggggtccctgagactctcctgtgtagcctctggattcacctttagcacctattccatgagttgggtccgccaggctccggggaaggggctggagtgggtctcaagtgttagtggtgatggtgctaacacatactacgcaggctccgtgaagggccgcttcaccatctccagagacaattccgagagcacggtgtttctgcaaatgagccgcctgaaagccgaggacacggccatttactactgtgcgagaatgcagacagtgggagctgacacctggggccagggcaccctggtcaccgtttcctcagcctccaccaagggcccatcggtcttccccctggcgccctgctccaggancacctccgagagcacagcggccctgggctcgcctggtcaaggactacttccagacagcgtactgagcgggctggcaaggcncatagnnnnnnnnn

SEQ ID NO: 52983 - DNA, 527 bp, Homo sapiens
  misc_feature: GYAE6OF01AYB1K.36.26.C04.1.454.CMB.1.raw
  modified_base (521)..(521): a, c, t, g, unknown or other
  misc_feature (521)..(521): n is a, c, g, or t
  modified_base (524)..(527): a, c, t, g, unknown or other
  misc_feature (524)..(527): n is a, c, g, or t
tcagtacgctgtctcacgaccggtgctcgatttagtctagcgactttgggttggggggtcccgtgagactctcctgtgtagcctctggattcacctttagcacctattccatgagttgggtccgccaggctccggggaaggggctggagtgggtctcaagtgttagtggtgatggtgctaacacatactacgcaggctccgtgaagggccgcttcaccatctccagagacaattccgagagcacggtgtttctgcaaatgagccgcctgaaagccgaggacacggccttatattactgtgcgaaatatttctgacgtcgtagcacctcgcccctattttgactactggggccagggaaccctggtcaccgtctcctcagcctccaccaagggcccatccggtcttcccctggccgccctgctccaggacgccacctccgagacgcacagcggccctgggctgcctggtcaaggactacttccagacagcgtactgacgcgggctcggcaaggcgcatacgnacnnnn

SEQ ID NO: 52984 - DNA, 375 bp, Homo sapiens
  misc_feature: GYAE6OF01B2GQE.36.26.C04.1.454.CMB.1.raw
  modified_base (368)..(375): a, c, t, g, unknown or other
  misc_feature (368)..(375): n is a, c, g, or t
tcagtacgctgtctcacgaccggtgctcgatttagtctagcgactttgggtttggggcagggagtgggctaaggtgacgcaggtggcgccagccaggcgcacacccaatgcccgtgagcccagacactggaccctgcctggaccctcgtggatagacaagaaccaaggggcctctgcgccctgggcccagctctgtcccacaccgcagtcacatggcgccatctctcttgcagcttccaccaagggcccatcggtcttcccctggcgccctgctccaggagcacctctgggggcacagcggccctgggctgcctggtcaaggactacttccagacagcgtactgagcgggctggcaaggcgcaatagnnnnnnnn

SEQ ID NO: 52985 - DNA, 373 bp, Homo sapiens
  misc_feature: GYAE6OF01A4IDY.36.26.C04.1.454.CMB.1.raw
  modified_base (366)..(373): a, c, t, g, unknown or other
  misc_feature (366)..(373): n is a, c, g, or t
tcagtacgctgtctcacgaccggtgctcgatttagtctagcgactttgggtttggggcagggagtgggctaaggtgacgcaggtggcgccagccaggcgcacacccaatgcccgtgagcccagacactggaccctgcctggaccctcgtggatagacaagaaccaaggggcctctgcgccctgggcccagctctgtcccacaccgcagtcacatggcgccatctctcttgcagcttccaccaagggcccatcggtcttcccctggcgccctgctccaggagcacctctggggcacagcggccctgggctgcctggtcaaggactacttccagacagcgtactgagcgggctggcaaggcgcatagnnnnnnnn

SEQ ID NO: 52986 - DNA, 380 bp, Homo sapiens
  misc_feature: GYAE6OF01APDLI.36.26.C04.1.454.CMB.1.raw
  modified_base (281)..(281): a, c, t, g, unknown or other
  misc_feature (281)..(281): n is a, c, g, or t
  modified_base (367)..(380): a, c, t, g, unknown or other
  misc_feature (367)..(380): n is a, c, g, or t
tcagtacgctgtctcacgaccggtgctcgatttagtctagcgactttgggtttggggcgagggagtgggctaaggtgacgcaggtggcgccagccaggcgcacacccaatgcccgtgagcccagacactggaccctgcctggaccctcgtggatagacaagaaccaaggggcctctgcgccctgggcccagctctgtcccacaccgcagtcacatggcgccatctctcttgcagcttccaccaagggcccatcggtcttcccctggcgccctgctccaggngcacctctggggcacagcggccctggctgcctggtcaaggactacttccagacagcgtactgagcgggctggcaaggcgcatagcnnnnnnnnnnnnnn

SEQ ID NO: 52987 - DNA, 371 bp, Homo sapiens
  misc_feature: GYAE6OF01BPPIV.36.26.C04.1.454.CMB.1.raw
  modified_base (366)..(371): a, c, t, g, unknown or other
  misc_feature (366)..(371): n is a, c, g, or t
tcagtacgctgtctcacgaccggtgctcgatttagtctagcgactttgggtttggggcagggagtgggctaaggtgacgcaggtggcgccagccaggcgcacacccaatgcccgtgagcccagacactggaccctgcctggaccctcgtggatagacaagaaccaaggggcctctgcgccctgggcccagctctgtcccacaccgcagtcacatggcgccatctctcttgcagcttccaccaagggcccatcggtcttcccctggcgccctgctccaggagcacctctgggggcacagcggccctgggctgcctggtcaaggctacttccagacagcgtactgagcgggctggcaaggcgcatagnnnnnn

SEQ ID NO: 52988 - DNA, 528 bp, Homo sapiens
  misc_feature: GYAE6OF01A3UNT.36.26.C04.1.454.CMB.1.raw
  modified_base (527)..(528): a, c, t, g, unknown or other
  misc_feature (527)..(528): n is a, c, g, or t
tcagtacgctgtctcacgaccggtgctcgatttagtctagcgactttgggtttgggggaggcttggaacagccgggggggtccctgagactctcctgtgtagcctctggattcacctttagcacctattccatgagttgggtccgccaggctccggggaaggggctggagtgggtctcaagtgttagtggtgatggtgctaacacatactacgcaggctccgtgaagggccgcttcaccatctccagagacaattccgagagcacggtgtttctgcaaatgagccgcctgaaagccgaggaccacggccatttactactgtgcgagaatgcagacagtgggagctgacacctggggccagggcaccctggtcaccgtttctcagcctccaccaagggcccatccggtccttccccctggccgcccctgcctccaggacgcacctccgagacgcacgagccggcctgggctcgcctggtccaaggactactcagcagcgtactgagcgggctgggcaaggcacatagnn

SEQ ID NO: 52989 - DNA, 673 bp, Homo sapiens
  misc_feature: GYAE6OF01C5WL1.36.26.C04.1.454.CMB.1.raw
  modified_base (231)..(231): a, c, t, g, unknown or other
  misc_feature (231)..(231): n is a, c, g, or t
  modified_base (273)..(273): a, c, t, g, unknown or other
  misc_feature (273)..(273): n is a, c, g, or t
  modified_base (344)..(344): a, c, t, g, unknown or other
  misc_feature (344)..(344): n is a, c, g, or t
  modified_base (389)..(389): a, c, t, g, unknown or other
  misc_feature (389)..(389): n is a, c, g, or t
tcagtacgctgtctcacgaccggtgctcgatttagtctagcgactttgggtttgggggaggctcggaacagccgggggggtccctgagactctcctgtgtagcctctggattcacctttagcacctattccatgagttgggtccgccaggctccggggaagggctggagtgggtctcaagtgttagtggtgatggtgctaacacatactacgcaggctccgtgaagggccncttcaccatctccagagacaattccgagagcaggttgtttcngcaaatgaagccgctgaaagccgaggacacggcctatttacactgtgcgaagaatgcagaacaggtggganctgacaccgtggggccagggcccaccgtggtcctacccgtttccncgaccgtccctaccgaacccgaacgggccctacgttcccggttccccgttccccgtcggccccgtccccgtcgtccctaccggaacggtaccgcccgtaaccccgtaccggaacgaccgacccaccggaccgggccccgggtacccgttcgggaaccgtccggtacccgttacgggaaccgtaaacggttacccttaccgtaccgaacgtaacgtaccggtaccggtacgtcgggaacgggcgggtccgtacgggaaccgaacgggtccacgaagtacggcgtg

SEQ ID NO: 52990 - DNA, 527 bp, Homo sapiens
  misc_feature: GYAE6OF01C72VS.36.26.C04.1.454.CMB.1.raw
  modified_base (368)..(368): a, c, t, g, unknown or other
  misc_feature (368)..(368): n is a, c, g, or t
  modified_base (424)..(424): a, c, t, g, unknown or other
  misc_feature (424)..(424): n is a, c, g, or t
  modified_base (519)..(527): a, c, t, g, unknown or other
  misc_feature (519)..(527): n is a, c, g, or t
tcagtacgctgtctcacgaccggtgctcgatttagtctagcgactttgggttgggggggtccctgagactctcctgtgtagcctctggattcacctttagcacctattccatgagttgggtccgccaggctccgggggaaggggctgggagtggggtctcaagtgttagtggtgatggtgctaacacatactacgcaggctccgtgaagggccgcttcaccatctccagagacaattccgagagcacggtgtttctgcaaatgagccgcctgaaagccgaggacacggccatttactactgtgcgagaatgcagacagtgggagctgacaccgtggggccagggccaccctggtcaccgttcctcacncctccaccaagggcccatccggtcttcccccgtggccgccctcgctccacgggacnccaccctccgagacgcacacgccggcccgtgggctcgcctggacaaggacctactccagacagcgtactgagcgggctggcgaaggcgcagtagnnnnnnnnn

SEQ ID NO: 52991 - DNA, 372 bp, Homo sapiens
  misc_feature: GYAE6OF01A2B48.36.26.C04.1.454.CMB.1.raw
  modified_base (266)..(266): a, c, t, g, unknown or other
  misc_feature (266)..(266): n is a, c, g, or t
  modified_base (365)..(372): a, c, t, g, unknown or other
  misc_feature (365)..(372): n is a, c, g, or t
tcagtacgctgtctcacgaccggtgctcgatttagtctagcgactttgggtttggggcagggagtgggctaaggtgacgcaggtggcgccagccaggcgcacacccaatgcccgtgagcccagacactggaccctgcctggaccctcgtggatagacaagaaccaaggggcctctgcgccctgggcccagctctgtcccacaccgcagtcacatggcgccatctctcttgcagcttccaccaaggcccatcggtcttcccctggcnccctgctccaggagcacctctggggcacagcggccctgggctgcctggtcaaggactacttccagacagcgtactgagcgggctggcaaggcgcatagnnnnnnnn

SEQ ID NO: 52992 - DNA, 381 bp, Homo sapiens
  misc_feature: GYAE6OF01BUB05.36.26.C04.1.454.CMB.1.raw
  modified_base (367)..(369): a, c, t, g, unknown or other
  misc_feature (367)..(369): n is a, c, g, or t
  modified_base (371)..(381): a, c, t, g, unknown or other
  misc_feature (371)..(381): n is a, c, g, or t
tcagtacgctgtctcacgaccggtgctcgatttagtctagcgactttgggtttggggcagggagtgggctaaggtgacgcaggtggcgccagccaggcgcacacccaatgcccgtgagcccagacactggaccctgcctggaccctcgtggatagacaagaaccaaggggcctctgcgccctgggcccagctctgtcccacaccgcagtcacatggcgccatctctcttgcagcttccaccaagggcccatcggtcttccccctggcgccctgctccaggagcacctctggggcacagcggccctgggcctgcctggtcaaggctacttccagacagcgtactgagcgggctggcaaggcgcatagnnngnnnnnnnnnnn

SEQ ID NO: 52993 - DNA, 520 bp, Homo sapiens
  misc_feature: GYAE6OF01B66ZG.36.26.C04.1.454.CMB.1.raw
  modified_base (510)..(520): a, c, t, g, unknown or other
  misc_feature (510)..(520): n is a, c, g, or t
tcagtacgctgtctcacgaccggtgctcgatttagtctagcgactttgggttgggggggtccctgagactctcctgtgtagcctctggattcacctttagcacctattccatgagttgggtccgccaggctccggggaaggggctggagtgggtctcaagtgttagtggtgatggtgctaacacatactacgcaggctccgtgaagggccgcttcaccatctccagagacaattccgagagcacggtgtttctgcaaatgagccgcctgaaagccgaggacacggccatttactactgtgcgagaatgcagacagtgggagctgacaccgtggggccagggcaccctggtcaccgtttcctcagcctccaccaagggccccatcggtcttcccccctggccaccctcctcccaagacgccacctctgggggccacgacgccggccctgggcctgccctggtcaaggactacttccagacagcgtactgagcgggctggcaggcgcatagnnnnnnnnnnn

SEQ ID NO: 52994 - DNA, 374 bp, Homo sapiens
  misc_feature: GYAE6OF01B8RAL.36.26.C04.1.454.CMB.1.raw
  modified_base (366)..(374): a, c, t, g, unknown or other
  misc_feature (366)..(374): n is a, c, g, or t
tcagtacgctgtctcacgaccggtgctcgatttagtctagcgactttgggtttggggcagggagtgggctaaggtgacgcaggtggcgccagccaggcgcacacccaatgcccgtgagcccagacactggaccctgcctggaccctcgtggatagacaagaaccaaggggcctctgcgccctgggcccagctctgtcccacaccgcagtcacatggcgccatctctcttgcagcttccaccaaggcccatcggtcttcccctggcgccctgctccaggagcacctctgggggcacagcggccctgggctgcctggtcaaggactacttccagacagcgtactgagcgggctggcaaggcgcatagnnnnnnnnn

SEQ ID NO: 52995 - DNA, 564 bp, Homo sapiens
  misc_feature: GYAE6OF01BU641.36.26.C04.1.454.CMB.1.raw
  modified_base (238)..(238): a, c, t, g, unknown or other
  misc_feature (238)..(238): n is a, c, g, or t
  modified_base (312)..(312): a, c, t, g, unknown or other
  misc_feature (312)..(312): n is a, c, g, or t
  modified_base (349)..(349): a, c, t, g, unknown or other
  misc_feature (349)..(349): n is a, c, g, or t
  modified_base (557)..(557): a, c, t, g, unknown or other
  misc_feature (557)..(557): n is a, c, g, or t
  modified_base (559)..(559): a, c, t, g, unknown or other
  misc_feature (559)..(559): n is a, c, g, or t
  modified_base (561)..(561): a, c, t, g, unknown or other
  misc_feature (561)..(561): n is a, c, g, or t
tcagtacgctgtctcacgaccggtgctcgatttagtctagcgactttgggtttgggggtccctgagactctcctgtgtagcctctggattcacctttagcacctattccatgagttgggtccgccaggctccggggaaggggctggagtgggtctcaagtgttagtggtgatggtgctaacacatactacgcaggctccgtgaagggccgcttcaccatctccagagacaatcccaanagtatactgtatctagacatgaacagcctgacagccgagacacggctatattatgtgacgaaaggaccaatccncatcactccctatacttagatacgtgggccagggacncctggaccaccgtctccgtcagccctaccacgaacggcccagttccggtacccttccccgtggcccgtccgtcgcctccgagacgaccacctaccgagacgcacgacggccggcccgtgggcctcgccgtggcgtaacgtactaccgttaccgagaccagtccgacgtacggacgtccgggctcgggaccgaacgggcacgacgtagncngngcg

SEQ ID NO: 52996 - DNA, 416 bp, Homo sapiens
  misc_feature: GYAE6OF01D92KN.36.26.C04.1.454.CMB.1.raw
  modified_base (406)..(416): a, c, t, g, unknown or other
  misc_feature (406)..(416): n is a, c, g, or t
tcagtacgctgtctcacgaccggtgctcgatttagtctagcgactttgggtttggggcagggagtgggctaaggtgacgcaggtggcgccagccaggcgcacacccaatgcccgtgagcccagacactggaccctgcctggaccctcgtggatagacaagaaccaaggggcctctgcgccctgggcccagctctgtcccacaccgcagtcacatggcgccatctctcttgcagccttccaccaagggcccatccggtccttccccctggccgccctgcctcccgaggacgccacctcgtgggggccacgacggccggcccgtggggcctcggcccgtggtccgaacggacctaccttccacgacgagccgtacgtggacggcgggcgtcggcgaaggccgcatagnnnnnnnnnnn

SEQ ID NO: 52997 - DNA, 608 bp, Homo sapiens
  misc_feature: GYAE6OF01BHAGR.36.26.C04.1.454.CMB.1.raw
  modified_base (353)..(353): a, c, t, g, unknown or other
  misc_feature (353)..(353): n is a, c, g, or t
  modified_base (402)..(402): a, c, t, g, unknown or other
  misc_feature (402)..(402): n is a, c, g, or t
  modified_base (604)..(605): a, c, t, g, unknown or other
  misc_feature (604)..(605): n is a, c, g, or t
tcagtacgctgtctcacgaccggtgctcgatttagtctagcgactttgggtttgggggaggcttggaacagccgggggggtccctgagactctcctgtgtagcctctggattcacctttagcacctattccatgagttgggtccgccaggctccgggggaaggggctggagtgggtctcaagtgttagtggtgatggtgctaacacatactacgcaggctccgtgaagggccgcttcaccatctccagagacaattccgagagcacggtgtttctgacaaatgacgccgcctagaaacgccgaggaccacggcctaatttacactgtgcgaagaatgacagacgaggtgggancgtagaccaccggtggggccagggccacccgtggtcctacccgtttccncacgccctaccgaccgaacgggcccagtccggtcccttcccccgtggcccgtccctcgcctccgaggacgccacccgtccgagacgaccacgacgccggcccgtgggcctcggccgtaaggtccgaacgtacctaccttaccgacgaccgacgaccgttacgcggacggcgggcgtcgggaccgaacgggcgacgaagtcgnngcg

SEQ ID NO: 52998 - DNA, 666 bp, Homo sapiens
  misc_feature: GYAE6OF01BFW0L.36.26.C04.1.454.CMB.1.raw
  modified_base (213)..(213): a, c, t, g, unknown or other
  misc_feature (213)..(213): n is a, c, g, or t
  modified_base (256)..(256): a, c, t, g, unknown or other
  misc_feature (256)..(256): n is a, c, g, or t
  modified_base (304)..(304): a, c, t, g, unknown or other
  misc_feature (304)..(304): n is a, c, g, or t
  modified_base (328)..(328): a, c, t, g, unknown or other
  misc_feature (328)..(328): n is a, c, g, or t
  modified_base (656)..(656): a, c, t, g, unknown or other
  misc_feature (656)..(656): n is a, c, g, or t
  modified_base (658)..(658): a, c, t, g, unknown or other
  misc_feature (658)..(658): n is a, c, g, or t
  modified_base (660)..(666): a, c, t, g, unknown or other
  misc_feature (660)..(666): n is a, c, g, or t
tcagtacgctgtctcacgaccggtgctcgatttagtctagcgactttgggttgggggggtccctgagactctcctgtgtagcctctggattcacctttagcacctattccatgagttgggtccgccaggctccgggggaaggggctgggagtgggtctcaagtgttagtggtgatggtgctaacacatactacgcaggctccgtgaagggccncttcaccatctccagagacaattccgagagcacggttgtttcngcaaatgagccgctagaaagccgaggacacggcctatttacctactgngcgagaatggcagacaggtggganctgaccgaccgtggggccacgggcctacccggtgtcctacccgtttccacgacgtccctaccgaaccggaccggccctagttcccggttcccttcccccgtgggcccgtcccgtcggacccttaccggacggtaccgcccgtaacccgtccggaacgaccgaccgaaccgacggccccgggtccccggtgggtcccgtccggtacccgttacgggtaaccgaaaccgggtaccttaaccccggttaccgaccggaaccgtacggtacccggtttacgtacgggaccgggccgggtacgtacgggaccgtaaacgggcgactagacggngngnnnnnnn

SEQ ID NO: 52999 - DNA, 618 bp, Homo sapiens
  misc_feature: GYAE6OF01A894M.36.26.C04.1.454.CMB.1.raw
  modified_base (393)..(393): a, c, t, g, unknown or other
  misc_feature (393)..(393): n is a, c, g, or t
  modified_base (613)..(614): a, c, t, g, unknown or other
  misc_feature (613)..(614): n is a, c, g, or t
  modified_base (616)..(616): a, c, t, g, unknown or other
  misc_feature (616)..(616): n is a, c, g, or t
  modified_base (618)..(618): a, c, t, g, unknown or other
  misc_feature (618)..(618): n is a, c, g, or t
tcagtacgctgtctcacgaccggtgctcgatttagtctagcgactttgggtttgggggaggcttggaacagccgggggggtccctgagactctcctgtgtagcctctggattcacctttagcacctattccatgagttgggtccgccaggctccggggaaggggctggagtgggtctcaagtgttagtggtgatggtgctaacacatactacgcaggctccgtgaagggccgcttcaccatctccagagacaattccgagagcacggtgtttctgcaaatgagccgcctgaaagccgaggacacggccatttactactgtgcgagaatgcagacgagtgggagctgaccaccgtcggggccgagggccacccgtggtcctacccggttttccncacgcccttcccaacccgaacgggccccactccggttcccttcccccgtcggccccgcccctcgcccttccgacgggtaccgccacccgtccgaagcgacaaccgacggccggcccggttcgggttcgcccgtcgggtaccaagggtacctaccttccgaacgtacacgtccggtacgtggacggcgggcggtggacgaacgggcgtaaccgagtaaggnngngn

SEQ ID NO: 53000 - DNA, 692 bp, Homo sapiens
  misc_feature: GYAE6OF01BXK39.36.26.C04.1.454.CMB.1.raw
  modified_base (232)..(232): a, c, t, g, unknown or other
  misc_feature (232)..(232): n is a, c, g, or t
  modified_base (276)..(276): a, c, t, g, unknown or other
  misc_feature (276)..(276): n is a, c, g, or t
  modified_base (411)..(411): a, c, t, g, unknown or other
  misc_feature (411)..(411): n is a, c, g, or t
  modified_base (691)..(691): a, c, t, g, unknown or other
  misc_feature (691)..(691): n is a, c, g, or t
tcagtacgctgtctcacgaccggtgctcgatttagtctagcgactttgggtttgggggaggcttggaacagccgggggggtccctgagactctcctgtgtagcctctggattcacctttagcacctattccatgagttgggtccgccaggctccggggaaggggctggagtgggtctcaagtgttagtggtgatggtgctaacacatactacgcaggctccgtgaagggccncttcaccatctccagagacaattccgagagcgacggttgtttcngacaaatgacgccgctagaaacgccgagacacggcctatttacactgtgacgagaatgacagacgtaggtgggactctcgaccaccggtgggacccgagggcccgtacccgttggtccccgtacccgttttcccnccgtaccgtacccctacccgaacccggaaccgggtcccctaacgttcccggttccccttcccccggttcgggaccccgtcccgtaccggtcccgtaccgaacgggtaccgaccctaaccccgtaccggacggtaccgaccgtaaccgaccggtcccgggcccgttcgggcctccggtccgtacggtaccgaaacgtacccttaccgtaccgaacgtaccgtacgtaccgttacgacgggtacgggccgggtcgtcggacgacggtcacgtaagtcgagcng

SEQ ID NO: 53001 - DNA, 441 bp, Homo sapiens
  misc_feature: GYAE6OF01E52J4.36.26.C04.1.454.CMB.1.raw
  modified_base (416)..(441): a, c, t, g, unknown or other
  misc_feature (416)..(441): n is a, c, g, or t
tcagtacgctgtctcacgaccggtgctcgatttagtctagcgactttgggtttggggcagggagtgggctaaggtgacgcaggtggcgccagccaggcgcacacccaatgcccgtgagcccagacactggaccctgcctggaccctcgtggatagacaagaaccaaggggcctctgccgccctgggcccagctctcgtcccacaccgcagtcacatggcgccatctctctgcagcttccaccgaacgggcccagtccggtccttccccctggccgccctgcctccgaggacgccaccgtcgtggggcaccgacggccggcccgtggggccttcggcccgtggtaccaacgggtacctaccgttccagaccaggaccgtacgtggacggccgggcgtggacaaacggcgacagtagnnnnnnnnnnnnnnnnnnnnnnnnnn

SEQ ID NO: 53002 - DNA, 616 bp, Homo sapiens
  misc_feature: GYAE6OF01CTV81.36.26.C04.1.454.CMB.1.raw
  modified_base (358)..(358): a, c, t, g, unknown or other
  misc_feature (358)..(358): n is a, c, g, or t
  modified_base (374)..(374): a, c, t, g, unknown or other
  misc_feature (374)..(374): n is a, c, g, or t
  modified_base (393)..(393): a, c, t, g, unknown or other
  misc_feature (393)..(393): n is a, c, g, or t
  modified_base (474)..(474): a, c, t, g, unknown or other
  misc_feature (474)..(474): n is a, c, g, or t
  modified_base (590)..(590): a, c, t, g, unknown or other
  misc_feature (590)..(590): n is a, c, g, or t
  modified_base (612)..(612): a, c, t, g, unknown or other
  misc_feature (612)..(612): n is a, c, g, or t
tcagtacgctgtctcacgaccggtgctcgatttagtctagcgactttgggtttgggggaggcttggaacagccggggggggtccctgagactctcctgtgtagcctctggattcacctttagcacctattccatgagttgggtccgccaggctccggggaagggctggagtgggtctcaagtgttagtggtgatggtgctaacacatactacgcaggctccgtgaacgggccgcttcaccatctccagagacaattccgagagcacggttgtttctgacaaagtgacgccgcctagaaacgccgaggacacggcctatttacactgtgacgagaatgacagacaggtggagcgtgacnccgtgggccagggccnccgtgtcctaccgtttccncacgtccctaccgaaccgaaccgggtccctagtcccggttcccttcccccgtcggcccgtccctcgccgtaccgagggccnccgacccgtccggagacgccacgaccggccggcccggtagggcctacggaccgtggtaccgaacggttacctacgttaccgaacgtacacggtcgtacgtcggaggccgggtacgnggacgaacggtccgatagacgngtgc

SEQ ID NO: 53003 - DNA, 376 bp, Homo sapiens
  misc_feature: GYAE6OF01A1EP0.36.26.C04.1.454.CMB.1.raw
  modified_base (340)..(340): a, c, t, g, unknown or other
  misc_feature (340)..(340): n is a, c, g, or t
  modified_base (364)..(376): a, c, t, g, unknown or other
  misc_feature (364)..(376): n is a, c, g, or t
tcagtacgctgtctcacgaccggtgctcgatttagtctagcgactttgggtttggggcgagggagtgggctaaggtgacgcaggtggcgccagccaggcgcacacccaatgcccgtgagcccagacactggaccctgcctggaccctcgtggatagacaagaaccaaggggcctctgcgccctgggcccagctctgtcccacaccgcagtcacatggcgccatctctcttgcagcttccacaagggcccatcggtcttcccctggcgccctgctccaggagcacctctggggcacagcggccctggctgcctggtcaaggctacttccagacagcgtacngagcgggctggcaaggcgcatagnnnnnnnnnnnnn

SEQ ID NO: 53004 - DNA, 620 bp, Homo sapiens
  misc_feature: GYAE6OF01ALOGS.36.26.C04.1.454.CMB.1.raw
  modified_base (273)..(273): a, c, t, g, unknown or other
  misc_feature (273)..(273): n is a, c, g, or t
  modified_base (278)..(278): a, c, t, g, unknown or other
  misc_feature (278)..(278): n is a, c, g, or t
  modified_base (355)..(355): a, c, t, g, unknown or other
  misc_feature (355)..(355): n is a, c, g, or t
  modified_base (361)..(361): a, c, t, g, unknown or other
  misc_feature (361)..(361): n is a, c, g, or t
  modified_base (394)..(394): a, c, t, g, unknown or other
  misc_feature (394)..(394): n is a, c, g, or t
  modified_base (435)..(435): a, c, t, g, unknown or other
  misc_feature (435)..(435): n is a, c, g, or t
tcagtacgctgtctcacgaccggtgctcgatttagtctagcgactttgggtttgggggaggcttggaacagcccgggggggtccctgagactctcctgtgtagcctctggattcacctttagcacctattccatgagttgggtccgccaggctccggggaaggggctggagtgggtctcaagtgttagtggtgatggtgctaacacatactacgcaggctccggtgaagggccgcttcaccagtctccagacgacaattccgagagcacggtntttcngcaaatgagccgcctagaaacgccgaggaccacggtcctatttacacgtgtcgacgagaatgacagacaggtggganctgacnccgtgggccagggcaccgtgtcctaccgtttcncgacgccctccgaccgacgggcccagtccgtccttccccgnggccgtcccgtcgacctccgacggtaccgcccacccgtccgacgacgaccacgacggcccgggtacccgtcgggacctcggacccgtacgggtaccgaacggtacttaccgttacgacgtaccgtacgtaccgtacgtcggacgggccgggtcgacggaccgaacgggccgagtagtgcgtgacg

SEQ ID NO: 53005 - DNA, 586 bp, Homo sapiens
  misc_feature: GYAE6OF01CQI0X.36.26.C04.1.454.CMB.1.raw
  modified_base (223)..(223): a, c, t, g, unknown or other
  misc_feature (223)..(223): n is a, c, g, or t
  modified_base (232)..(232): a, c, t, g, unknown or other
  misc_feature (232)..(232): n is a, c, g, or t
  modified_base (273)..(273): a, c, t, g, unknown or other
  misc_feature (273)..(273): n is a, c, g, or t
  modified_base (348)..(348): a, c, t, g, unknown or other
  misc_feature (348)..(348): n is a, c, g, or t
  modified_base (399)..(399): a, c, t, g, unknown or other
  misc_feature (399)..(399): n is a, c, g, or t
  modified_base (448)..(448): a, c, t, g, unknown or other
  misc_feature (448)..(448): n is a, c, g, or t
  modified_base (579)..(579): a, c, t, g, unknown or other
  misc_feature (579)..(579): n is a, c, g, or t
  modified_base (582)..(582): a, c, t, g, unknown or other
  misc_feature (582)..(582): n is a, c, g, or t
  modified_base (584)..(584): a, c, t, g, unknown or other
  misc_feature (584)..(584): n is a, c, g, or t
  modified_base (586)..(586): a, c, t, g, unknown or other
  misc_feature (586)..(586): n is a, c, g, or t
tcagtacgctgtctcacgaccggtgctcgatttagtctagcgactttgggtttgggggaggcttggaacaggccgggggggtccctgagactctcctgtgtagcctctggattcacctttagcacctattccatgagttgggtccgccaggcgtccggggaagggctggagtgggtctcaagtgttagtggtgatggtgctaacacatacacgcaggctccgngaagggccnttcacatctccagagacaattccgagagcacggttgtttcngacaaatgagccgctagaaagccgaaggacacggcctatttaacactgtgacgagaatgcagactaggtgggacnctagaccaccgtggggaccaacggggctacccgtggtcctaccggtttccncgacgccctacccaaccgaagggcccctaagtcccggtccttcccccgnggccgcccctgcctcccgaaggcgacctacccgcgagacaccgacacggccggtcccgtggctcgccgtggtacaacggtctaccgtcgaagaccagtccgtaacgcggagcggctcgggacaaggccganagngngn

SEQ ID NO: 53006 - DNA, 746 bp, Homo sapiens
  misc_feature: GYAE6OF01BNZLR.36.26.C04.1.454.CMB.1.raw
  modified_base (145)..(145): a, c, t, g, unknown or other
  misc_feature (145)..(145): n is a, c, g, or t
  modified_base (313)..(313): a, c, t, g, unknown or other
  misc_feature (313)..(313): n is a, c, g, or t
  modified_base (322)..(322): a, c, t, g, unknown or other
  misc_feature (322)..(322): n is a, c, g, or t
  modified_base (741)..(741): a, c, t, g, unknown or other
  misc_feature (741)..(741): n is a, c, g, or t
  modified_base (743)..(743): a, c, t, g, unknown or other
  misc_feature (743)..(743): n is a, c, g, or t
tcagtacgctgtctcacgaccggtgctcgatttagtctagcgactttgggtttgggggaggcttggaacagccggggggtccctgagactctcctgtgtagcctcgtggattcacctttagcacctattccatgagttgggtccncgaggcgtccggggaagggctggagtcgggtctcgaagttgttaggtggtgagttgggtgactaaacactaagttaccgtacgcgaggtcctccggtaggaacgggcctcttaccaacctagttcctacgaaggacgaactaacgttccgaagacgtcgtacgggttnttttaccgnggaacaaagtcggaccgcccgtaccgtaaggaaaacgcccggaaagaccgtaccggtaccttaattttaccgacgtggtacgacgtaagtaacgtgacggaacgtagagggtagggactcgtacggaaccgtccggcgggaccacgggtccctaacccggtggtacccttacccggtttcacccgactcccgtacccgaaaccggtaccggcccttacggtcccgttccccgttccccggcggtcccccgtaccgtccgtccgaccggaacggccgtacccgacccgtcggaacgccaccgtacgccgggtcccggaccgtcggcttccggcgtacgtacgaaccgttctaccgtcaaggaccgtaggtaccgtaggtcggagggcggtacggacggaccgacgggtaccagtaagcgngngcg

SEQ ID NO: 53007 - DNA, 521 bp, Homo sapiens
  misc_feature: GYAE6OF01EOURS.36.26.C04.1.454.CMB.1.raw
  modified_base (233)..(233): a, c, t, g, unknown or other
  misc_feature (233)..(233): n is a, c, g, or t
  modified_base (333)..(333): a, c, t, g, unknown or other
  misc_feature (333)..(333): n is a, c, g, or t
  modified_base (476)..(477): a, c, t, g, unknown or other
  misc_feature (476)..(477): n is a, c, g, or t
  modified_base (482)..(521): a, c, t, g, unknown or other
  misc_feature (482)..(521): n is a, c, g, or t
tcagtacgctgtctcacgaccggtgctcgatttagtctagcgacttttggggtttggggcaggggagtgggctaaggtgacgcaggtggcgccagccaggcgcacacccaatgcccgtgacgcccagacactggaccctgcctggaccctcggtggatagaacaagaaccgaaggggcctctcgccgcccgtgggcccagcctctcgtcccacaccgcagtcacagtcggccnccattcttcctcttcgctacgtccttacccgaaccgaacgggccctacgttcccggttcccttcccccgtcggcccgtcccctcgccctaccgacggacncctaccggtcggtcggggacctacggacggcccggtcccgtcgggctcggtcccgtaggtaccgaacggtaccttacttaccgaagtaccgacggtaccgtacgtcggacggcgggtcgacggacgacggccgataagtacgnngatgnnnnnnnnnnnnnnnnnnnnnnnnnnnnnnnnnnnnnnnn

SEQ ID NO: 53008 - DNA, 378 bp, Homo sapiens
  misc_feature: GYAE6OF01BJMXN.36.26.C04.1.454.CMB.1.raw
  modified_base (369)..(378): a, c, t, g, unknown or other
  misc_feature (369)..(378): n is a, c, g, or t
tcagtacgctgtctcacgaccggtgctcgatttagtctagcgactttgggtttggggcagggagtgggctaaggtgacgcaggtggcgccagccaggcgcacacccaatgcccgtgagcccagacactggaccctgcctggaccctcgtggatagacaagaaccaaggggcctctgcgccctgggccccagctctgtcccacaccgcagtcacatggcgccatctctcttgcagcttccaccaaggcccatcggtcttccccctggcgccctgctccaggacgcacctctggggcacagcggccctgggctgcctggtcaacggactacttcagacagcgtactgagcgggctggcaaggcgcagtagnnnnnnnnnn

SEQ ID NO: 53009 - DNA, 676 bp, Homo sapiens
  misc_feature: GYAE6OF01BTADB.36.26.C04.1.454.CMB.1.raw
  modified_base (357)..(357): a, c, t, g, unknown or other
  misc_feature (357)..(357): n is a, c, g, or t
  modified_base (412)..(412): a, c, t, g, unknown or other
  misc_feature (412)..(412): n is a, c, g, or t
  modified_base (671)..(671): a, c, t, g, unknown or other
  misc_feature (671)..(671): n is a, c, g, or t
tcagtacgctgtctcacgaccggtgctcgatttagtctagcgactttgggtttgggggaggcttggaacagccgggggggtccctgagactctcctgtgtagcctctggattcacctttagcacctattccatgagttgggtccgccaggctccggggaagggctggagtgggtctcaagtgttagtggtgatggtgctaacacatactacgcaggctccgtgaagggccgcttcaccatcctccagagacaattccgagacgcacggttgtttctgacaaatgacgccgcctagaaacgccgaaggacaccggcctatttacctacgtgtgcgagaatgacagacgaggtagggancgtagaccgaccggtcgggccaacgggcccacccgtcggtacctacccgtttccncgacgccctaccgaaccgaacggcccctagttcccgtcccttcccccgtcggcccgtcccgtcgcccgtaccgaacggtaccgacccacccgtacccggacgaccgaccgaaccgacggcccgggtacccgtcgggtccgtccggtccggttacggtacgaacggtaccttaccgttaccgaacgaccgtaacggtccgtaacggtcgggacggtaccggggtccgtaccgggacggaaccggccgaacgaacgtaggntgacg

SEQ ID NO: 53010 - DNA, 790 bp, Homo sapiens
  misc_feature: GYAE6OF01BKUCN.36.26.C04.1.454.CMB.1.raw
  modified_base (124)..(124): a, c, t, g, unknown or other
  misc_feature (124)..(124): n is a, c, g, or t
  modified_base (786)..(788): a, c, t, g, unknown or other
  misc_feature (786)..(788): n is a, c, g, or t
  modified_base (790)..(790): a, c, t, g, unknown or other
  misc_feature (790)..(790): n is a, c, g, or t
tcagtacgctgtctcacgaccggtgctcgatttagtctagcgactttgggttgggggggtccctgagactctcctgtgtagcctctggattcacctttagcacctattccatgagttgggtccnccaggctccggggaagggctgggagtgggtctcaagtgttagtggtgatggtgactaacacatactacgcaggtcctccggtggaacgggcccgtctttaccaaccctattcctacccgaaggaacgtaacctaaactttacccgaaaacgaaaccctaccccgttgttaccttcctaggaactaaaagttacgaaaacctaaccggtaggaacggaccggacccgggaacggaacccgtaacccggtaacccttaaagttaacgtttaaccgttaacggtaaaaccgtaaacggtccggtaaccgtaacggtattacgtacgtaacgttacgttaggttacggtacgttacggttacttacgtacgttcggttcgggtccgggtccgtacggaccgtaccggtcgttacctacgttcgtcctccgacgtacccgaccctaccgaccggtaccggtccctaccgttcccggttaccccgtcccggtccggccccgtcccgtccgaccgtaccgacggcccgtacccgtccgtaccggacgacgccgaccggcccgggacccgtccggtcggtcgtccgtacgggtaccgacgtaacgtacctaccgtacgaaccgtacgtacgtacggtacgcgggcggtcgggcgacggtcgacggcagannngn

SEQ ID NO: 53011 - DNA, 544 bp, Homo sapiens
  misc_feature: GYAE6OF01EJ2G9.36.26.C04.1.454.CMB.1.raw
  modified_base (252)..(252): a, c, t, g, unknown or other
  misc_feature (252)..(252): n is a, c, g, or t
  modified_base (422)..(422): a, c, t, g, unknown or other
  misc_feature (422)..(422): n is a, c, g, or t
  modified_base (534)..(534): a, c, t, g, unknown or other
  misc_feature (534)..(534): n is a, c, g, or t
  modified_base (538)..(544): a, c, t, g, unknown or other
  misc_feature (538)..(544): n is a, c, g, or t
tcagtacgctgtctcacgaccggtgctcgatttagtctagcgactttgggtttgggggtccctgagactctcctgtgtagcctctggattcacctttagcacctattccatgagttgggtccgccaggctccggggaaggggctggagtgggtctcaagtgttagtggtgatggtgctaacacatactacgcaggctccgtgaagggccgcttcaccatctccagagacaattccgagagcacggtgtttcngcaaatgagccgcctgaaagccgaggacacggccatttactactgtgcgagaatgcagacaggtgggagctgacaccgtgggccagggcacccgtggtccaccgtttcctcacgcctccaccgaaggccccatccggtcctcccccgtggccgccctgcctccgaggacnccacccgtccgagacgcacgacgccggcccgtgggcctgccgtggtcgaaggaccttaccgtccacgacacgcgtacgtgacggcgggcgtggacgaggcgaccgagtacgngacnnnnnnn

SEQ ID NO: 53012 - DNA, 615 bp, Homo sapiens
  misc_feature: GYAE6OF01DVT78.36.26.C04.1.454.CMB.1.raw
  modified_base (123)..(123): a, c, t, g, unknown or other
  misc_feature (123)..(123): n is a, c, g, or t
  modified_base (247)..(247): a, c, t, g, unknown or other
  misc_feature (247)..(247): n is a, c, g, or t
  modified_base (252)..(252): a, c, t, g, unknown or other
  misc_feature (252)..(252): n is a, c, g, or t
  modified_base (265)..(265): a, c, t, g, unknown or other
  misc_feature (265)..(265): n is a, c, g, or t
  modified_base (334)..(334): a, c, t, g, unknown or other
  misc_feature (334)..(334): n is a, c, g, or t
  modified_base (338)..(338): a, c, t, g, unknown or other
  misc_feature (338)..(338): n is a, c, g, or t
  modified_base (432)..(432): a, c, t, g, unknown or other
  misc_feature (432)..(432): n is a, c, g, or t
  modified_base (559)..(559): a, c, t, g, unknown or other
  misc_feature (559)..(559): n is a, c, g, or t
  modified_base (599)..(599): a, c, t, g, unknown or other
  misc_feature (599)..(599): n is a, c, g, or t
  modified_base (609)..(609): a, c, t, g, unknown or other
  misc_feature (609)..(609): n is a, c, g, or t
tcagtacgctgtctcacgaccggtgctcgatttagtctagcgactttgggtttgggggtccctgagactctcctgtgtagcctctggattcacctttagcacctattccatgagttgggtccnccaggctccggggaagggctggagtgggtctcaagtgttagtggtgatggtgctaacacatactacgcaggctccggtgaagggccgcttcaccatctccagagacaattccgagagcacggtntttcngacaaatgagccncctagaaacgccgaggacacggccattttacactgtagcgaagtaactgacctaggaccaggtgggacncgtnacgtaccgtggggccgagggccaccgtggtacctaccgtttcctacgacgtccctaccgaacggaacgggccctagtccggtaccttcccccgngggacccgtcccctgccctaccgaacggtcgaccctacccgtcgaaggacaccaacgcggtcccgggacctgggctcggccgtaggtaccgaaggtaccttacgttaccgaagcgacggtcgtacgngaccggtcgggcttcgggacgaacgggcgactaagtacgnacgcatccgntagcaa

SEQ ID NO: 53013 - DNA, 753 bp, Homo sapiens
  misc_feature: GYAE6OF01C4R1C.36.26.C04.1.454.CMB.1.raw
  modified_base (126)..(126): a, c, t, g, unknown or other
  misc_feature (126)..(126): n is a, c, g, or t
  modified_base (427)..(427): a, c, t, g, unknown or other
  misc_feature (427)..(427): n is a, c, g, or t
  modified_base (578)..(578): a, c, t, g, unknown or other
  misc_feature (578)..(578): n is a, c, g, or t
  modified_base (741)..(741): a, c, t, g, unknown or other
  misc_feature (741)..(741): n is a, c, g, or t
  modified_base (747)..(747): a, c, t, g, unknown or other
  misc_feature (747)..(747): n is a, c, g, or t
  modified_base (749)..(751): a, c, t, g, unknown or other
  misc_feature (749)..(751): n is a, c, g, or t
  modified_base (753)..(753): a, c, t, g, unknown or other
  misc_feature (753)..(753): n is a, c, g, or t
tcagtacgctgtctcacgaccggtgctcgatttagtctagcgacttttggggttgggggggtccctgagactctcctgtgtagcctctggattcacctttagcacctattccatgagttgggtccnccaggcgtccggggaaggggctggagtgggtctcaagttgttagtggtgtatgggtgacctaaacactatacctacgcaggcctccggtaggaacggggccctcctttaccaacctacttccctccgaagagaacctaaatttcccggaagacgccgtacggtttcgttttcaggaactaaatcggacgccgcctaggaaaacggccggaaggtaccaccggtccttaatttacgactggtacggacggaaagtaagcgaacgaacgacggagggtcggagtcgtacggaaccgtccgggnggggacccgacggggaccccttaccggtacggttacccttaccccggtttcccacacccggtcccctaaccgaacccggaacggtcccctacggttcccgttcccccttacccgccggtcccgtcccgttacgccgtaccggaacgtaccnccgtacccgtacgacgaccgaccgacggccggacccggtccggtcggaccgttcgaccgtacgggtaaccgaacgttaccttaccgtaccgaacgaccggtactccggttaacgtgggaaccggtcggggcgttaccgggagtaaacggcccgaagtcacganacgcanannngn

SEQ ID NO: 53014 - DNA, 806 bp, Homo sapiens
  misc_feature: GYAE6OF01COM52.36.26.C04.1.454.CMB.1.raw
  modified_base (125)..(125): a, c, t, g, unknown or other
  misc_feature (125)..(125): n is a, c, g, or t
  modified_base (278)..(278): a, c, t, g, unknown or other
  misc_feature (278)..(278): n is a, c, g, or t
  modified_base (405)..(405): a, c, t, g, unknown or other
  misc_feature (405)..(405): n is a, c, g, or t
  modified_base (792)..(792): a, c, t, g, unknown or other
  misc_feature (792)..(792): n is a, c, g, or t
  modified_base (800)..(800): a, c, t, g, unknown or other
  misc_feature (800)..(800): n is a, c, g, or t
  modified_base (804)..(804): a, c, t, g, unknown or other
  misc_feature (804)..(804): n is a, c, g, or t
  modified_base (806)..(806): a, c, t, g, unknown or other
  misc_feature (806)..(806): n is a, c, g, or t
tcagtacgctgtctcacgaccggtgctcgatttagtctagcgactttggggttgggggggtccctgagactctcctgtgtagcctctggattcacctttagcacctattccatgagttgggtccnccaggcgtccggggaagggctgggagtgggtctcaagttgttagtggtgatggtgactaacacatactacgcaggctccggtaggaacgggcctcttacacctagtcctaccgaagagaacctaaacgttccggaagacgtcgtaacgggttnttttcagactaaaagtcggaacggccaccgtaaggaaaacggccggaaggacctacggtaccttaagttttaccaacgttggtcggaacggaagtaacgtcgacgaacggacggagggtaggggacncgtaccggaaaccgtccgggttcggggacccgacgggaccctaacccggttggtacccctttaccggtttcccacgaaccgtcccaccgaaacggaaccggtccctaccgttacccggttcccctttccccggacggaccccgttcccgtacggtacccgtaccggaacggtaacccgccccgtaaacccggtacgggaacgaccggaacccgaccggtaccgggcccggtaccccggtggtacccggttcggtaccggtaacgggtaaaccgtaaccggttaaccctttacccgttaccgaacggtaccgggttaccgtaaccgggttacgtaaccggggccgggtaccgggacgtacgggaacgtaaccgggctaacgagtacgntgctagcngcgngn

SEQ ID NO: 53015 - DNA, 626 bp, Homo sapiens
  misc_feature: GYAE6OF01AG2WA.36.26.C04.1.454.CMB.1.raw
  modified_base (147)..(147): a, c, t, g, unknown or other
  misc_feature (147)..(147): n is a, c, g, or t
  modified_base (202)..(202): a, c, t, g, unknown or other
  misc_feature (202)..(202): n is a, c, g, or t
  modified_base (210)..(210): a, c, t, g, unknown or other
  misc_feature (210)..(210): n is a, c, g, or t
  modified_base (504)..(504): a, c, t, g, unknown or other
  misc_feature (504)..(504): n is a, c, g, or t
  modified_base (515)..(515): a, c, t, g, unknown or other
  misc_feature (515)..(515): n is a, c, g, or t
  modified_base (541)..(541): a, c, t, g, unknown or other
  misc_feature (541)..(541): n is a, c, g, or t
  modified_base (621)..(621): a, c, t, g, unknown or other
  misc_feature (621)..(621): n is a, c, g, or t
  modified_base (623)..(623): a, c, t, g, unknown or other
  misc_feature (623)..(623): n is a, c, g, or t
tcagtacgctgtctcacgaccggtgctcgatttagtctagcgactttgggtttgggggaggcttggaacaggccgggggggtccctgagactctcctgtgtacgcctctggattcacctttagcacctattccatgagttgggtccncgaggcgtccggggaagggctggagtggtctacgaagttgtagtggtgagtggtnactaacanactactcgcgacggctccggtaggaacggccgtctacaccagttcacaagacgaactaacgtacgagacgtacgtaggttcttcgacgaacaaagtcggaaccgccgtacgtaacgaaacggtccggaacgaaccgaccggtaccttaagtttacacgtgtacggaacgaacggtaatcggacgtaacggagacgggtgggaacacgtacggaacctcgggcggtacacgggtctccgtagtcctaccgttcaacgtcacctcgaacgcgctactccgtcctcctcgccgtccntcgcgagaccncacgtcgacgcacgacgcgtcggccngtcctcgtagtacgtatcgaccttacgcaaggcacgtcgacgtcggccggtaggtccgagaaccgcgtaccgtagagacncntcg

SEQ ID NO: 53016 - DNA, 659 bp, Homo sapiens
  misc_feature: GYAE6OF01D8NQC.36.26.C04.1.454.CMB.1.raw
  modified_base (186)..(186): a, c, t, g, unknown or other
  misc_feature (186)..(186): n is a, c, g, or t
  modified_base (487)..(487): a, c, t, g, unknown or other
  misc_feature (487)..(487): n is a, c, g, or t
  modified_base (538)..(538): a, c, t, g, unknown or other
  misc_feature (538)..(538): n is a, c, g, or t
  modified_base (624)..(624): a, c, t, g, unknown or other
  misc_feature (624)..(624): n is a, c, g, or t
  modified_base (638)..(638): a, c, t, g, unknown or other
  misc_feature (638)..(638): n is a, c, g, or t
  modified_base (643)..(643): a, c, t, g, unknown or other
  misc_feature (643)..(643): n is a, c, g, or t
  modified_base (654)..(654): a, c, t, g, unknown or other
  misc_feature (654)..(654): n is a, c, g, or t
  modified_base (657)..(657): a, c, t, g, unknown or other
  misc_feature (657)..(657): n is a, c, g, or t
tcagtacgctgtctcacgaccggtgctcgatttagtctagcgactttgggtttgggggaggcttggaacagccgggggggtccctgagactctcctgtgtacgcctctggattcacctttagcacctattccatgagttggtccgcaggcgtccggggaagggctggagtggtctcaagtgttagnggtgatggtgctaacactatacgtacgcgaggcctaccggtaggaacgggccctacttcacctatcctaccgagaacgaactaacgttccgaaggtacgccgttacgggttgttttcagacctaaagttggaccgcccgtccgtaaggaaaccggccggaacggtaccgacccggtcctttaacgttttaacctacgtggttacggaacgtaaggtaactcgacgagaacgtggtagggactcgtacgaccgaccgggtcggccgacggccctaccgtcggtacctccgttcacgcgaccncgtaaccgacggtccacgttcccggtaccctcccggtcgtcccgtccgtcncgtacccgaggaccgtaccgacccgtcgaacgcgaccgacggcggcccgcggtcgcgtcgtaccgtgacagtacctactcgatcgngcgtagcgcgcggngacgngacgtcacgancgncg

SEQ ID NO: 53017 - DNA, 814 bp, Homo sapiens
  misc_feature: GYAE6OF01C98KA.36.26.C04.1.454.CMB.1.raw
  modified_base (160)..(160): a, c, t, g, unknown or other
  misc_feature (160)..(160): n is a, c, g, or t
  modified_base (801)..(801): a, c, t, g, unknown or other
  misc_feature (801)..(801): n is a, c, g, or t
  modified_base (806)..(806): a, c, t, g, unknown or other
  misc_feature (806)..(806): n is a, c, g, or t
  modified_base (810)..(810): a, c, t, g, unknown or other
  misc_feature (810)..(810): n is a, c, g, or t
  modified_base (812)..(814): a, c, t, g, unknown or other
  misc_feature (812)..(814): n is a, c, g, or t
tcagtacgctgtctcacgaccggtgctcgatttagtctagcgactttgggttgggggggtccctgagactctcctgtgtagcctctggattcacctttagcaccttattccatgagttgggtccgccaggctccgggggaaggggctgggagtgggtctnaagtgtttagtggtgatggtgactaacacatactacgcaggctccggtggaacgggccgtcttcaccatcctccagacgaacaacttccgagagtccgtacggttgttttctgactaaagtgacgccgacctaggaaacgccggaaggacgaccggccttaatttactacgttggtcgacgagaacgtcgacgaacgagtagggtacgggacgtctacggaacccgtacccgggtcgggggacccgacggggacccctacccggtttccggtacccgtttaccccgttttcccaccgtaccggtcccctaacccgaacccgggtaacccggggtcccctaccggtttccccgggtttccccccgtttcccccggtcgggtcccccgtcccgttacggtcccgtaccggaacgggaccgccccgtaaccccgttaccggaacggaccgacccgaaccgggtccgggtaccccgggtcccggttcggggtacccgttaccggtaccccggttagggtaacccgtaaaccgggttaccctttacccggtaaccgtaacggaaccgttacggttaaccgttacggtacggaccggggtccgggtacgtacgggaaccgggtaacgtccgtaacggtgtaaccggnacgtnagancnnn

SEQ ID NO: 53018 - DNA, 769 bp, Homo sapiens
  misc_feature: GYAE6OF01AONKX.36.26.C04.1.454.CMB.1.raw
  modified_base (197)..(197): a, c, t, g, unknown or other
  misc_feature (197)..(197): n is a, c, g, or t
  modified_base (759)..(759): a, c, t, g, unknown or other
  misc_feature (759)..(759): n is a, c, g, or t
  modified_base (765)..(765): a, c, t, g, unknown or other
  misc_feature (765)..(765): n is a, c, g, or t
tcagtacgctgtctcacgaccggtgctcgatttagtctagcgactttgggtttgggggaggcttggaacagccgggggggtccctgagactctcctgtgtagcctctggattcacctttagcacctattccatgagttgggtccgccaggctccggggaagggctggagtgggtctcaagtgttagtggtgatggtnctaacacatactacgcaggctccggtggaacgggcctcttcacctatcctccagacgactaattccgagacgcctacggttcttttacagactaaaatggacgcccgaccgtaggaaaacggccggaaggaccaccggtacctaattttaacctacgtggtacgacggaagtaacgtcggaccgtaggaacgagggtaggggaactcgttacggaaccctaccggggtacggggcccgtaacggggtacccctaaccccgggtttcgggttacccctttaaccccggttttcccgaccgtaacccgtcccccgtaaccccggaaacccggtaaacccggggtcccccttaacggttaccccggtttccccgtttccccccggtcgggtccccgtccccgttacggccccttacgggacggaccgtaccgtaccccggtacggacgacgaccaaccgaccgggcccggtccgtcgggtaccgtcgtaccgtcgtaaccgtaacgtacctacgtaccgacgacgacgtaccgtagcgacgggcggtcacggaccgacggcgtanagtcgntgcg

SEQ ID NO: 53019 - DNA, 460 bp, Homo sapiens
  misc_feature: GYAE6OF01DBJDD.36.26.C04.1.454.CMB.1.raw
  modified_base (222)..(222): a, c, t, g, unknown or other
  misc_feature (222)..(222): n is a, c, g, or t
  modified_base (253)..(253): a, c, t, g, unknown or other
  misc_feature (253)..(253): n is a, c, g, or t
  modified_base (270)..(270): a, c, t, g, unknown or other
  misc_feature (270)..(270): n is a, c, g, or t
  modified_base (275)..(275): a, c, t, g, unknown or other
  misc_feature (275)..(275): n is a, c, g, or t
  modified_base (289)..(289): a, c, t, g, unknown or other
  misc_feature (289)..(289): n is a, c, g, or t
  modified_base (414)..(414): a, c, t, g, unknown or other
  misc_feature (414)..(414): n is a, c, g, or t
  modified_base (416)..(460): a, c, t, g, unknown or other
  misc_feature (416)..(460): n is a, c, g, or t
tcagtacgctgtctcacgaccggtgctcgatttagtctagcgactttgggtttggggcaggggagtgggctaagggtgacgcaggtggcgccagccaggcgcacacccaatggcccgtgagcccagacactggaccctgcctggaccctcgtggatagacaagaccaaggggcctctgccgccctgggcccagctctcgtcccacaccgcagtcacatggcnccatctctctgcagccttccacgacggcccngtccggtccttcccccnggccncctgcctcgaggcncaccgtgtcggggccacgacggccgtcccgtggccgtcgccgtcggtacgaacggtaccttacgttcccaacgacgacggcgttacgcggacggtcgggcgtacggcgtaacgggcacgtagagncnnnnnnnnnnnnnnnnnnnnnnnnnnnnnnnnnnnnnnnnnnnnn

SEQ ID NO: 53020 - DNA, 518 bp, Homo sapiens
  misc_feature: GYAE6OF02IPE2S.36.26.C04.1.454.CMB.1.raw
  modified_base (516)..(518): a, c, t, g, unknown or other
  misc_feature (516)..(518): n is a, c, g, or t
tcagtacgctgtctcacgaccggtgctcgatttagtctagcgactttgggtttggggaggcttggaacagccggggggtccctgagactctcctgtgtagcctctggattcacctttagcacctattccatgagttgggtccgccaggctccggggaaggggctggagtgggtctcaagtgttagtggtgatggtgctaacacatactacgcaggctccgtgaagggccgcttcaccatctccagagacaattccgagagcacggtgttctgcaaatgagccgcctgaaagccgaggacacggccatttactactgtgcgagaatgcagacagtgggagctgacacctgggccagggcaccctggtcaccgtttcctcagccctccaccaagggcccatcggtcttcccctggcgccctgctccaggagccacctccgagagcacagcggccctgggctgcctggtcaaggactacttccagacagcgtactgagcgggctggcaaggcgcatagnnn

SEQ ID NO: 53021 - DNA, 628 bp, Homo sapiens
  misc_feature: GYAE6OF02FZBA9.36.26.C04.1.454.CMB.1.raw
  modified_base (331)..(331): a, c, t, g, unknown or other
  misc_feature (331)..(331): n is a, c, g, or t
  modified_base (471)..(471): a, c, t, g, unknown or other
  misc_feature (471)..(471): n is a, c, g, or t
  modified_base (502)..(502): a, c, t, g, unknown or other
  misc_feature (502)..(502): n is a, c, g, or t
  modified_base (519)..(519): a, c, t, g, unknown or other
  misc_feature (519)..(519): n is a, c, g, or t
  modified_base (531)..(531): a, c, t, g, unknown or other
  misc_feature (531)..(531): n is a, c, g, or t
  modified_base (626)..(626): a, c, t, g, unknown or other
  misc_feature (626)..(626): n is a, c, g, or t
tcagtacgctgtctcacgaccggtgctcgatttagtctagcgactttgggtttgggggcacgggaggtgggccgggtaaggtgacgcaggtggccgccagccgacggcgcgactaaccctaaagtgcccgtgagcccagacaactgggacccctcgccgtggacccctcggtagggataggacaaggaaccaagggggcctcttgcggccctgggcccgaggctctgtcccactaccgcacgtcaccactggacggcccgtactacctcttccttggcacgactttccaaccaaggcccatcggtcttcccctggccacctgctccacggngcacctcgtcggggcacgacgcggcccttgggtctggtaccgtcggtcgaacggtacgtaacttcccggacgggaccgacgtcgtacctcgagggccgggacggtcggccgtaagggtccgaccgtaacttacgcacgcnccacgaggcccagtcggtctcccctggcccncctcctcacgacgcacncgcggcgacgcncgcgccgcggcgcgcgtcgtacgtaacgtacgtaccgtaccgtacgtactctacgtcgtcgcggcggtcgtcggacgacggacgacgacgtacgngc

SEQ ID NO: 53022 - DNA, 586 bp, Homo sapiens
  misc_feature: GYAE6OF02GUNBI.36.26.C04.1.454.CMB.1.raw
  modified_base (465)..(465): a, c, t, g, unknown or other
  misc_feature (465)..(465): n is a, c, g, or t
  modified_base (486)..(486): a, c, t, g, unknown or other
  misc_feature (486)..(486): n is a, c, g, or t
tcagtacgctgtctcacgaccggtgctcgatttagtctagcgactttgggtttgggggaggcttggaacagccgggggggtccctgagactctcctgtgtagcctctggattcacctttagcacctattccatgagttgggtccgccaggctccggggaaggggctggagtgggtctcaagtgttagtggtgatggtgctaacacatactacgcaggctccgtgaagggccgcttcaccatctccagagacaattccgagagcacggtgtttctgcaaatgaacagtctgagagccgaagacgcggccgtatatcactgtgcgaaattccccgggaggggcagtggctggtactgcgaaggcactttgagtccgtgggccagggaccctggtcaccgtgtcctcacgcctccaccgaacgggcccagtccggtccttccccgtggccgccctgcctccgaggacnccacccgtccgagacgccacncgtccggcccgtgggcctcgccgtggtaccgaacggtccttaccgttccgaacgaccgacggtccgtacgcggacggccgggcgtcgggaccgaaggccg

SEQ ID NO: 53023 - DNA, 373 bp, Homo sapiens
  misc_feature: GYAE6OF02FPIPJ.36.26.C04.1.454.CMB.1.raw
  modified_base (368)..(373): a, c, t, g, unknown or other
  misc_feature (368)..(373): n is a, c, g, or t
tcagtacgctgtctcacgaccggtgctcgatttagtctagcgactttgggtttggggcagggagtgggctaaggtgacgcaggtggcgccagccaggcgcacacccaatgcccgtgagcccagacactggaccctgcctggaccctcgtggatagacaagaaccaaggggcctctgcgccctgggcccagctctgtcccacaccgcagtcacatggcgccatctctcttgcagcttccaccaagggcccatcggtcttccccctggcgccctgctccaggagcacctctgggggcacagcggccctgggctgcctggtcaaggactacttccagacagcgtactgagcgggctggcaaggcgcatagnnnnnn

SEQ ID NO: 53024 - DNA, 544 bp, Homo sapiens
  misc_feature: GYAE6OF02GVST8.36.26.C04.1.454.CMB.1.raw
  modified_base (383)..(383): a, c, t, g, unknown or other
  misc_feature (383)..(383): n is a, c, g, or t
  modified_base (541)..(542): a, c, t, g, unknown or other
  misc_feature (541)..(542): n is a, c, g, or t
  modified_base (544)..(544): a, c, t, g, unknown or other
  misc_feature (544)..(544): n is a, c, g, or t
tcagtacgctgtctcacgaccggtgctcgatttagtctagcgactttgggtttgggggaggcttggaacagccggggggtccctgagactctcctgtgtagcctctggattcacctttagcacctattccatgagttgggtccgccaggctccggggaaggggctggagtgggtctcaagtgttagtggtgatggtgctaacacatactacgcaggctccgtgaagggccgcttcaccatctccagagacaattccgagagcacggtgtttctgcaaatgagccgcctgaaagccgaggacacggccatttactactgtgcgagaatgcagacagtgggagctgacaccgtgggccaggggcacccgtggtccaccgtttccncacgccctccaccaacgggcccatccggtccttccccctggccgccctcgctccaggacgccacctccgagacgccacgacgccggcctcgggctcgcctcggtcaacggacctactccagacagcgtactggagcgggctggcgaaggcgcagtagnngn

SEQ ID NO: 53025 - DNA, 581 bp, Homo sapiens
  misc_feature: GYAE6OF02GLY0B.36.26.C04.1.454.CMB.1.raw
tcagtacgctgtctcacgaccggtgctcgatttagtctagcgactttgggtttgggggaggcttggaacagccgggggggtccctgagactctcctgtgtagcctctggattcacctttagcacctattccatgagttgggtccgccaggctccggggaaggggctggagtgggtctcaagtgttagtggtgatggtgctaacacatactacgcaggctccgtgaagggccgcttcaccatctccagagacaattccgagagcacgctgtatgtgcaaatgaacagcctgagagccgaggacacggctgtgtattactgtgcgagagacgcctctcgctccctatggttcggggagtttaggccacgatggacgtctggggcaaaggggaccacgggtcaccgtctcctcacgcctccaccaacgggcccagtccggtccttccccctcggccaccctcctccaacgacgccacctcgtcggggcacgacgccggcccgtcgggcctcgccgtcggtcgaacgggaccttaccgttcccaacgaccacggccgttacgtcggacggccgggcgtggaccgg

SEQ ID NO: 53026 - DNA, 623 bp, Homo sapiens
  misc_feature: GYAE6OF02IH53S.36.26.C04.1.454.CMB.1.raw
  modified_base (385)..(385): a, c, t, g, unknown or other
  misc_feature (385)..(385): n is a, c, g, or t
  modified_base (617)..(617): a, c, t, g, unknown or other
  misc_feature (617)..(617): n is a, c, g, or t
  modified_base (619)..(619): a, c, t, g, unknown or other
  misc_feature (619)..(619): n is a, c, g, or t
tcagtacgctgtctcacgaccggtgctcgatttagtctagcgactttgggtttgggggaggcttggaacagccggggggtccctgagactctcctgtgtagcctctggattcacctttagcacctattccatgagttgggtccgccaggctccggggaaggggctggagtgggtctcaagtgttagtggtgatggtgctaacacatactacgcaggctccgtgaagggccgcttcaccatctccagagacaattccgagagcacggtgtttctgcaaatgagccgcctgaaagccgaggacacggccatttactactgtgcgagaatgcagacaggtgggagctgacaccgtgggccagggccacccgtggtcaccggttttccncacgccctcccaccgaacgggcccatccggtccttccccgtcggccgcccgtgcctccgacgggacgccaccgtccgagacgccacgacgccggcccgtgggcctcggcccgttcgggtaccaaacgggtaccttaaccgtttcccgaacggtaaccgacgacccggttaccgtacgggaccgggtccggggtcgttacgggaccgtaacggggccggaccgaagtaacggngngacg

SEQ ID NO: 53027 - DNA, 510 bp, Homo sapiens
  misc_feature: GYAE6OF02HF3E8.36.26.C04.1.454.CMB.1.raw
  modified_base (431)..(431): a, c, t, g, unknown or other
  misc_feature (431)..(431): n is a, c, g, or t
  modified_base (478)..(478): a, c, t, g, unknown or other
  misc_feature (478)..(478): n is a, c, g, or t
  modified_base (502)..(510): a, c, t, g, unknown or other
  misc_feature (502)..(510): n is a, c, g, or t
tcagtacgctgtctcacgaccggtgctcgatttagtctagcgactttgggttgggggggtccctgagactctcctgtgtagcctctggattcacctttagcacctattccatgagttgggtccgccaggctccggggaaggggctggagtgggtctcaagtgttagtggtgatggtgctaacacatactacgcaggctccgtgaagggccgcttcaccatctccagagacaattccgagagcacggtgtttctgcaaatgagccgcctgaaagccgaggacacggccatttactactgtgcgagaatgcagacagtgggagctgacacctggggccaggggcaccctggtcaccgtttcctcagcctccaccaagggcccatcggtcttccccctggcgccctgctccaggacgcacctccgagacgcacngcggccctgggctgcctggtcaaggacctacttccagacagcgtacngagcgggctggcaaggcgcatagnnnnnnnnn

SEQ ID NO: 53028 - DNA, 374 bp, Homo sapiens
  misc_feature: GYAE6OF02HHIGD.36.26.C04.1.454.CMB.1.raw
  modified_base (367)..(374): a, c, t, g, unknown or other
  misc_feature (367)..(374): n is a, c, g, or t
tcagtacgctgtctcacgaccggtgctcgatttagtctagcgactttgggtttggggcagggagtgggctaaggtgacgcaggtggcgccagccaggcgcacacccaatgcccgtgagcccagacactggaccctgcctggaccctcgtggatagacaagaaccaaggggcctctgcgccctgggcccagctctgtcccacaccgcagtcacatggcgccatctctcttgcagcttccaccaagggcccatcggtcttccccctggcgccctgctccaggagcacctctgggggcacagcggccctgggctgcctggtcaaggactacttccagacagctactgagcgggctggcaaggcgcatagnnnnnnnn

SEQ ID NO: 53029 - DNA, 583 bp, Homo sapiens
  misc_feature: GYAE6OF02JGQRP.36.26.C04.1.454.CMB.1.raw
  modified_base (573)..(573): a, c, t, g, unknown or other
  misc_feature (573)..(573): n is a, c, g, or t
  modified_base (582)..(582): a, c, t, g, unknown or other
  misc_feature (582)..(582): n is a, c, g, or t
tcagtacgctgtctcacgaccggtgctcgatttagtctagcgactttgggttgggggggtcccgtgagactctcctgtgtagcctctggattcacctttagcacctattccatgagttgggtccgccaggctccggggaagggctggagtgggtctcaagtgttagtggtgatggtgctaacacatactacgcaggctccgtgaagggccgcttcaccatctccagagacaattccgagagcacggtgtttctgcaaatgagccgcctgaaagccgaggacacggccttatattaactgtgcgaaatattctgacgtcgtagcacctcgcccctaattttgactactggggtccagggaaccctggtcaccgttctcctccagccctccaccaagggcccatcggtccttcccctggcgccctgctccaggacgcaccgttccgagtacgcacgtacgccggcccgtggggctcgccgtcggtaccaagggaccttaccgtttccgacggtaccgaacggtccgtacgtcggacggccggggcgtcgggacaacgggccgtacacgtacgacncgtgcagcnc

SEQ ID NO: 53030 - DNA, 590 bp, Homo sapiens
  misc_feature: GYAE6OF02HLIG8.36.26.C04.1.454.CMB.1.raw
  modified_base (468)..(468): a, c, t, g, unknown or other
  misc_feature (468)..(468): n is a, c, g, or t
  modified_base (587)..(588): a, c, t, g, unknown or other
  misc_feature (587)..(588): n is a, c, g, or t
tcagtacgctgtctcacgaccggtgctcgatttagtctagcgactttgggtttgggggaggcttggaacagccgggggggtccctgagactctcctgtgtagcctctggattcacctttagcacctattccatgagttgggtccgccaggctccggggaaggggctggagtgggtctcaagtgttagtggtgatggtgctaacacatactacgcaggctccgtgaagggccgcttcaccatcctccagagacaattccgagagcacggttgtttctgcaaatgagccgcctagaaagccgaggacacggcctatttacactgtgcgagaatgcagacaggtgggagcgtagaccacgtcggggaccacggggccacccgtgggtacctacccggttttcctcacgccctacccgaccgaacgggcccagtccgtccttccccgtcggccgccctcgcctccacggacnccgacctccgagacgcacgacgccggccgtggcctcgccgtgtcgaaacggtacctacttccgagacgacgcgtacgtcggacggccgggtacgtcgggacgacggccgactaggacgnncg

SEQ ID NO: 53031 - DNA, 679 bp, Homo sapiens
  misc_feature: GYAE6OF02J1NHM.36.26.C04.1.454.CMB.1.raw
  modified_base (366)..(366): a, c, t, g, unknown or other
  misc_feature (366)..(366): n is a, c, g, or t
  modified_base (676)..(676): a, c, t, g, unknown or other
  misc_feature (676)..(676): n is a, c, g, or t
tcagtacgctgtctcacgaccggtgctcgatttagtctagcgactttgggttgggggtccgtgagactctcctgtgtagcctctggattcacctttagcacctattccatgagttgggtccgccaggctccggggaaggggctggagtgggtctcaagtgttagtggtgatggtgctaacacatactacgcaggctccgtgaagggccgcttcaccatctccagagacaattccgagagcacggtgtttctgcaaatgacgccgcctgaaagccgaggacacggccatttactactgtgcgagaatgcagacaggtgggagctgacaccgtggggccaggggcaccctgggctacccggtttcctnacgtccctccgaccgaaacgggccccaatccgggttcccttccccccgtggggcccctccccgttcggacccttcccgaacgggtcggtacccgacccttcccgggaacgtacggcccacgacggtccccgggccccgtcggggtccctcgggcccttacgggtccggaaaacgggccctttaccgttaccccgaaaggacccgtaaggtcccgttaaccgtagggacgggtacccggggccgttacgggaacccgggaaacggggcccgtacccgtaaagttaccgggacgtcgcgacgcgtttgtcgngcg

SEQ ID NO: 53032 - DNA, 508 bp, Homo sapiens
  misc_feature: GYAE6OF02FW2DQ.36.26.C04.1.454.CMB.1.raw
  modified_base (400)..(400): a, c, t, g, unknown or other
  misc_feature (400)..(400): n is a, c, g, or t
  modified_base (495)..(495): a, c, t, g, unknown or other
  misc_feature (495)..(495): n is a, c, g, or t
  modified_base (502)..(508): a, c, t, g, unknown or other
  misc_feature (502)..(508): n is a, c, g, or t
tcagtacgctgtctcacgaccggtgctcgatttagtctagcgactttgggtttgggggtccctgagactctcctgtgtagcctctggattcacctttagcacctattccatgagttgggtccgccaggctccggggaaggggctggagtgggtctcaagtgttagtggtgatggtgctaacacatactacgcaggctccgtgaagggccgcttcaccatctccagagacaattccgagagcacggtgtttctgcaaatgagccgcctgaaagccgaggacacggccatttactactgtgcgagaatgcagacagtgggagctgacacctggggccaggggcaccctggtcaccgtttcctcagcctccaccaagggccccatcggtcttccccctggccnccctgctccaggagcacctccgagagcacagcggccctgggctgcctggtcaaggactacttccagacagcgtactgagcgggctggcaagggcncatacgnnnnnnn

SEQ ID NO: 53033 - DNA, 590 bp, Homo sapiens
  misc_feature: GYAE6OF02HNWOY.36.26.C04.1.454.CMB.1.raw
  modified_base (580)..(581): a, c, t, g, unknown or other
  misc_feature (580)..(581): n is a, c, g, or t
  modified_base (584)..(586): a, c, t, g, unknown or other
  misc_feature (584)..(586): n is a, c, g, or t
  modified_base (589)..(590): a, c, t, g, unknown or other
  misc_feature (589)..(590): n is a, c, g, or t
tcagtacgctgtctcacgaccggtgctcgatttagtctagcgactttgggtttgggggtccctgagactctcctgtgtagcctctggattcacctttagcacctattccatgagttggtccgccaggctccggggaaggggctggagtgggtctcaagtgttagtggtgatggtgctaacacatactacgcaggctccgtgaagggccgcttcaccatctccagagacaattccgagagcacggtgtttctgcaaatgagccgcctgaaagccgaggacacggccatttactactgtgcgagaatgcagacaggtgggagctgaccaccgtgggccagggcacctggtcacccgtttcctcacgccctcccaccgaacgggccccacgttccggttcccttccccccgtgggcccgtcccctgcccttccgaagggacgccctaacccgtcccgaaggacgaccgaacgacggcccggccccgtacgggctacgggcctcgggaccaacggaccttacgttacccagaccgtcgaccggttactggacggcggacgtggacggtaacgggcgcgataggnncannncgnn

SEQ ID NO: 53034 - DNA, 642 bp, Homo sapiens
  misc_feature: GYAE6OF02HFRMU.36.26.C04.1.454.CMB.1.raw
  modified_base (127)..(127): a, c, t, g, unknown or other
  misc_feature (127)..(127): n is a, c, g, or t
  modified_base (621)..(621): a, c, t, g, unknown or other
  misc_feature (621)..(621): n is a, c, g, or t
  modified_base (626)..(626): a, c, t, g, unknown or other
  misc_feature (626)..(626): n is a, c, g, or t
  modified_base (628)..(628): a, c, t, g, unknown or other
  misc_feature (628)..(628): n is a, c, g, or t
  modified_base (631)..(631): a, c, t, g, unknown or other
  misc_feature (631)..(631): n is a, c, g, or t
  modified_base (637)..(637): a, c, t, g, unknown or other
  misc_feature (637)..(637): n is a, c, g, or t
  modified_base (640)..(640): a, c, t, g, unknown or other
  misc_feature (640)..(640): n is a, c, g, or t
tcagtacgctgtctcacgaccggtgctcgatttagtctagcgactttgggttggggggggtccctgagacgtctcctgtcgtagcctctggattcacctttagtcacctattccatgagttggtccnccaggctccggggaaggggctggagtgggtctctaaggtgttagtggtgtagttggtgctaacactatactacgcaggctccgtgagggccgcttcaccatctccgaggagacaattcccgagacgcgacggttcgtttctgcaaatggacgccgcctgaaaggccgtaggactacggcctatttactactgtgcgagagtcgcagacaggtggagctgacgtaccggtggggccaggggtctaccgtggtactaccgttcgcgacgcctaccaaccgacgggccctaagtccggttcccttcccccgtaggaccctaccccgtaccctacccaacggacgcctacccgtcggtacggggacctaacgtaccggaccggtacccgttacgggccttcgtccgttcggtaccgaacggtaccgtaccgttaccgacgaccgtacggtaccgtacgtcgacggccgggtacgtcggacgaaggcgtcgtagtacgngtcgngncgngtgcgngtnag

SEQ ID NO: 53035 - DNA, 610 bp, Homo sapiens
  misc_feature: GYAE6OF02F771V.36.26.C04.1.454.CMB.1.raw
  modified_base (607)..(608): a, c, t, g, unknown or other
  misc_feature (607)..(608): n is a, c, g, or t
tcagtacgctgtctcacgaccggtgctcgatttagtctagcgactttgggtttgggggaggcttggaacagccgggggggtccctgagactctcctgtgtagcctctggattcacctttagcacctattccatgagttgggtccgccaggctccggggaaggggctggagtgggtctcaagtgttagtggtgatggtgctaacacatactacgcaggctccgtgaagggccgcttcaccatctccagagacaattccgagagcacggtgtttctgcaaatgagccgctgaaagccgaggacacggccatttactactgtgcgagaatgcagacagtgggagctgacaccgtgggccagggccacccgtggtcctacccggtttcctcacgccctacccacccgaacgggcccaacgtccggttccctttcccccgtcggcccgcccgtcgcctaccgacgggacgccacccgtccgacggacgccaccgacggccggcccgtcgggccgtcgcccgtggtacgaacgggtaactaccgttccacgacgacggtaccgtacgtcggacggccggggtcgtcgggacgtacgggacgaccgagtaggcnncg

SEQ ID NO: 53036 - DNA, 610 bp, Homo sapiens
  misc_feature: GYAE6OF02JFYG4.36.26.C04.1.454.CMB.1.raw
  modified_base (232)..(232): a, c, t, g, unknown or other
  misc_feature (232)..(232): n is a, c, g, or t
  modified_base (274)..(274): a, c, t, g, unknown or other
  misc_feature (274)..(274): n is a, c, g, or t
  modified_base (347)..(347): a, c, t, g, unknown or other
  misc_feature (347)..(347): n is a, c, g, or t
  modified_base (392)..(392): a, c, t, g, unknown or other
  misc_feature (392)..(392): n is a, c, g, or t
tcagtacgctgtctcacgaccggtgctcgatttagtctagcgactttgggtttgggggaggcttggaacagccgggggggtccctgagactctcctgtgtagcctctggattcacctttagcacctattccatgagttgggtccgccaggctccggggaaggggctggagtgggtctcaagtgttagtggtgatggtgctaacacatactacgcaggctccgtgaagggccncttcaccatctccagagacaattccgagagcacggtgtttcngcaaatgagccgctagaaacgccgaggacacggtccatttacgactgtcgacgagaatgcagacaggtggganctagacaccgtgggccaggggccacccgtggtccaccgtttcctnacgccctccgacgacgggcccagtccgtacccttcccgtggcccgccctgcctaccgaggccgcctaccgtccgagtacgacctacacggcccgggtcctcggtacctcgccgtacgggtaccaacgggtaccttaccgtacccgaagtccacggccgttaacggtggaacggtccgggtactacgggaccgaacggtccgagaccgtaagccgagcg

SEQ ID NO: 53037 - DNA, 559 bp, Homo sapiens
  misc_feature: GYAE6OF02JJX7L.36.26.C04.1.454.CMB.1.raw
  modified_base (252)..(252): a, c, t, g, unknown or other
  misc_feature (252)..(252): n is a, c, g, or t
  modified_base (364)..(364): a, c, t, g, unknown or other
  misc_feature (364)..(364): n is a, c, g, or t
  modified_base (549)..(549): a, c, t, g, unknown or other
  misc_feature (549)..(549): n is a, c, g, or t
  modified_base (552)..(553): a, c, t, g, unknown or other
  misc_feature (552)..(553): n is a, c, g, or t
  modified_base (555)..(555): a, c, t, g, unknown or other
  misc_feature (555)..(555): n is a, c, g, or t
  modified_base (559)..(559): a, c, t, g, unknown or other
  misc_feature (559)..(559): n is a, c, g, or t
tcagtacgctgtctcacgaccggtgctcgatttagtctagcgactttgggtttgggggtccctgagactctcctgtgtagcctctggattcacctttagcacctattccatgagttgggtccgccaggctccggggaaggggctggagtgggtctcaagtgttagtggtgatggtgctaacacatactacgcaggctccgtgaagggccgcttcaccatctccagagacaattccgagagcacggtgtttcngcaaatgagccgcctgaaagccgaggacacggccatttactactgtgcgagaatgcagacaggtgggagctgacaccgtggggccagggccacccgtggtccaccgtttccncacgcctccaccgaacgggcccatccggtccttcccccgtggccgccctcgcctccgaggacgccacccgtcgacgacgccacacggccggacccgtggggcctcgccgtacggtcaacggtccttacctccgaagaccagccgtacgtaggcgccgggctacggcgaacggcgacgagtgcacngcnngnacgn

SEQ ID NO: 53038 - DNA, 542 bp, Homo sapiens
  misc_feature: GYAE6OF02IFXLY.36.26.C04.1.454.CMB.1.raw
  modified_base (437)..(437): a, c, t, g, unknown or other
  misc_feature (437)..(437): n is a, c, g, or t
  modified_base (534)..(542): a, c, t, g, unknown or other
  misc_feature (534)..(542): n is a, c, g, or t
tcagtacgctgtctcacgaccggtgctcgatttagtctagcgactttgggtttgggggtccctgagactctcctgtgtagcctctggattcacctttagcacctattccatgagttgggtccgccaggctccggggaaggggctggagtgggtctcaagtgttagtggtgatggtgctaacacatactacgcaggctccgtgaagggccgcttcaccatctccagagacaattccgagagcacggtgtttctgcaaatgagccgcctgaaagccgaggacacggccatttactactgtgcgagaatgcagacagtgggagctgacactgggccagggcaccctggtcacccgttcctcacgcctccaccaacgggcccatcggtcttccccctggccgccctgcctccgacggacgccacccgtccgacgagccacncgccgggcccctggggcctgccctgggtccgaaaggaccttaccttccgagacagccgtactgaggcgggcgtcgggcgaacgggccgacgagtagnnnnnnnnn

SEQ ID NO: 53039 - DNA, 640 bp, Homo sapiens
  misc_feature: GYAE6OF02H4J41.36.26.C04.1.454.CMB.1.raw
  modified_base (273)..(273): a, c, t, g, unknown or other
  misc_feature (273)..(273): n is a, c, g, or t
  modified_base (638)..(638): a, c, t, g, unknown or other
  misc_feature (638)..(638): n is a, c, g, or t
tcagtacgctgtctcacgaccggtgctcgatttagtctagcgactttgggtttgggggaggcttggaacagccgggggggtccctgagactctcctgtgtagcctctggattcacctttagcacctattccatgagttgggtccgcaggctccggggaaggggctggagtgggtctcaagtgttagtggtgatggtgctaacacatactacgcaggctcgtgaagggccgcttcaccatctccagagacaattccgagagcacggttgtttcngacaaatgagccgctagaagccgaaggacacggaccctatttacctaacgtgtagcgaagtaatcgcagacgaggtgggagcgtgaaccgaccggtcggggacccgaggggtacctacccggttggtcccgtacccgttttccaccgacgtcccctacccgaccggaacgggcccctagtcccggttcccgttcccccgtcggcccgccccgtcgccgtaccgacggacgaccacccgtccgacgtacgaccacgacgccggtccgtcggctcgccgtacgtacgaacgtacctactaccgagaccgtacgaccgtacgtcgggacgtccgggacgtacggaccgacggccgacgtagtacgcgngc

SEQ ID NO: 53040 - DNA, 822 bp, Homo sapiens
  misc_feature: GYAE6OF02JT22T.36.26.C04.1.454.CMB.1.raw
tcagtacgctgtctcacgaccggtgctcgatttagtctagcgactttgggttgggggggggtccctgagactctcctgtgtagcctctggattcacctttagcacctattccatggaggttgggtccgccaggctccgggggaaggggctgggagtgggtctcaagtgttagtggtgagtggtgctaacacattactacgcaggtctccggtgaagggccgtcttcaccatcctaccagagactaattccaaagaaccaccctgtcctctgacaaatgaaccaactgagacgccggaggacaccggacctatacttactgtaacgaaatcggacctacggattagtcgtaactacgtagttcggggacttagggttaccttgtacttccgtacggtcgggggtacccgtcggtacctaacccgtttgggtacctaaccgttcggttacccttccgtaccgtaccgtaccccgttaccccgaaaccgggaccggggtacccctacggtttaccccggtttcccccgtttaccccccggtcggggtcccccgtacccccgttacggtaccccgttaaccgggaacgggtacccgtaccccggtaccccggttaccgggaacgtaccggtacccgtaaccgtaccggggccccgggtcccggttccggggccgttacccggttacccgggttacgggtaaccgtaaacgggttaacccttaaccggttcccgaaggtaacccggtcggtaaccggtaccggtacgggtaccgggtcgggaccgttagggacccggttacgggccaacggttcgaacgtgccgtag

SEQ ID NO: 53041 - DNA, 471 bp, Homo sapiens
  misc_feature: GYAE6OF02GD7ZP.36.26.C04.1.454.CMB.1.raw
  modified_base (204)..(204): a, c, t, g, unknown or other
  misc_feature (204)..(204): n is a, c, g, or t
  modified_base (221)..(221): a, c, t, g, unknown or other
  misc_feature (221)..(221): n is a, c, g, or t
  modified_base (418)..(418): a, c, t, g, unknown or other
  misc_feature (418)..(418): n is a, c, g, or t
  modified_base (420)..(420): a, c, t, g, unknown or other
  misc_feature (420)..(420): n is a, c, g, or t
  modified_base (422)..(424): a, c, t, g, unknown or other
  misc_feature (422)..(424): n is a, c, g, or t
  modified_base (426)..(427): a, c, t, g, unknown or other
  misc_feature (426)..(427): n is a, c, g, or t
  modified_base (429)..(471): a, c, t, g, unknown or other
  misc_feature (429)..(471): n is a, c, g, or t
tcagtacgctgtctcacgaccggtgctcgatttagtctagcgacttttgggtttgggggcagggagtgggctaaggtgacgcaggtggcgccagccaggcgcacacccaatgcccgtgagcccagacactggaccctgcctggaccctcgtggatagacaagaaccaaggggcctactgcgccctgggcccagctctgtcccanaccgcagtcacatggcnccgatctctcttgcagcttccaccgaagggccccatcggtcttcccctggccgccctgctccaggacgccacctcgtcgggggcacgtaggccggcccgtgggcctcggcccttcggtacgaaacgggacttaaccgttccgaagacaaggccgtaaccgtgaggccgggactgggacaaaggtcgacaagtacggnanannnannannnnnnnnnnnnnnnnnnnnnnnnnnnnnnnnnnnnnnnnnnn

SEQ ID NO: 53042 - DNA, 629 bp, Homo sapiens
  misc_feature: GYAE6OF02F8IDO.36.26.C04.1.454.CMB.1.raw
  modified_base (231)..(231): a, c, t, g, unknown or other
  misc_feature (231)..(231): n is a, c, g, or t
  modified_base (363)..(363): a, c, t, g, unknown or other
  misc_feature (363)..(363): n is a, c, g, or t
  modified_base (416)..(416): a, c, t, g, unknown or other
  misc_feature (416)..(416): n is a, c, g, or t
  modified_base (443)..(443): a, c, t, g, unknown or other
  misc_feature (443)..(443): n is a, c, g, or t
  modified_base (476)..(476): a, c, t, g, unknown or other
  misc_feature (476)..(476): n is a, c, g, or t
  modified_base (576)..(576): a, c, t, g, unknown or other
  misc_feature (576)..(576): n is a, c, g, or t
  modified_base (625)..(626): a, c, t, g, unknown or other
  misc_feature (625)..(626): n is a, c, g, or t
tcagtacgctgtctcacgaccggtgctcgatttagtctagcgactttgggtttgggggaggcttggaacagccggggggtccctgagactctcctgtgtagcctctggattcacctttagcacctattccatgagttgggtccgccaggctccggggaagggctggagtgggtctcaagtgttagtggtgatggtgctaacacatactacgcaggctccggtgaagggccncttcaccatcctccagacgacaacttccgaagagccacggttgtttctgacaaatgacgccgcctagaaacggccgaaggacaccggcctatttactacgtgtgacgaagaatgacaagacgaggtgggacnctcgaaccaccggtggggaccacggggccacccggtggtacctaccgtttccncgacgccctaccgaccgaacggtcccncgtccgttcccttccccgcggcccgtcccgtcnccgtacccgacggtaccgcctaccgtccggagacgccacgacggcccggccgtggacctcggccgttcggtacggaacgtacctaccttccgagtaaccngtacgttacgcggtacggcggtacgtcggacgacggcgacgtaggacgnngac

SEQ ID NO: 53043 - DNA, 607 bp, Homo sapiens
  misc_feature: GYAE6OF02HN3WV.36.26.C04.1.454.CMB.1.raw
  modified_base (283)..(283): a, c, t, g, unknown or other
  misc_feature (283)..(283): n is a, c, g, or t
  modified_base (331)..(331): a, c, t, g, unknown or other
  misc_feature (331)..(331): n is a, c, g, or t
  modified_base (401)..(401): a, c, t, g, unknown or other
  misc_feature (401)..(401): n is a, c, g, or t
  modified_base (446)..(446): a, c, t, g, unknown or other
  misc_feature (446)..(446): n is a, c, g, or t
  modified_base (451)..(451): a, c, t, g, unknown or other
  misc_feature (451)..(451): n is a, c, g, or t
  modified_base (549)..(549): a, c, t, g, unknown or other
  misc_feature (549)..(549): n is a, c, g, or t
tcagtacgctgtctcacgaccggtgctcgatttagtctagcgactttgggtttgggggaggcttggaacagccgggggggtccctgagactctcctgtgtagcctctggattcacctttagcacctattccatgagttgggtccgccaggctccggggaaggggctggagtgggtctcaagtgttagtggtgatggtgctaacacatactacgcaggctccggtgagggccgcttcaccattcctccagacgacaaacgttccgagagcctacggttgtttcngctaaatgagccgcctagaacgcgagaccacggccatttacactgtgngagatgcagacaggtggacgctaggaccaccgtggggccacggggcctaccgtcggtaccctcgtttccncacgtccctacccaccgaacggccctagtccgtccctttccccgnggccncccgtcgccgtaccgacggtacgaccgaccgtccgagaaccgccgacaccggccggcccgttgggtctccgtgtaccacggttcctaactccgagacncgtacgtacgtggcggaccggtgtaccgggcgagggtccgacgtacgtaacgcagtgc

SEQ ID NO: 53044 - DNA, 636 bp, Homo sapiens
  misc_feature: GYAE6OF02I23G2.36.26.C04.1.454.CMB.1.raw
  modified_base (454)..(454): a, c, t, g, unknown or other
  misc_feature (454)..(454): n is a, c, g, or t
  modified_base (458)..(458): a, c, t, g, unknown or other
  misc_feature (458)..(458): n is a, c, g, or t
  modified_base (464)..(464): a, c, t, g, unknown or other
  misc_feature (464)..(464): n is a, c, g, or t
  modified_base (476)..(476): a, c, t, g, unknown or other
  misc_feature (476)..(476): n is a, c, g, or t
  modified_base (631)..(632): a, c, t, g, unknown or other
  misc_feature (631)..(632): n is a, c, g, or t
tcagtacgctgtctcacgaccggtgctcgatttagtctagcgactttgggtttgggggaggcttggaacagccgggggggtccctgagactctcctgtgtagcctctggattcacctttagcacctattccatgagttgggtccgccaggctccggggaagggctggagtgggtctcaagtgttagtggtgatggtgctaacacatactacgcaggctccggtgaagggcctcttcaccatcctccgagagaacaacttccgagagcgtacggttgtttctagacaaatggacgcccgcctagaaacgcccgaggaccgacggtcctaatttacgacgtggtgcgagaatgcagacgaggtggatcgagaccaccggtcgggaccgagggcctaccgtcggtaccctaccgtttcacacgtccctaccgacgacggcctagtccgtcctcccgngccnccgtcncctcgacggacnccaccgtcgacgacgacaccgacggcccggaccgtcgggtcctccggcgttacggtaccgaacggttaccttaccgtaccgaacgtaccgaggtaccgtagcggaaccgggtcggtacccgggttaggaccgtaacgggccgtacgtaagacgtnntacg

SEQ ID NO: 53045 - DNA, 748 bp, Homo sapiens
  misc_feature: GYAE6OF02GMKTR.36.26.C04.1.454.CMB.1.raw
  modified_base (261)..(261): a, c, t, g, unknown or other
  misc_feature (261)..(261): n is a, c, g, or t
  modified_base (732)..(732): a, c, t, g, unknown or other
  misc_feature (732)..(732): n is a, c, g, or t
  modified_base (737)..(737): a, c, t, g, unknown or other
  misc_feature (737)..(737): n is a, c, g, or t
  modified_base (739)..(739): a, c, t, g, unknown or other
  misc_feature (739)..(739): n is a, c, g, or t
  modified_base (741)..(741): a, c, t, g, unknown or other
  misc_feature (741)..(741): n is a, c, g, or t
  modified_base (743)..(743): a, c, t, g, unknown or other
  misc_feature (743)..(743): n is a, c, g, or t
  modified_base (745)..(745): a, c, t, g, unknown or other
  misc_feature (745)..(745): n is a, c, g, or t
  modified_base (747)..(747): a, c, t, g, unknown or other
  misc_feature (747)..(747): n is a, c, g, or t
tcagtacgctgtctcacgaccggtgctcgatttagtctagcgactttgggttggggggggtccctgagactctcctgtgtagcctctggattcacctttagcacctattccatgagttgggtccgccaggctccggggaaggggctggagtgggtctcaagtgttagtggtgatggtgctaaacacatactacgcaggctccgtgaagggccgcttcaccatctcagagacaattccgagagcacggttgttctgacaaangagccgctagaacgcgaggacacgcctatttacacgtgtgcgaagaatgacaagacgaggtggggacgtctacggaaccgtacccggtagggggaccccaagggggacccctaccccggtttagggtacccctttaaccccggtttccctacgtaacccggccccttaaccccgaaaccggaaaccggggtcccctaaacggttccccggttcccctttaccccccggtacggggccccgcccccgtttcgcccgttaccggtaaacggggacctaaccccgtacccgtaccgaaacgaccgggaacccaaccggtcccggacccgggtcccccggttaggggtaccctccgggtacccgttacggggtaaccaaacgggttaaccctacgtttaccgacggtaaccgacgttaccggtaacgtcgggaacggcggtacgtacgggaacgaacgggtccgactaacgtagngtacngngntnangng

SEQ ID NO: 53046 - DNA, 814 bp, Homo sapiens
  misc_feature: GYAE6OF02HDY0E.36.26.C04.1.454.CMB.1.raw
  modified_base (256)..(256): a, c, t, g, unknown or other
  misc_feature (256)..(256): n is a, c, g, or t
  modified_base (798)..(798): a, c, t, g, unknown or other
  misc_feature (798)..(798): n is a, c, g, or t
  modified_base (806)..(806): a, c, t, g, unknown or other
  misc_feature (806)..(806): n is a, c, g, or t
  modified_base (808)..(808): a, c, t, g, unknown or other
  misc_feature (808)..(808): n is a, c, g, or t
  modified_base (811)..(811): a, c, t, g, unknown or other
  misc_feature (811)..(811): n is a, c, g, or t
  modified_base (813)..(814): a, c, t, g, unknown or other
  misc_feature (813)..(814): n is a, c, g, or t
tcagtacgctgtctcacgaccggtgctcgatttagtctagcgactttgggttgggggggggtccctgagactctcctgtgtagcctctggattcacctttagcacctattccatgaggttgggtccgccaggctccggggaaggggctggagtgggtctcaagtgttagtggtgatggtgctaacacatactacgcaggctccgtgaagggccgcttcaccatctccagagacaattccgagagcacggtgtttcngacaaatggagcccgcctaggaaacgccgaaggacgacggcctaatttacactgtgcggaagaaagtcgacagaacgaggtaggggacgcgtgaaccgaccgtagggggccaacggggcctaccccgtggttcccgtaacccgtttccctaccgaccggtacccttacccccggaaaccgaaaccggggcccccctaaaggtttccccgggtttaccccttttaccccccccggtaggggtccccccggtaccccccgtcggtaaccccgttaccccgggaaggggtaacccacccccgtaaaccggtaccccggaacggaccgtacccgaaacccggtaaccgggccccggggtaccccggttcggggccccgtttccgggaaccccgtttaccggggtaacccgtaaaacgggggtaaccctttaaacccgtttacccggaaaggtaaccctacccgggttaaaccgggtttacgttaacggaaggggttccccggggaggttccgggaaccgtacgggaccggtacgaacggttaacgngtactcgnancgngnn

SEQ ID NO: 53047 - DNA, 450 bp, Homo sapiens
  misc_feature: GYAE6OF02IYRH4.36.26.C04.1.454.CMB.1.raw
  modified_base (314)..(314): a, c, t, g, unknown or other
  misc_feature (314)..(314): n is a, c, g, or t
  modified_base (392)..(392): a, c, t, g, unknown or other
  misc_feature (392)..(392): n is a, c, g, or t
  modified_base (403)..(403): a, c, t, g, unknown or other
  misc_feature (403)..(403): n is a, c, g, or t
  modified_base (419)..(419): a, c, t, g, unknown or other
  misc_feature (419)..(419): n is a, c, g, or t
  modified_base (422)..(422): a, c, t, g, unknown or other
  misc_feature (422)..(422): n is a, c, g, or t
  modified_base (425)..(450): a, c, t, g, unknown or other
  misc_feature (425)..(450): n is a, c, g, or t
tcagtacgctgtctcacgaccggtgctcgatttagtctagcgactttgggtttgggggcagggagtgggctaaggtgacgcaggtggcgccagccaggcgcacacccaatgcccgtgagcccagacactggaccctgcctggaccctcgtggatagacaagaaccaaggggcctctgcgccctgggcccagcctctcgtcccacaccgcagtcacatggccgaccatctccttcttgcagtccttaccaccgtaacgggcccagttcccggtcctttcccccgtgggccgtcccctacgcccttaccaggtacnccaccgtcggtggggccacgacggccggcccgtgggcctcgccgtggtacgaacggtacctactcagacagtcctagngacgcggtcgngacgaaggcacgatgnagnacnnnnnnnnnnnnnnnnnnnnnnnnnn

SEQ ID NO: 53048 - DNA, 581 bp, Homo sapiens
  misc_feature: GYAE6OF02HYWCI.36.26.C04.1.454.CMB.1.raw
  modified_base (382)..(382): a, c, t, g, unknown or other
  misc_feature (382)..(382): n is a, c, g, or t
  modified_base (577)..(577): a, c, t, g, unknown or other
  misc_feature (577)..(577): n is a, c, g, or t
  modified_base (579)..(579): a, c, t, g, unknown or other
  misc_feature (579)..(579): n is a, c, g, or t
tcagtacgctgtctcacgaccggtgctcgatttagtctagcgactttgggtttgggggaggcttggaacagccgggggggtccctgagactctcctgtgtagcctctggattcacctttagcacctattccatgagttgggtccgccaggctccggggaaggggctggagtgggtctcaagtgttagtggtgatggtgctaacacatactacgcaggctccgtgaagggccgcttcaccatctccagagacaattccgagagcacggtgttctgcaaatgagccgcctgaaagccgaggcacggccatttactactgtgcgagaatgcagacaggtgggagctggaccaccgtgggccagggccacccgtggcaccgtttcncacgccctcccacacgggccctagtccggtcccttcccccgtcggccgtccctgccgtcccgaggacgccacccgtccgagacgaccacgacgccggccgttgggttcgccgtcggtacaacggtaccttacttccacgacacgtactacgtggacggtccgggcgtggacgacgggccgacgaacgtagacgtnancg

SEQ ID NO: 53049 - DNA, 888 bp, Homo sapiens
  misc_feature: GYAE6OF02H6P2K.36.26.C04.1.454.CMB.1.raw
  modified_base (884)..(884): a, c, t, g, unknown or other
  misc_feature (884)..(884): n is a, c, g, or t
  modified_base (886)..(886): a, c, t, g, unknown or other
  misc_feature (886)..(886): n is a, c, g, or t
tcagtacgctgtctcacgaccggtgctcgatttagtctagcgactttgggttgggggggggtccctgagactctcctgtgtagcctctggattcacctttagcacctattccatgagttgggtccgccaggctccggggaaggggctggagtgggtctcaagtgttagtggtgatggtgctaacacatactacgcaggctccgtgaagggccgcttcaccatctccagagactaacgttcccggagacgccgaacggttcgttttacgtcgacaaaagtggacggcccgtaccgttaaggaaacggcccgggtaaacgggaacccgaccgggtaaccctttaaacgtttttaaccgtaccgttagggttacggaaccggtaaggtaaacgtttacggaccgtaaacggaaccgtaaggggtttcggggaaacggtcgtaacggaccgtaaccccggggttcgggggaacccggaaccgggggtaccctaccccggtacggggttaccccttaaccccgggttttccgttaccgaacccggtacccctttaaccccgaaacccgggtaaaccgggtcccccgtaacggtttaccccggggttacccctttccccccggtcggggtccccggtaccccgttccggtacccgtacccggacgggtaccggtacccgtaccccgttaaccggaacgtaaccggtccaaccggtaaccgggcccggtcccggtacgggtcccgtcggtaccgttacgggtaaccgtaacggtaaccgttaccgttaaccgaacggtaccggtaaccgtaccgttaacggtacggtccgggtacggggcggttacggaccggaacgggccgtacgtaaggtcgtaagcgtgacctggacngnga

SEQ ID NO: 53050 - DNA, 526 bp, Homo sapiens
  misc_feature: GYAE6OF02GPEDO.36.26.C04.1.454.CMB.1.raw
  modified_base (225)..(225): a, c, t, g, unknown or other
  misc_feature (225)..(225): n is a, c, g, or t
  modified_base (477)..(477): a, c, t, g, unknown or other
  misc_feature (477)..(477): n is a, c, g, or t
  modified_base (480)..(480): a, c, t, g, unknown or other
  misc_feature (480)..(480): n is a, c, g, or t
  modified_base (485)..(492): a, c, t, g, unknown or other
  misc_feature (485)..(492): n is a, c, g, or t
  modified_base (495)..(526): a, c, t, g, unknown or other
  misc_feature (495)..(526): n is a, c, g, or t
tcagtacgctgtctcacgaccggtgctcgatttagtctagcgacttttgggtttggggcagggagtgggctaaggtgacgcaggtggcgccagccaggcgcacacccaatgcccgtgagcccagacactggaccctgcctggaccctcgtggatagacaaagaaccaaggggcctctgccgccctcgggcccagctctcgtccccacacccgcagtcacatggcnccatcctctcttgcacgccttacccaccgaacgggcccacgttcccggttcccttccccccgtcgggcccgtcccccgtgtccctccgagggaccgccctaccgtcggtcggggggccaacgacggcccggcccgtcgggccgtccgccggtggtacgaacgggtacctacccttaccggacaaccgtacggccgtaacgttcggaacgggtccggggcgtacgggaccgaaggtaccgaccgaagtacgangancagcnnnnnnnntgnnnnnnnnnnnnnnnnnnnnnnnnnnnnnnnn

SEQ ID NO: 53051 - DNA, 670 bp, Homo sapiens
  misc_feature: GYAE6OF02JSE6K.36.26.C04.1.454.CMB.1.raw
  modified_base (125)..(125): a, c, t, g, unknown or other
  misc_feature (125)..(125): n is a, c, g, or t
  modified_base (660)..(660): a, c, t, g, unknown or other
  misc_feature (660)..(660): n is a, c, g, or t
  modified_base (667)..(668): a, c, t, g, unknown or other
  misc_feature (667)..(668): n is a, c, g, or t
tcagtacgctgtctcacgaccggtgctcgatttagtctagcgactttgggttggggggggtccctgagactctcctgtgtagcctctggattcacctttagcacctattccatgagttgggtccnccaggctccggggaagggctggagtgggtctcaagtgttagtggtgatggtgctaacacatactacgcaggctccgtgaacgggccgcttcacatctccagagacaattccgagagcgacggttgtttctgacaaaagtgacgcccgcctaggaaaacgccggaaggaccaccggacctaagtttaccacgtgtgcgaagaatgcagacaggtgggagcgtagaccgtacgtcggggaccagggccctacccgtggtaccctacccggtttccctagccgtccctacccgaaacccggacgggaccctaacgtcccggttcccctcccccgtcgggcccgtcccgtcgcctccgaggaccgccgtaccgacgacgcgaccgaaccgacggcccggtccggtacggtcctcgtcccgtgggtaccgaaccggtaccttacccgttaccgaaacgtccgacggtacgtacggtacggtacggccgggtacggtacggaacggtaccgggaccgtacggtaaccgtcgagctaccggngcgagcnncg

SEQ ID NO: 53052 - DNA, 688 bp, Homo sapiens
  misc_feature: GYAE6OF02FFJMG.36.26.C04.1.454.CMB.1.raw
  modified_base (209)..(209): a, c, t, g, unknown or other
  misc_feature (209)..(209): n is a, c, g, or t
  modified_base (236)..(236): a, c, t, g, unknown or other
  misc_feature (236)..(236): n is a, c, g, or t
  modified_base (244)..(244): a, c, t, g, unknown or other
  misc_feature (244)..(244): n is a, c, g, or t
  modified_base (249)..(249): a, c, t, g, unknown or other
  misc_feature (249)..(249): n is a, c, g, or t
  modified_base (676)..(676): a, c, t, g, unknown or other
  misc_feature (676)..(676): n is a, c, g, or t
  modified_base (687)..(687): a, c, t, g, unknown or other
  misc_feature (687)..(687): n is a, c, g, or t
tcagtacgctgtctcacgaccggtgctcgatttagtctagcgactttgggttggggggggtccctgagactctcctgtgtagcctctggattcacctttagcacctattccatgagttgggtccgccaggctccggggaaggggctggagtgggtctcaagtgttagtggtgatggtgctaacacatactacgcaggctcgtgaggccncttcacatctccagagacaatccgagngcacggtntttcngcaaatgacgccgcctgaacgcgaggacacggcctatttactactgtcgacgagtaatgcaagacaggtagggagtcgtcgaaccacggttcggggccgacgggccacccggttcggtccgtacccgttttccacgtaccggtccctacccgaacccgaacggggacccctaacggttccccgggtttacccttccccccggtacgggtccccgccccgttcggttacccgacccggtacggacggacccgtaacccgtcccggaaggtaaccggcaacggtaccgggcccggacccgttcggggaccttcggtccggttcggtacggaaacggttaccttaccgtaccaacgaccgtacggtaccgtaccgtaggaccggacgggttacgcggaccggaacggtccggacgtaagttacgcgacgngacgcacagtnc

SEQ ID NO: 53053 - DNA, 157 bp, Homo sapiens
  misc_feature: GYAE6OF01ALRHA.29.78.H01.1.454.CMB.1.raw
  modified_base (156)..(157): a, c, t, g, unknown or other
  misc_feature (156)..(157): n is a, c, g, or t
tcagatagagtactcacgaccggtgctcgattagtgtgagtagttggttgggtctccactccgccttgacgggctgccatcagcccaaggccaacccactgtcactctgttccgcctcctcagtactctatctgagcggctggcaaggcgcatagnn

SEQ ID NO: 53054 - DNA, 164 bp, Homo sapiens
  misc_feature: GYAE6OF01A2VBM.29.78.H01.1.454.CMB.1.raw
  modified_base (163)..(164): a, c, t, g, unknown or other
  misc_feature (163)..(164): n is a, c, g, or t
tcagatagagtactcacgaccggtgctcgatttagtgtgagtagtttgggttgggtctccactcccgccttgacgggctgccatcagcccaaggccaacccactgtcactctgttcccaccctcctcagtactctatctgagcgggctggcaaggcgcatagnn

SEQ ID NO: 53055 - DNA, 528 bp, Homo sapiens
  misc_feature: GYAE6OF01B1M1C.29.78.H01.1.454.CMB.1.raw
  modified_base (524)..(524): a, c, t, g, unknown or other
  misc_feature (524)..(524): n is a, c, g, or t
  modified_base (528)..(528): a, c, t, g, unknown or other
  misc_feature (528)..(528): n is a, c, g, or t
tcagatagagtactcacgaccggtgctcgatttagtgtgagtagtttgggtttgggcgcctgggtacggccggggtcgctgagactctcctgtgcggcctctggattaagtttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccggggcccacttgaccactggggccaggggacgctggtcaccgtctcctcagcctccaccaagggcccatcggtcttccccctggcaccctcctccaacgagcacctcgtcggggcacagcagccctgggctgcctggtcaaggactacttccagtactctatctgagcgggctggcaaggcgnatgn

SEQ ID NO: 53056 - DNA, 167 bp, Homo sapiens
  misc_feature: GYAE6OF01EXAE1.29.78.H01.1.454.CMB.1.raw
  modified_base (167)..(167): a, c, t, g, unknown or other
  misc_feature (167)..(167): n is a, c, g, or t
tcagatagagtactcacgaccggtgctcgatttagtgtgagtagtttgggtttggggtctccactcccgccttgacggggctgccatcagcccaaggccaaccccactgtcactctgttcccaccctcctcagtactctatctgagcgggctggcaaggcgcatagn

SEQ ID NO: 53057 - DNA, 202 bp, Homo sapiens
  misc_feature: GYAE6OF01ARCAZ.29.78.H01.1.454.CMB.1.raw
  modified_base (170)..(170): a, c, t, g, unknown or other
  misc_feature (170)..(170): n is a, c, g, or t
  modified_base (173)..(202): a, c, t, g, unknown or other
  misc_feature (173)..(202): n is a, c, g, or t
tcagatagagtactcacgaccggtgctcgatttagtgtgagtagtttgggtttggggtctccactcccgccttgacgggctgccattcagcccaaggccaaccccactgtcactctgttcccgccctcctcagtactctatctggagcgggctgggcaaggtcgcatagntannnnnnnnnnnnnnnnnnnnnnnnnnnnnn

SEQ ID NO: 53058 - DNA, 165 bp, Homo sapiens
  misc_feature: GYAE6OF01C6MQ1.29.78.H01.1.454.CMB.1.raw
tcagatagagtactcacgaccggtgctcgatttagtgtgagtagtttgggtttggggtctccactcccgccttgacgggctgccatcagcccaaggccaaccccactgtcactctgttcccaccctcctcagtactctatctgagcgggctggcaaggcgcatag

SEQ ID NO: 53059 - DNA, 566 bp, Homo sapiens
  misc_feature: GYAE6OF01ACOYD.29.78.H01.1.454.CMB.1.raw
  modified_base (382)..(382): a, c, t, g, unknown or other
  misc_feature (382)..(382): n is a, c, g, or t
  modified_base (565)..(566): a, c, t, g, unknown or other
  misc_feature (565)..(566): n is a, c, g, or t
tcagatagagtactcacgaccggtgctcgatttagtgtgagtagtttgggtttggggcgcctgggtacggccggggggtcgctgagactctcctgtgcggcctctggattaagttttaggagtcatgccatgaactgggtccgccaggctccagggaagggctggagtgggtctcggctattagtggcagtggtggcgctatatattatgcagacgccctgaagggccggttcaccatttccagagacaattcgaagaacacgctagtatctgcaaatggagagcctgagactcgacgacacggccgtctattattgtgttaaaggcgagctggaatacgggaccgggcccgacttggaccacgtggggcccagggggaccnctggtccaccgtctcctcagcctccaccgaagggcccagtcggtcttccccctcggtcctaccctcctccaacgacgccaacctcgtcggggccacgacgccgacgcccgtacgggccgtcgtcctcggtcaaggacctacttccagtacctctatctgacgcgggctggcacggcgacatgnn

SEQ ID NO: 53060 - DNA, 166 bp, Homo sapiens
  misc_feature: GYAE6OF01B04BK.29.78.H01.1.454.CMB.1.raw
  modified_base (166)..(166): a, c, t, g, unknown or other
  misc_feature (166)..(166): n is a, c, g, or t
tcagatagagtactcacgaccggtgctcgatttagtgtgagtagtttgggtttggggtctccactcccgccttgacgggctgccatcagcccaaggccaaccccactgtcactctgttcccaccctcctcagtactctatctgagcgggctggcaaggcgcatagn

SEQ ID NO: 53061 - DNA, 186 bp, Homo sapiens
  misc_feature: GYAE6OF01AUV0C.29.78.H01.1.454.CMB.1.raw
  modified_base (163)..(163): a, c, t, g, unknown or other
  misc_feature (163)..(163): n is a, c, g, or t
  modified_base (169)..(186): a, c, t, g, unknown or other
  misc_feature (169)..(186): n is a, c, g, or t
tcagatagagtactcacgaccggtgctcgatttagtgtgagtagtttgggtttgggggtctccactcccgccttgacgggctgccatcagcccgaaggccaaccccactgtcactctggttcccaccctcctcagtactctatctgagcgggctggcaaggcncatagnnnnnnnnnnnnnnnnnn

SEQ ID NO: 53062 - DNA, 483 bp, Homo sapiens
  misc_feature: GYAE6OF01EF72S.29.78.H01.1.454.CMB.1.raw
  modified_base (340)..(340): a, c, t, g, unknown or other
  misc_feature (340)..(340): n is a, c, g, or t
  modified_base (420)..(420): a, c, t, g, unknown or other
  misc_feature (420)..(420): n is a, c, g, or t
  modified_base (481)..(483): a, c, t, g, unknown or other
  misc_feature (481)..(483): n is a, c, g, or t
tcagatagagtactcacgaccggtgctcgatttagtgtgagtagtttgggtttggtggtctctctcccagcctgtgctgactcaatcgccctctgcctctgcctccctgggaggctcggtcaaggtcacctgtactctgagcagtggacacagcagctacgccatcgcttggcatcagcagaggccagacacgggccctcgttacttgatgacagtcaacaatgatggcagtcacagcaagggggacgggatccctgatcgcttctcagtctccagctctgggcctgagcgctacctcacaatctccggcctccagtctgagatgaggctgactattacngtcagacctggggcactggcattcaggtcttcggaccgggaccaaggtcaccgtcgtcggtcagcccaaggcccaacccnctgtcactctcgttcccgccctcctcagtactctatctgagcgggctggcaaggcacatgnnn

SEQ ID NO: 53063 - DNA, 188 bp, Homo sapiens
  misc_feature: GYAE6OF01CL5NN.29.78.H01.1.454.CMB.1.raw
  modified_base (167)..(188): a, c, t, g, unknown or other
  misc_feature (167)..(188): n is a, c, g, or t
tcagatagagtactcacgaccggtgctcgatttagtgtgagtagtttgggtttggggtctccactcccgccttgacgggctgccatcagcccaaggccaaccccactgtcactctagttcccaccctcctcagtactctatctgagcgggctggcaaggcgcatagnnnnnnnnnnnnnnnnnnnnnn

SEQ ID NO: 53064 - DNA, 528 bp, Homo sapiens
  misc_feature: GYAE6OF01DLZ41.29.78.H01.1.454.CMB.1.raw
  modified_base (282)..(282): a, c, t, g, unknown or other
  misc_feature (282)..(282): n is a, c, g, or t
  modified_base (523)..(523): a, c, t, g, unknown or other
  misc_feature (523)..(523): n is a, c, g, or t
  modified_base (527)..(528): a, c, t, g, unknown or other
  misc_feature (527)..(528): n is a, c, g, or t
tcagatagagtactcacgaccggtgctcgatttagtgtgagtagtttgggtttggggcgcctgggtacggccggggggtcgctgagactctcctgtgtggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatgganagcctgagactcgacgacacggccgtctattattgtgttaaaggcgagctggaatacgggaccggggcccgacttgaccactggggccaggggacgctgggtcaccgtctcctcagcctccaccaagggcccatcggtctccccctggcacctcctccaagagcacctctggggcacagcagccctgggctgcctggtcaaggctactccagtactctatctgagcgggctggcaaggcgnatgnn

SEQ ID NO: 53065 - DNA, 535 bp, Homo sapiens
  misc_feature: GYAE6OF01D0D4U.29.78.H01.1.454.CMB.1.raw
  modified_base (529)..(529): a, c, t, g, unknown or other
  misc_feature (529)..(529): n is a, c, g, or t
  modified_base (534)..(535): a, c, t, g, unknown or other
  misc_feature (534)..(535): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccgggccgacttgaccactggggccaggggacgctggtcaccgtctcctcagcctccaccaagggcccatcggtcttccccctcggccaccctcctccaagacgcacctctcgggggcacagcagccctgggctgcctggtcaaggctacttccagtactctatctgagcgggctggcaaggcgnactgnn

SEQ ID NO: 53066 - DNA, 165 bp, Homo sapiens
  misc_feature: GYAE6OF01DGJG5.29.78.H01.1.454.CMB.1.raw
  modified_base (165)..(165): a, c, t, g, unknown or other
  misc_feature (165)..(165): n is a, c, g, or t
tcagatagagtactcacgaccggtgctcgatttagtgtgagtagtttgggtttgggtctccactcccgccttgacgggctgccatcagcccaaggccaaccccactgtcactctgttcccaccctcctcagtactctatctgagcgggctggcaaggcgcatagn

SEQ ID NO: 53067 - DNA, 547 bp, Homo sapiens
  misc_feature: GYAE6OF01AWTHC.29.78.H01.1.454.CMB.1.raw
  modified_base (543)..(543): a, c, t, g, unknown or other
  misc_feature (543)..(543): n is a, c, g, or t
  modified_base (547)..(547): a, c, t, g, unknown or other
  misc_feature (547)..(547): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccggggcccgacttgaccactgggggccagggggacgctggtcaccggtctcctcagccctccaccaagggcccatccggtcttccccctcggccaccctcctcccaagacgccacctcgtgggggccacagccagcccgtgggcctgcctggtcaaggactacttccagtacctctatctgagcgggctggcaggcgnatgn

SEQ ID NO: 53068 - DNA, 532 bp, Homo sapiens
  misc_feature: GYAE6OF01DCORO.29.78.H01.1.454.CMB.1.raw
  modified_base (527)..(527): a, c, t, g, unknown or other
  misc_feature (527)..(527): n is a, c, g, or t
  modified_base (531)..(532): a, c, t, g, unknown or other
  misc_feature (531)..(532): n is a, c, g, or t
tcagatagagtactcacgaccggtgctcgatttagtgtgagtagtttgggtttggggcgcctgggtacggccgggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccgggcccgacttgaccactggggccaggggacgctggtcaccgtctcctcagcctccaccaagggcccatcggtcttccccctggccaccctcctccaagacgcacctctcggggcacagcagccctgggctgcctggtcaaggactacttccagtactctatctgagcgggctggcaaggcgnatgnn

SEQ ID NO: 53069 - DNA, 512 bp, Homo sapiens
  misc_feature: GYAE6OF01AOS9R.29.78.H01.1.454.CMB.1.raw
  modified_base (319)..(319): a, c, t, g, unknown or other
  misc_feature (319)..(319): n is a, c, g, or t
tcagatagagtactcacgaccggtgctcgatttagtgtgagtagtttgggtttggggtccgagccatggtgcagactccccagagctctcctcctcctccactgcacagggtctctctcccagcctgtgctgactcaatcgccctctgcctctgcctccctgggaggctcggtcaaggtcacctgtactctgagcagtggacacagcagctacgccatcgcttggcatcagcagaggccagacacgggccctcgttacttgatgacagtcaaacaatgatggcagtcacagcgaagggggcggatccctgatcgcttcncagtctccagctcgtgggcctgacgcgctacctcacaatctccggcctccagtctgagatgaggctgactattactgtcagaccgtggggcacgtggctagttcgaggttcgttaccgggaccgggacacggtccaccggtcgtcggtcacggcccaacggcccaaccccgtctcgtccactcgtcgtccccg

SEQ ID NO: 53070 - DNA, 167 bp, Homo sapiens; identical to SEQ ID NO: 53056
  misc_feature: GYAE6OF01BA74D.29.78.H01.1.454.CMB.1.raw
  modified_base (167)..(167): a, c, t, g, unknown or other
  misc_feature (167)..(167): n is a, c, g, or t

SEQ ID NO: 53071 - DNA, 557 bp, Homo sapiens
  misc_feature: GYAE6OF01ERUKX.29.78.H01.1.454.CMB.1.raw
  modified_base (555)..(557): a, c, t, g, unknown or other
  misc_feature (555)..(557): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagccggaatacgggaccgggcccgacttgaccacgtggggccagggggacgctggtcaccgtctcctcagcctccaccaagggcccatcgtccttcccctcggccacccctcctccaacgacgcaccctcgtcgggggcacgacgccacgcccgtcgggcctcggcctggtcaaggactacttccagtactctatcgtgaggcgggcgtcggcaacggcgcatagnnn

SEQ ID NO: 53072 - DNA, 174 bp, Homo sapiens
  misc_feature: GYAE6OF01BEVF9.29.78.H01.1.454.CMB.1.raw
  modified_base (168)..(174): a, c, t, g, unknown or other
  misc_feature (168)..(174): n is a, c, g, or t
tcagatagagtactcacgaccggtgctcgatttagtgtgagtagtttgggtttgggggtctccactcccgccttgacggggctgccatcagcccaaggccaaccccactgtcactctgttcccaccctcctcagtactctatctgagcgggctggcaaggcgcatagnnnnnnn

SEQ ID NO: 53073 - DNA, 519 bp, Homo sapiens
  misc_feature: GYAE6OF01DSB16.29.78.H01.1.454.CMB.1.raw
  modified_base (430)..(430): a, c, t, g, unknown or other
  misc_feature (430)..(430): n is a, c, g, or t
  modified_base (436)..(436): a, c, t, g, unknown or other
  misc_feature (436)..(436): n is a, c, g, or t
  modified_base (515)..(515): a, c, t, g, unknown or other
  misc_feature (515)..(515): n is a, c, g, or t
  modified_base (519)..(519): a, c, t, g, unknown or other
  misc_feature (519)..(519): n is a, c, g, or t
tcagatagagtactcacgaccggtgctcgatttagtgtgagtagtttgggtttggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccggggcccgacttgaccactggggccaggggacgctggtcaccgtctcctcagcctccaccaagggccatcgtctcccctgcaccnctccanagcacctctggggcacagcagccctgggctgcctggtcaaggctactccagtactctatctgagcgggctggcaaggcnatgn

SEQ ID NO: 53074 - DNA, 529 bp, Homo sapiens
  misc_feature: GYAE6OF01CB821.29.78.H01.1.454.CMB.1.raw
  modified_base (528)..(529): a, c, t, g, unknown or other
  misc_feature (528)..(529): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccgggcccgacttgaccactggggccagggggacgctggtcaccgtctcctcagcctcaccaagggcccatcgtcttccccctcggcaccctcctccaagagcacctctggggcacagcagccctgggctgcctggtcaaggactacttccagtactctatctgagcggctggcaggcgcatgnn

SEQ ID NO: 53075 - DNA, 485 bp, Homo sapiens
  misc_feature: GYAE6OF01A93DV.29.78.H01.1.454.CMB.1.raw
  modified_base (419)..(419): a, c, t, g, unknown or other
  misc_feature (419)..(419): n is a, c, g, or t
  modified_base (477)..(477): a, c, t, g, unknown or other
  misc_feature (477)..(477): n is a, c, g, or t
  modified_base (483)..(485): a, c, t, g, unknown or other
  misc_feature (483)..(485): n is a, c, g, or t
tcagatagagtactcacgaccggtgctcgatttagtgtgagtagtttgggtttggtggtctctctcccagcctgtgctgactcaatcgccctctgcctctgcctccctgggaggctcggtcaaggtcacctgtactctgagcagtggacacagcagctacgccatcgcttggcatcagcagaggccagacacgggccctcgttacttgatgacagtcaacaatgatggcagtcacagcaagggggacgggatccctgatcgcttctcagtctccagctctgggcctgagcgctacctcacaatctccggcctccagtctgaggatgaggctgactattactgtcagacctggggcactggcattcaggtcttcgggaccgggacaaggtcacgtcgtcggtcagcccaaggccaacccnctcgtccactctcgttcccaccctcctcagtctctatcgtgagcgggctggcaaggcncatagnnn

SEQ ID NO: 53076 - DNA, 192 bp, Homo sapiens
  misc_feature: GYAE6OF01BZ94H.29.78.H01.1.454.CMB.1.raw
  modified_base (167)..(192): a, c, t, g, unknown or other
  misc_feature (167)..(192): n is a, c, g, or t
tcagatagagtactcacgaccggtgctcgatttagtgtgagtagtttgggttgggggtctaccactcccgccttgacgggctgccatcagcccaaggccaaccccactgtcactctgttccaccctcctcagttactctatctgagcgggctggcaaggcgcatagnnnnnnnnnnnnnnnnnnnnnnnnnn

SEQ ID NO: 53077 - DNA, 542 bp, Homo sapiens
  misc_feature: GYAE6OF01BZ6G3.29.78.H01.1.454.CMB.1.raw
  modified_base (537)..(537): a, c, t, g, unknown or other
  misc_feature (537)..(537): n is a, c, g, or t
  modified_base (541)..(542): a, c, t, g, unknown or other
  misc_feature (541)..(542): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattatgtgttaaaggcgagctggaatacgggaccggggcccgacttgaccacgtggggccaggggacgctggtcaccgtctcctcagcctccaccaagggcccatcggtccttccccctggccaccctcctccaacgacgccacctcgtcggggcacgagcacgccctgggctgcctggtcaaggactacttccacgtactctatctgagcgggctggcgaggcgnatgnn

SEQ ID NO: 53078 - DNA, 562 bp, Homo sapiens
  misc_feature: GYAE6OF01D97GX.29.78.H01.1.454.CMB.1.raw
  modified_base (561)..(562): a, c, t, g, unknown or other
  misc_feature (561)..(562): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccggggcccgacttgaccactggggccagggggacgctggtcaccgtctcctcagcctccaccaagggcccatccggtccttccccctcggccaccctcctcccaacgacgccaccctccgtcgggggccacagccacgccccgtgggcctcggccctggtcaacgggacctaccgttccagtactctactctgagcgggctggcaaggcgacatgnn

SEQ ID NO: 53079 - DNA, 499 bp, Homo sapiens
  misc_feature: GYAE6OF01COQPN.29.78.H01.1.454.CMB.1.raw
  modified_base (423)..(423): a, c, t, g, unknown or other
  misc_feature (423)..(423): n is a, c, g, or t
  modified_base (496)..(497): a, c, t, g, unknown or other
  misc_feature (496)..(497): n is a, c, g, or t
  modified_base (499)..(499): a, c, t, g, unknown or other
  misc_feature (499)..(499): n is a, c, g, or t
tcagatagagtactcacgaccggtgctcgatttagtgtgagtagtttgggtttggtggtctctctcccagcctgtgctgactcaatcgccctctgcctctgcctccctgggaggctcggtcaaggtcacctgtactctgagcagtggacacagcagctacgccatcgcttggcatcagcagaggccagacacgggccctcgttacttgatgacagtcaacaatgatggcagtcacagcaagggggacgggatccctgatcgcttctcagtctccagctctgggcctgagcgctacctcacaatctccggcctccagtctgaggatgaggctgactattactgtcagacctggggcacgtggcattcaggtcttcggaccgggaccaaggtcaccgtcgtcggtcacgcccaaggccaaccccnctcgtcactctacgttcccgccctcctcacgtactcctatcgtgagcgggctcggcaagggccgacagtacgnngn

SEQ ID NO: 53080 - DNA, 493 bp, Homo sapiens
  misc_feature: GYAE6OF01CBKL6.29.78.H01.1.454.CMB.1.raw
tcagatagagtactcacgaccggtgctcgatttagtgtgagtagtttgggtttggggtccgagccatggtgcagactccccagagctctcctcctcctccactgcacagggtctctctcccagcctgtgctgactcaatcgccctctgcctctgcctccctgggaggctcggtcaaggtcacctgtactctgagcagtggacacagcagctacgccatcgcttggcatcagcagaggccagacacgggccctcgttacttgatgacagtcaacaatgatggcagtcacagcaagggggacggatccctgatcgcttctcagtctccagctctgggcctgagcgctacctcacatctccggcctcagtctgaggatgaggctgactattactgtcagacctggggcactggctagttcaggtcttcggaccgggaccaaggtcaccggtcgtcggtcacgcccaaggcccaaccccgctcgcactctgtccccg

SEQ ID NO: 53081 - DNA, 550 bp, Homo sapiens
  misc_feature: GYAE6OF01BFSWH.29.78.H01.1.454.CMB.1.raw
  modified_base (545)..(545): a, c, t, g, unknown or other
  misc_feature (545)..(545): n is a, c, g, or t
  modified_base (549)..(550): a, c, t, g, unknown or other
  misc_feature (549)..(550): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccggggcccgacttgaccactggggccaggggacgctggtcaccgtctcctcagcctccaccaagggcccatccggtccttccccctggcccacccctcctcccaacgacgccaccctccgtcgggggccacgagccagccccgtgggcctgcctggtcaaggactacttccagtactctatctgagcggctggcaggcgnatgnn

SEQ ID NO: 53082 - DNA, 582 bp, Homo sapiens
  misc_feature: GYAE6OF01A82OI.29.78.H01.1.454.CMB.1.raw
  modified_base (365)..(365): a, c, t, g, unknown or other
  misc_feature (365)..(365): n is a, c, g, or t
  modified_base (550)..(550): a, c, t, g, unknown or other
  misc_feature (550)..(550): n is a, c, g, or t
  modified_base (576)..(577): a, c, t, g, unknown or other
  misc_feature (576)..(577): n is a, c, g, or t
tcagatagagtactcacgaccggtgctcgatttagtgtgagtagtttgggtttggtgggtctctctcccagcctgtgctgactcaatcgcccctctgcctctgcctccctgggaggctcggtcaaggtcacctgtactctgagcagtggactacagcagctacgccatcgcttggcatcagcaggaggccagaccaccgggccctcgttacttgatgacagtcaacaatgatggcagtcacagacgaaagggggcggactcccgtgactcggcttctcagttcctccagcctcgtgggccctaggacgccgcctacctcacaactcgtccggcctccagtctgaggatgaggctagactattacngtcagaccgtgggcacgtggctagttccgagggttccttaccgggaaccgggtacctaaggttcctaccggttcggtccggtacacggccccaaggcccctaaccccacgttcggtacctacttccgtaccgttaccccacccgttcctacgtacgttacctcgtacgtcgtaggacgccgggtntcgggacaacgggtccactaagtcgnngtacg

SEQ ID NO: 53083 - DNA, 575 bp, Homo sapiens
  misc_feature: GYAE6OF01B0X7L.29.78.H01.1.454.CMB.1.raw
  modified_base (574)..(575): a, c, t, g, unknown or other
  misc_feature (574)..(575): n is a, c, g, or t
tcagatagagtactcacgaccggtgctcgatttagtgtgagtagtttgggtttggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccgggcccgacttgaccacgtggggccaggggacgctggtcaccgtctcctcagccctccaccacgggcccatcggtcttccccctcggccaccctcctccaacgacgcaccctcgtcgggggcacacgcacgcccgtcgggccgtcgcccgtcggtaccgaacggtacctaccttccgacgttacctccttactccgtgacggccgggcgtggacgaacggcgacagtgnn

SEQ ID NO: 53084 - DNA, 638 bp, Homo sapiens
  misc_feature: GYAE6OF01DMSYU.29.78.H01.1.454.CMB.1.raw
  modified_base (307)..(307): a, c, t, g, unknown or other
  misc_feature (307)..(307): n is a, c, g, or t
tcagatagagtactcacgaccggtgctcgatttagtgtgagtagtttgggtttgggggagagaggagtccacccctgggatcttcaggtgttttcatttggtgatcaggacggaacagagagaactcaccatggagtttgggctgagcggtgtcgttttctaggtggctaattttaaaaggtgtcagtgtgacgtgcagttggtggagtcgtgggggcgcctggggtacgggccgggggggtcgctgagactctcctgtgcggcctctggatttaaggttttaggatcatgccatgaactgggtccncaggctcgagggaggggctggagtgggtctcgggctattagtggcaggtggtggcgctatatattatgcagaccgccctggaacgggtccggttacacctatttccaagagacaattacgaaagaacacgtctagtatctagacaaagtgggagacgcctaggaacacgtcgacgacgaccggtccgttattatttattggtaggttaaagggcgagcgtagggaaacgtaccgggggacccggggtcccgtaagtttcggaacccgtacggttcggggggacccgtaaggggggtacccgcggtttacgggtacccgtacccgggttccc

SEQ ID NO: 53085 - DNA, 175 bp, Homo sapiens
  misc_feature: GYAE6OF01CAPE0.29.78.H01.1.454.CMB.1.raw
  modified_base (167)..(175): a, c, t, g, unknown or other
  misc_feature (167)..(175): n is a, c, g, or t
tcagatagagtactcacgaccggtgctcgatttagtgtgagtagtttgggtttgggggtctccactcccgccttgacgggctgccatcagcccaaggccaaccccactgtcactctgttcccgccctcctcagtactctatctgagcgggctggcaaggcgcatagnnnnnnnnn

SEQ ID NO: 53086 - DNA, 167 bp, Homo sapiens
  misc_feature: GYAE6OF01CKOKZ.29.78.H01.1.454.CMB.1.raw
  modified_base (167)..(167): a, c, t, g, unknown or other
  misc_feature (167)..(167): n is a, c, g, or t
tcagatagagtactcacgaccggtgctcgatttagtgtgagtagtttgggtttgggggtctccactcccgccttgacgggctgccatcagcccaaggccaaccccactgtcactctgttcccgccctcctcagtactctatctgagcgggctggcaaggcgcatagn

SEQ ID NO: 53087 - DNA, 491 bp, Homo sapiens
  misc_feature: GYAE6OF01DLBZ9.29.78.H01.1.454.CMB.1.raw
  modified_base (313)..(313): a, c, t, g, unknown or other
  misc_feature (313)..(313): n is a, c, g, or t
  modified_base (334)..(334): a, c, t, g, unknown or other
  misc_feature (334)..(334): n is a, c, g, or t
  modified_base (412)..(412): a, c, t, g, unknown or other
  misc_feature (412)..(412): n is a, c, g, or t
  modified_base (465)..(465): a, c, t, g, unknown or other
  misc_feature (465)..(465): n is a, c, g, or t
  modified_base (488)..(489): a, c, t, g, unknown or other
  misc_feature (488)..(489): n is a, c, g, or t
  modified_base (491)..(491): a, c, t, g, unknown or other
  misc_feature (491)..(491): n is a, c, g, or t
tcagatagagtactcacgaccggtgctcgatttagtgtgagtagtttgggtttggtggtctctctcccagcctgtgctgactcaatcgccctctgcctctgcctccctgggaggctcggtcaaggtcacctgtactctgagcagtggacacagcagctacgccatcgcttggcatcagcagagccagacacggcctgttactgatgacagtcaacaatgatggcagtcacagcgaagggggacggatccctgatcgcttctcagtctccagctcgtggcctgagcgctacctcaacatctccggcctcagtcngaggatgagctgactattacngtcagaccgtgggcacgtgcattcgaggtcttacgggaccgggacaaggtcaccgtgtcgcagcccaagcccaacccntcgtccactctcgttccccgcctcgtctacgtctctactccgtggagccgggntcgggactacgggcacaagtcgnngn

SEQ ID NO: 53088 - DNA, 520 bp, Homo sapiens
  misc_feature: GYAE6OF01E0KI7.29.78.H01.1.454.CMB.1.raw
tcagatagagtactcacgaccggtgctcgatttagtgtgagtagtttggggtttggggagagctctggggagtctgcaccatggctcggaccccactcctcttcctcaccctcctcctccactgcacagggtctctctcccagcctgtgctgactcaatcgccctctgcctctgcctccctgggaggctcggtcaaggtcacctgtactctgagcagtggacacagcagctacgccatcgcttggcatcagcagaggccagacacgggccctcgttacttgatgacagtcaacaatgatggcagtcacagcgaagggggacggatcccgtgatcgcttctcagtctccagctcgtgggcctgacgcgctacctcacaatctccggcctccagtctgaggatgagctgactattactgtcagaccgtgggcacgtggctattcgaggtccgttacgggacccggggtacaacgggtccaccggtcgtcggtacacggaccccaacggcccaaccccgtacg

SEQ ID NO: 53089 - DNA, 717 bp, Homo sapiens
  misc_feature: GYAE6OF01DJBIG.29.78.H01.1.454.CMB.1.raw
tcagatagagtactcacgaccggtgctcgatttagtgtgagtagtttgggtttggggtccgagccatggtgcagactccccagagctcctcctcctcctccactgcacgaggtctctcctccagctgtgctgactacaactccgccctctcgcctctcgccctcccggtgggacgtcgtcggtacaaggtccacctgtactcgtgagcaggtggacacagcagtcctacgccagtcgtcgttggactatcagcaaggacggaccaagaaccgccgggtcccttacgttacttgatcgaacacgtacaaaataagtgagtcggacagtacaacgaggacgggaaagggggtacgactcccgtagacgtccgtctttccgacgtacgtcctaccgacgtccttcggtcgggtcctaggaccgtccgtaccttaacccgacaaacgtaaccgttcccgtcccgggtacccttaccgtaacggttccgtagggaacggtaaggtacggaacggtccgtaacgtaactttaacgttaccgtacgtacgaacggtaccgggtcggggacctaacggtcggacttaacgttccggtagggttcccggttaccggggaaaccgggtaaccgtaacggtccgtaccggtcggtaccggtacgaacccggacccgaacggaccccaaaccccgtgttacgaccctaccttccgttcccgttcccccg

SEQ ID NO: 53090 - DNA, 544 bp, Homo sapiens
  misc_feature: GYAE6OF01DCHPC.29.78.H01.1.454.CMB.1.raw
  modified_base (381)..(381): a, c, t, g, unknown or other
  misc_feature (381)..(381): n is a, c, g, or t
  modified_base (543)..(544): a, c, t, g, unknown or other
  misc_feature (543)..(544): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccgggcccgacttgaccacgtgggggccagggggacnctggtcaccgtctcctcagccctccaccaagggcccatcggtccttccccctggccaccctcctccaacgacgccacctcgtcggggccacgagcacgccctgggctgcctggtcaaggctacttccagtactctatctgagcgggctggcacggcgcatgnn

SEQ ID NO: 53091 - DNA, 572 bp, Homo sapiens
  misc_feature: GYAE6OF01DE9Y8.29.78.H01.1.454.CMB.1.raw
  modified_base (247)..(247): a, c, t, g, unknown or other
  misc_feature (247)..(247): n is a, c, g, or t
  modified_base (365)..(365): a, c, t, g, unknown or other
  misc_feature (365)..(365): n is a, c, g, or t
tcagatagagtactcacgaccggtgctcgatttagtgtgagtagtttgggtttggggtctgagagaggagtccacccctgggatcttcaggtgttttcatttggtgatcaggacggaacagagagaactcaccatggagtttgggctgagcgtgtcgttttctaggtggctaattttaaaaggtgtcagtgtgacgtgcagttggtggagtcgtgggggcgccgtggggtacgggccgggggggtcncgtgagactctcctgtgcggcctctggatttaagttttaggagtcatgcatgaactggtccgccaggctcgaggggaaggggctggagtggtctcggctatagtggcagtggtggcgntatatattatgcagacgccctggaagggccggttcaccatttccagagacaattcgaagaacacgctgtatctagcaaatggagagcctagagactcgacgacacggccgtactattattgtagttaaaggcgaaggctagggaaacgtcggggaccgggcccgacgttcgacccgtacgcggggaccaggggacgcgtggtacccg

SEQ ID NO: 53092 - DNA, 581 bp, Homo sapiens
  misc_feature: GYAE6OF01BZ5LM.29.78.H01.1.454.CMB.1.raw
  modified_base (579)..(580): a, c, t, g, unknown or other
  misc_feature (579)..(580): n is a, c, g, or t
tcagatagagtactcacgaccggtgctcgatttagtgtgagtagtttgggtttgggggcgcctggggtacgccggggggtcgggctgagactctcctgtgcggcctctggattaagttttaggtaggtcatgccatgaactgggtccggccaggctccagggaaggggcgtggagtgggtcgtcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacggggaccggggcccgacttgaccactgggggccagggggacgctggtcaccgtctcctcagccctccaccaacgggcccatcggtcttccccctcggcaccctcctccaacgacgccacctcgtcgggggcacgacgcacgcccgtcgggcctcgtccgtggtaccgacggaccgttaccttccgagtaccttctactcgtgacggcggggctcgggcgaacggcgacatgnng

SEQ ID NO: 53093 - DNA, 189 bp, Homo sapiens
  misc_feature: GYAE6OF01BD4IG.29.78.H01.1.454.CMB.1.raw
  modified_base (167)..(189): a, c, t, g, unknown or other
  misc_feature (167)..(189): n is a, c, g, or t
tcagatagagtactcacgaccggtgctcgatttagtgtgagtagtttgggtttgggggtctccactcccgccttgacgggctgccatcagcccaaggccaaccccactgtcactctgttcccaccctcctcagtactctatctgagcgggctggcaaggcgcatagnnnnnnnnnnnnnnnnnnnnnnn

SEQ ID NO: 53094 - DNA, 541 bp, Homo sapiens
  misc_feature: GYAE6OF01BSR5O.29.78.H01.1.454.CMB.1.raw
tcagatagagtactcacgaccggtgctcgatttagtgtgagtagtttgggtttggagtctgcaccatggctcggaccccactcctcttcctcaccctcctcctccactgcacagggtctctctcccagcctgtgctgactcaatcgccctctgcctctgcctccctgggagctcggtcaaggtcacctgtactctgagcagtggacacagcagctacgccatcgcttggcatcagcagaggccagacacgggccctcgttactgatgacagtcaacaatgatggcagtcacagcgaagggggcggatcccgtgatcgcttctcagtctccagtctcgtgggcctgacgcgctacctcacatcctccggcctcagtctgagatgagctgacttattactgtacaggtaccgtggggccacgtgggactagttcgaggttccgttaccggggacccgggtacctaagggtcccgaccggtcggtccggtacgaccggaccccgaaggccccaaaccccgacgtacgtccacgttccgtacccg

SEQ ID NO: 53095 - DNA, 533 bp, Homo sapiens
  misc_feature: GYAE6OF01B4H7S.29.78.H01.1.454.CMB.1.raw
  modified_base (513)..(513): a, c, t, g, unknown or other
  misc_feature (513)..(513): n is a, c, g, or t
  modified_base (520)..(520): a, c, t, g, unknown or other
  misc_feature (520)..(520): n is a, c, g, or t
  modified_base (530)..(530): a, c, t, g, unknown or other
  misc_feature (530)..(530): n is a, c, g, or t
  modified_base (533)..(533): a, c, t, g, unknown or other
  misc_feature (533)..(533): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaatgcgagctggaatacgggaccggggcccgacttgaccactggggccaggggacgctggtcaccgtctcctcagcctccaccaaggcccatcggtcttccccctggccaccctcctccaagacgcacctctggggcacagcagccctggcctgcctggtcaggactacttcacgtactctactctggngcgggcnggcaggcgcntgn

SEQ ID NO: 53096 - DNA, 578 bp, Homo sapiens
  misc_feature: GYAE6OF01D77ON.29.78.H01.1.454.CMB.1.raw
  modified_base (393)..(393): a, c, t, g, unknown or other
  misc_feature (393)..(393): n is a, c, g, or t
  modified_base (577)..(578): a, c, t, g, unknown or other
  misc_feature (577)..(578): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccggggccgacttgaccacgtggggccaggggacgcgtggtcaccgtcnccctcagccctccaccaacgggcccatccggtccttccccctcgggcccacccctccctccaacgacgccaccctccgtcgggggccacgagccagcccctgggcctgcccgtggtccaaggaccttacttccagtacctcttacgtctgacggcgggcgtcgggaccaagggccgacactagnn

SEQ ID NO: 53097 - DNA, 520 bp, Homo sapiens
  misc_feature: GYAE6OF01EVQ3U.29.78.H01.1.454.CMB.1.raw
tcagatagagtactcacgaccggtgctcgatttagtgtgagtagtttgggtttggggtccgagccatggtgcagactccccagagctctcctcctcctccactgcacagggtctctctcccagcctgtgctgactcaatcgccctctgcctctgcctccctgggaggctcggtcaaggtcacctgtactctgagcagtggacacagcagctacgccatcgcttggcatcagcagaggccagacacgggccctcgttacttgatgacagtcaacaatgatggcagtcacagcgaagggggacggatccctgatcgcttctcagtctccagctcgtgggcctgacgcgctacctcacaatctccggcctccagtctgagatgaggctgacttattactgtcagaccgtggggcacgtggctagttcgagggttcttacgggaccggggaccaagggtccaccggtcgtcggtcaggccccaagggcccaaaccccgtctcgtaccaccttcgtcgttccccc

SEQ ID NO: 53098 - DNA, 486 bp, Homo sapiens
  misc_feature: GYAE6OF01ANLIQ.29.78.H01.1.454.CMB.1.raw
  modified_base (421)..(421): a, c, t, g, unknown or other
  misc_feature (421)..(421): n is a, c, g, or t
  modified_base (484)..(486): a, c, t, g, unknown or other
  misc_feature (484)..(486): n is a, c, g, or t
tcagatagagtactcacgaccggtgctcgatttagtgtgagtagtttgggtttggtggtctctctcccagcctgtgctgactcaatcgccctctgcctctgcctccctgggaggctcggtcaaggtcacctgtactctgagcagtggacacagcagctacgccatcgcttggcatcagcagaggccagacacgggccctcgttacttgatgacagtcaacaatgatggcagtcacagcaagggggacggatccctgatcgcttctcagtctccagctctgggcctgagcgctacctcacaatctccggcctccagtctgaggatgaggctgactattactgtcagacctggggcactggcattcaggtcttcgggaccgggaccaaggtcaccgtcgtcggtcagcccaaggcccaacccntcgtcactctcgttccccgcctcctcagtacctctatcgtgagcgggctggcaaggcgcatgnnn

SEQ ID NO: 53099 - DNA, 587 bp, Homo sapiens
  misc_feature: GYAE6OF01A8RZZ.29.78.H01.1.454.CMB.1.raw
  modified_base (213)..(213): a, c, t, g, unknown or other
  misc_feature (213)..(213): n is a, c, g, or t
  modified_base (348)..(348): a, c, t, g, unknown or other
  misc_feature (348)..(348): n is a, c, g, or t
tcagatagagtactcacgaccggtgctcgatttagtgtgagtagtttgggtttgggggagagaggagtccacccctgggatcttcaggtgttttcatttggtgatcaggacggaacagagagaactcaccatggagtttgggctgagcgtgtcgtttctaggtggctatttaaaggtgtcagtgtgacgtgcagttggtggagtctgggggcncctgggtacggccgggggggtcgctgagactctcctgtgcggcctctggattaagttttaggagtcatgccatgaactgggtccgccaggctccgagggaaggggctgggaggtgggtctcggctattagtggcngtggtggcgctatatattatgcagacgccctggaacgggccggttcacctatttccagagacaattcgaagaacacgctgtatctgacaaatggagagcctgagactcgaacgacgacggccgtctattattgtagttaaaggcgaagctagggaactacggggacccggggcccgtacgttggacccgacgtcgggggacccaacggggggtaccgccgtggtccgtacccggttccc

SEQ ID NO: 53100 - DNA, 635 bp, Homo sapiens
  misc_feature: GYAE6OF01A4YJ9.29.78.H01.1.454.CMB.1.raw
  modified_base (245)..(245): a, c, t, g, unknown or other
  misc_feature (245)..(245): n is a, c, g, or t
tcagatagagtactcacgaccggtgctcgatttagtgtgagtagtttgggtttggggtctgagagaggagtccacccctgggatcttcaggtgttttcatttggtgatcaggacggaacagagagaactcaccatggagtttgggctgagcggtgtgtttctaggtggctaatttaaaggtgtcagtgtgacgtgcaggttggtggagtcgtgggggcgccgtggggtacgggccgggggggtcncgtgagctctcctgtgcggcctctggattaagtttggagtcatgccatgaacgtgggtccgcgaggcctccgaggggaagggggcgtgggaggtgggtcgtcgggactagttagtggcaggtggtggcgctatatattatgcagacgccctaggaacgggtccggttacaccgtatttcccgaagtacgactaagttacggaaagaacacggacttgtaatctaggactaaagtggagacgccgtagacgacgtacgacgtacgaccggtccgtacttagttagttggtagttaaaggcgagtcggtaggaacggtaccggggacccggggacccggtacgttacggacctacgggtacggggaccgtaaggggcctcggtggtaccccg

SEQ ID NO: 53101 - DNA, 840 bp, Homo sapiens
  misc_feature: GYAE6OF01BZOKH.29.78.H01.1.454.CMB.1.raw
  modified_base (110)..(110): a, c, t, g, unknown or other
  misc_feature (110)..(110): n is a, c, g, or t
tcagatagagtactcacgaccggtgctcgatttagtgtgagtagtttggggtttggggagagctctggggagtctgcaccatggctcggaccccactcctcttcccaccnccctcctccacctctcgacacggtcggtctcctcctaccgcgtcgttgtcgtcgtacgtacctaactacgtcccgtcccttcgtccgtccttcgtccgtccccttcgggtaggggcgtccggtacgtaacgtacgtcctacgttctctcgagacgacgtaggacgaacacgacgacgtacgtaccgtaccgactacggtccgttcggtacgacttacacgacgacgaaggaccgacgaacgaaccgggtcccggtcctttacgtttacgtagtacgtaccgaacgttacgtaaaccaaaacgtagtagtacggcggaactacgaccaacggacggaaacggggggaacgggggtactacccgttcgagtacgtccgttcttcgacgtacgtccgacgcgtcgtcgggccgtacgtacggccgtcccttaacccttacccgaccgtaaaccgttcgttcccccgggtccccttaccgtaacggttacggttcggaagggtaacgtccggttacgggccgttacttaaccgttaaacttttacggtccgttacggaaccggacccgggtttacggggcggtaactcgggtaccgtacgtttccgtacggggttaccggtttacccggggaacccggggggtaaccaaacggtttaccgggtccccggttaccgggttccggtaaccggaccaacccgggtaaccggaaccccggtaacccctaaccgttggg

SEQ ID NO: 53102 - DNA, 583 bp, Homo sapiens
  misc_feature: GYAE6OF01D40OX.29.78.H01.1.454.CMB.1.raw
  modified_base (575)..(575): a, c, t, g, unknown or other
  misc_feature (575)..(575): n is a, c, g, or t
  modified_base (581)..(581): a, c, t, g, unknown or other
  misc_feature (581)..(581): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaaatggagagcctgagactcgacgacacggccgtctattattgtgttaaaggcgagctggaatacgggaccgggccgacttgaccacgtggggccaggggacgctggtccaccgtctccctcacgccctccaaccgaacgggcccagtccggtccttcccccgtcggcccacccctccctaccaacgacgccaccctcgtcggggcacgagccacgcccgtcgggcctcgccgtcggtacaacggacctaccttccacgtacctctacgtctgacggcgggcgtggacgtaacggcganacgtgncg

SEQ ID NO: 53103 - DNA, 168 bp, Homo sapiens
  misc_feature: GYAE6OF01EF61B.29.78.H01.1.454.CMB.1.raw
  modified_base (167)..(168): a, c, t, g, unknown or other
  misc_feature (167)..(168): n is a, c, g, or t
tcagatagagtactcacgaccggtgctcgatttagtgtgagtagtttgggtttggggtctccactcccgccttgacggggctgccatcagcccaaggccaaccccactgtcactctgttcccgccctcctcagtactctatctgagcgggctggcaaggcgcatagnn

SEQ ID NO: 53104 - DNA, 610 bp, Homo sapiens
  misc_feature: GYAE6OF01CXPSV.29.78.H01.1.454.CMB.1.raw
  modified_base (146)..(146): a, c, t, g, unknown or other
  misc_feature (146)..(146): n is a, c, g, or t
  modified_base (396)..(396): a, c, t, g, unknown or other
  misc_feature (396)..(396): n is a, c, g, or t
  modified_base (412)..(412): a, c, t, g, unknown or other
  misc_feature (412)..(412): n is a, c, g, or t
  modified_base (609)..(609): a, c, t, g, unknown or other
  misc_feature (609)..(609): n is a, c, g, or t
tcagatagagtactcacgaccggtgctcgatttagtgtgagtagtttgggtttgggggcgcctgggtacggccgggggtcgctcgagacgtctcctggtgccggcctctggattaagttttaggagtcatgccatgaactggtccncaggctccgagggaagggtctggagtgggtctcggtctattagtcggcagttggtggcgctatatagttatcgcagacgccctggaacggccgttcaccatttccagagacaattcgaagaacacgctgtatctgcaaagtggacagcctgagactcgacgacacggccgtctaattaattgtagttaaaggcgaagcctaggaaactacggggaccgggccgagttgaccacgtggggccaaggggacnctggtcaccgtctccncagcctcaccaaggccatcggtccttcccctcggcaccctccgttaccaagacgcacctcgtcggggccaacgagcacgcccccgttgggtccgtcgaccgttcgggtacaaacgggaccttaaccgttccaacggttaacctcttaagtccgttaggacgcggggacttcgggacaacgggtcgactaactaggcnc

SEQ ID NO: 53105 - DNA, 496 bp, Homo sapiens
  misc_feature: GYAE6OF01BJDZS.29.78.H01.1.454.CMB.1.raw
  modified_base (432)..(432): a, c, t, g, unknown or other
  misc_feature (432)..(432): n is a, c, g, or t
  modified_base (451)..(451): a, c, t, g, unknown or other
  misc_feature (451)..(451): n is a, c, g, or t
  modified_base (494)..(496): a, c, t, g, unknown or other
  misc_feature (494)..(496): n is a, c, g, or t
tcagatagagtactcacgaccggtgctcgatttagtgtgagtagtttgggtttggtggtctctctcccagcctgtgctgactcaatcgccctctgcctctgcctccctgggaggctcggtcaaggtcacctgtactctgagcagtggacacagcagctacgccatcgcttggcatcagcagaggccagacacgggccctcgttacttgatgacagtcaacaatgatggcagtcacagcgaagggggacggatccctgatcgcttctcagtctccagctcgtgggcctgagcgctacctcacaatcctccggcctccagtctgaggatgagctgactattactgtcagaccgtggggcacgtggcagttcgagggttcttcgggaccggggaccaaggtccaccgtcgtcggtcacgcccaaggcccaacccntcgtcactctcgttccccnccctctcacgtactctatcgtgagcggctggcaaggcacatgnnn

SEQ ID NO: 53106 - DNA, 555 bp, Homo sapiens
  misc_feature: GYAE6OF01DIES2.29.78.H01.1.454.CMB.1.raw
  modified_base (555)..(555): a, c, t, g, unknown or other
  misc_feature (555)..(555): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccggggcccgacttgaccacgtggggccaggggacgctggtcaccgtctcctcagcctccaccaagggcccatcggtcttccccctggccaccctcctccaagacgcaccctcgtcgggggccacgagccaggccccgtgggccctggccctgggtccaagggcctacttcccagtacctctatctgaggcgggctggctaaggcgcatgn

SEQ ID NO: 53107 - DNA, 573 bp, Homo sapiens
  misc_feature: GYAE6OF01BPG38.29.78.H01.1.454.CMB.1.raw
  modified_base (572)..(573): a, c, t, g, unknown or other
  misc_feature (572)..(573): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccgttcaccatttccagagacaattcgaagaacacgctgtatctgcaaatggagagcctgagactcgacgacacggccgtctattattgtgttaaaggcgagctaggaactacggggaccggggccacttgaccacgtgggggccagggggacgcgtgggtcaccgtctcctcagccctccacaacgggcccagtccggtccttccccctggccaccctccctccaagacgccacctccgtcgggggccacgagccacgccctcgggcctcggcccgtcgggtcaacggacctaccttccacgttacctctactctggacggcgggctggcgaacggcgcatgnn

SEQ ID NO: 53108 - DNA, 540 bp, Homo sapiens
  misc_feature: GYAE6OF01BQP89.29.78.H01.1.454.CMB.1.raw
  modified_base (535)..(535): a, c, t, g, unknown or other
  misc_feature (535)..(535): n is a, c, g, or t
  modified_base (539)..(540): a, c, t, g, unknown or other
  misc_feature (539)..(540): n is a, c, g, or t
tcagatagagtactcacgaccggtgctcgatttagtgtgagtagtttgggtttgggggcgcctgggtacggccggggggtcgcctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaaatggagagcctgagactcgacgacacggccgtctattatgtgttaaaggcgagctggaatacgggaccgggcccgacttgaccacgtggggccagggggacgctggtcaccgtctcctcagcctccaccaaggcccatcggtcttccccctggccaccctcctccaacgacgcaccgtctcggggcacagcagccctgggctgccgtgtcaacggactactccagtactctatctgaggcggctggctaaggcganatgnn

SEQ ID NO: 53109 - DNA, 540 bp, Homo sapiens
  misc_feature: GYAE6OF01C3B59.29.78.H01.1.454.CMB.1.raw
  modified_base (426)..(426): a, c, t, g, unknown or other
  misc_feature (426)..(426): n is a, c, g, or t
  modified_base (438)..(438): a, c, t, g, unknown or other
  misc_feature (438)..(438): n is a, c, g, or t
  modified_base (452)..(452): a, c, t, g, unknown or other
  misc_feature (452)..(452): n is a, c, g, or t
  modified_base (456)..(456): a, c, t, g, unknown or other
  misc_feature (456)..(456): n is a, c, g, or t
  modified_base (518)..(518): a, c, t, g, unknown or other
  misc_feature (518)..(518): n is a, c, g, or t
  modified_base (538)..(540): a, c, t, g, unknown or other
  misc_feature (538)..(540): n is a, c, g, or t
tcagatagagtactcacgaccggtgctcgatttagtgtgagtagtttgggtttggggcgcctgggtacggccgggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccgggccgacttgaccactggggccaggggacgctggtcaccgtctcctcagccccacacgaccgctgtcgtccctccgcgccnccctccacagcncctctcgggcgcancgcnccgtcggcgcgcgtccgtgacgaaccgtacttcctacacgtcctatacgtcgagacgggcgngtcgaacgacggccatacgnnn

SEQ ID NO: 53110 - DNA, 166 bp, Homo sapiens; identical to SEQ ID NO: 53060
  misc_feature: GYAE6OF01ES3GV.29.78.H01.1.454.CMB.1.raw
  modified_base (166)..(166): a, c, t, g, unknown or other
  misc_feature (166)..(166): n is a, c, g, or t

SEQ ID NO: 53111 - DNA, 683 bp, Homo sapiens
  misc_feature: GYAE6OF01B91H9.29.78.H01.1.454.CMB.1.raw
  modified_base (183)..(183): a, c, t, g, unknown or other
  misc_feature (183)..(183): n is a, c, g, or t
  modified_base (239)..(239): a, c, t, g, unknown or other
  misc_feature (239)..(239): n is a, c, g, or t
  modified_base (274)..(274): a, c, t, g, unknown or other
  misc_feature (274)..(274): n is a, c, g, or t
tcagatagagtactcacgaccggtgctcgatttagtgtgagtagtttgggtttggggtctgagagaggagtccacccctgggatcttcaggtgttttcatttggtgatcaggacggaacagagagaactcaccatggagtttgggctgagcggtgtgttctaggtcggctaatttaaaaggtntcagtgtgacgtgcagttggtggagtctggggcgccttgggtacgccggggggtcncgtgagactctctgtgcgctgtgtattaagttagngtctatgcatagtacgtcggtccgcgcgcgcgaggagggcgtggtggtggtcgtcggtcgtagtaggtgtcgtaggtggtggcgtctatatattagtgtcgagacgccgtacggtacgggtaccggtaccgtactacgttactacgtacgtaactaacgtaacgtaacgaacgtacgtacgtagtactacgtagtaacgtaaacgtaggagtacgtaccgtacgacgtaacgtacgtaacgaccgtaccggtaccgttacgttaacgtttaacgttacggttaaggttaacggtaacggtacggtacggtaacggtaaacggtaaccggggtaacccggggtacccggtaccggttacggtaccggtaccggtacggggaccgggacggggaccggtcggtcggtaccg

SEQ ID NO: 53112 - DNA, 513 bp, Homo sapiens
  misc_feature: GYAE6OF01EPOEJ.29.78.H01.1.454.CMB.1.raw
tcagatagagtactcacgaccggtgctcgatttagtgtgagtagtttgggtttggggtccgagccatggtgcagactccccagagctctcctcctcctccactgcacagggtctctctcccagcctgtgctgactcaatcgccctctgcctctgcctccctgggaggctcggtcaaggtcacctgtactctgagcagtggacacagcagctacgccatcgcttggcatcagcagaggccagacacgggccctcgttacttgatgacagtcaacaatgatggcagtcacagcgaagggggacggatccctgatcgcttctcagtctcagctctgggcctgagcgctacctcacaatctccggcctccagtctgaggatgagctgactatactgtcagaccgtggggcacgtggctattcgaggtccttcgggaccgggaccaacggtccaccgtcggtccggtcacggcccgaacggcccaaccccgtactcgtaccacttcctcgttaccccc

SEQ ID NO: 53113 - DNA, 529 bp, Homo sapiens
  misc_feature: GYAE6OF01DMRVL.29.78.H01.1.454.CMB.1.raw
  modified_base (154)..(154): a, c, t, g, unknown or other
  misc_feature (154)..(154): n is a, c, g, or t
  modified_base (180)..(180): a, c, t, g, unknown or other
  misc_feature (180)..(180): n is a, c, g, or t
  modified_base (215)..(215): a, c, t, g, unknown or other
  misc_feature (215)..(215): n is a, c, g, or t
  modified_base (234)..(234): a, c, t, g, unknown or other
  misc_feature (234)..(234): n is a, c, g, or t
  modified_base (257)..(257): a, c, t, g, unknown or other
  misc_feature (257)..(257): n is a, c, g, or t
  modified_base (288)..(288): a, c, t, g, unknown or other
  misc_feature (288)..(288): n is a, c, g, or t
  modified_base (294)..(294): a, c, t, g, unknown or other
  misc_feature (294)..(294): n is a, c, g, or t
  modified_base (302)..(303): a, c, t, g, unknown or other
  misc_feature (302)..(303): n is a, c, g, or t
  modified_base (306)..(306): a, c, t, g, unknown or other
  misc_feature (306)..(306): n is a, c, g, or t
  modified_base (308)..(308): a, c, t, g, unknown or other
  misc_feature (308)..(308): n is a, c, g, or t
  modified_base (316)..(316): a, c, t, g, unknown or other
  misc_feature (316)..(316): n is a, c, g, or t
  modified_base (318)..(318): a, c, t, g, unknown or other
  misc_feature (318)..(318): n is a, c, g, or t
  modified_base (325)..(325): a, c, t, g, unknown or other
  misc_feature (325)..(325): n is a, c, g, or t
  modified_base (334)..(334): a, c, t, g, unknown or other
  misc_feature (334)..(334): n is a, c, g, or t
  modified_base (370)..(370): a, c, t, g, unknown or other
  misc_feature (370)..(370): n is a, c, g, or t
  modified_base (394)..(394): a, c, t, g, unknown or other
  misc_feature (394)..(394): n is a, c, g, or t
  modified_base (403)..(403): a, c, t, g, unknown or other
  misc_feature (403)..(403): n is a, c, g, or t
  modified_base (405)..(405): a, c, t, g, unknown or other
  misc_feature (405)..(405): n is a, c, g, or t
tcagatagagtactcacgaccggtgctcgatttagtgtgagtagtttgggtttggggtctgagagaggagtccacccctgggatcttcaggtgttttcatttggtgatcaggacggaacagagagaactcaccatggagtttgggctgagcggngtgtttctaggtggctatttaaaggngtcagtgtgacgtgcagttggtggagtctggggcnctgggacggcggggggtcncgtgagctctcctgtgcggcctntggattaagtttgagtcatgcatgactggcncagtcncaggaggnnggngnggtctcgntntagtgangtgagcatntatatatgcagacgcctgaaggcgtcgacattccanagacaattacgaagaacaacgctntatatgaananagagagactgagactacgacgacgacgtacgtacgtattattagttagtaagtagagacgtagaacggtacgggaccgggaccggtcgtacgtacgtacgtcggacggacggacggcgtcgtcg

SEQ ID NO: 53114 - DNA, 530 bp, Homo sapiens
  misc_feature: GYAE6OF01A7I4O.29.78.H01.1.454.CMB.1.raw
  modified_base (379)..(379): a, c, t, g, unknown or other
  misc_feature (379)..(379): n is a, c, g, or t
  modified_base (525)..(525): a, c, t, g, unknown or other
  misc_feature (525)..(525): n is a, c, g, or t
  modified_base (530)..(530): a, c, t, g, unknown or other
  misc_feature (530)..(530): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccgggcccgacttgaccactggggccagggggacnctggtcaccgtctcctcagcctcaccaaggcccatcgtctcccctgcaccctctccacgacgcacctctcggggcacagcacgccctgggctcgcctggtcaaggactacttccagtactctatctgagcgggctggcaaggcganatagn

SEQ ID NO: 53115 - DNA, 566 bp, Homo sapiens
  misc_feature: GYAE6OF01D7VBL.29.78.H01.1.454.CMB.1.raw
  modified_base (561)..(561): a, c, t, g, unknown or other
  misc_feature (561)..(561): n is a, c, g, or t
  modified_base (565)..(566): a, c, t, g, unknown or other
  misc_feature (565)..(566): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccggggcccgacttgaccactggggccagggggacgctggtcaccgtctcctcagccctccaccaagggcccatccggtccttccccctcggcccaccctccctcccaacgacgccaccctcgtcgggggccacacgcacgccccgtggggcctcgcccgtggtccaaggaccttaccttccagtacctctactctgaggcgggctggcgaaggcgnatgnn

SEQ ID NO: 53116 - DNA, 514 bp, Homo sapiens
  misc_feature: GYAE6OF01DPA4H.29.78.H01.1.454.CMB.1.raw
  modified_base (266)..(266): a, c, t, g, unknown or other
  misc_feature (266)..(266): n is a, c, g, or t
  modified_base (307)..(307): a, c, t, g, unknown or other
  misc_feature (307)..(307): n is a, c, g, or t
  modified_base (432)..(432): a, c, t, g, unknown or other
  misc_feature (432)..(432): n is a, c, g, or t
  modified_base (510)..(511): a, c, t, g, unknown or other
  misc_feature (510)..(511): n is a, c, g, or t
tcagatagagtactcacgaccggtgctcgatttagtgtgagtagtttgggtttggtgggtctctctcccagcctgtgctgactcaatcgccctctgcctctgccctccctgggaggctcggtcaaggtcacctgtactctgagcagtggacacagcagctacgccatcgcttggcatcagcagaggccagacgacgggccctgttactgatgacagtcaaacatgatggcagtcacagcgaagggggcggactcctgatcgcttcncagtctccagctcgtgggcctgacgcgctacctcacaatcnccggcctcagtctgagatgaggctagactattactgtcagaccgtgggctacgtggactagttcgaggttccttacgggaccgggacaaggtccacgtcgtcgtacacgcccaaggcccaacccntacgtccacttcctccgttcccgcctcctactacgtacctctatcgtcggagcggtctggacaacggtcacagtacgnngcg

SEQ ID NO: 53117 - DNA, 615 bp, Homo sapiens
  misc_feature: GYAE6OF01CNQ1K.29.78.H01.1.454.CMB.1.raw
  modified_base (613)..(614): a, c, t, g, unknown or other
  misc_feature (613)..(614): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacggggaccgggcccgacttgaccacgtggggccagggggacgcgtggtccaccgtctcctcacgccctccaccgaacgggcccacgtccggtccttcccccgtcggccctacccctccctacccaacgacgccacccgtccgtcgggggccacgacgccacgccccgtcgggcctcggcccgtcggtaccgaacggtaccttaccgttcccacgttaccttcctacgttccgtaggacggtccgggcgtgggaccgaacgggccgacaactgnng

SEQ ID NO: 53118 - DNA, 542 bp, Homo sapiens
  misc_feature: GYAE6OF01D876O.29.78.H01.1.454.CMB.1.raw
  modified_base (521)..(521): a, c, t, g, unknown or other
  misc_feature (521)..(521): n is a, c, g, or t
tcagatagagtactcacgaccggtgctcgatttagtgtgagtagtttgggtttggagtctgcaccatggctcggaccccactcctcttcctcaccctcctcctccactgcacagggtctctctcccagcctgtgctgactcaatcgccctctgcctctgccctccctgggaggctcggtcaaggtcacctgtactctgagcagtggacacagcagctacgccatcgcttggcatcagcagaggccagacacgggccctgttactgatgacagtcaaacaatgatggcagtcacaggacgaagggggacggatcccgtgatccgcttctcagtctccagctcgtgggcctgacgcgctacctcactaactccgtcccggcctccagtctgaggtatggagctagacttattacgtgtcagtaccgtggggaccacgtggactagttcgaggttccgttacgggaccgggactacgggtccaccggtcgtcggtcacgaccccgaaacggccccaaacccgtntcgtctaccgtccgttacccg

SEQ ID NO: 53119 - DNA, 538 bp, Homo sapiens
  misc_feature: GYAE6OF01CLEKT.29.78.H01.1.454.CMB.1.raw
  modified_base (533)..(533): a, c, t, g, unknown or other
  misc_feature (533)..(533): n is a, c, g, or t
  modified_base (537)..(538): a, c, t, g, unknown or other
  misc_feature (537)..(538): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccggggccgacttgaccactggggccagggggacgctggtcaccgtctcctcagcctccaccaggcccatcgtcttccccctggccaccctcctaccaagacgccacctctcggggccacacgcagccctgggctgcctggtcaacggactacttccagtactctatctgagcggcgtggcaaggcganatgnn

SEQ ID NO: 53120 - DNA, 681 bp, Homo sapiens
  misc_feature: GYAE6OF01DHCN3.29.78.H01.1.454.CMB.1.raw
  modified_base (182)..(182): a, c, t, g, unknown or other
  misc_feature (182)..(182): n is a, c, g, or t
  modified_base (187)..(187): a, c, t, g, unknown or other
  misc_feature (187)..(187): n is a, c, g, or t
  modified_base (189)..(189): a, c, t, g, unknown or other
  misc_feature (189)..(189): n is a, c, g, or t
  modified_base (193)..(194): a, c, t, g, unknown or other
  misc_feature (193)..(194): n is a, c, g, or t
  modified_base (200)..(200): a, c, t, g, unknown or other
  misc_feature (200)..(200): n is a, c, g, or t
  modified_base (202)..(202): a, c, t, g, unknown or other
  misc_feature (202)..(202): n is a, c, g, or t
  modified_base (207)..(207): a, c, t, g, unknown or other
  misc_feature (207)..(207): n is a, c, g, or t
  modified_base (211)..(211): a, c, t, g, unknown or other
  misc_feature (211)..(211): n is a, c, g, or t
  modified_base (223)..(224): a, c, t, g, unknown or other
  misc_feature (223)..(224): n is a, c, g, or t
  modified_base (226)..(226): a, c, t, g, unknown or other
  misc_feature (226)..(226): n is a, c, g, or t
  modified_base (260)..(260): a, c, t, g, unknown or other
  misc_feature (260)..(260): n is a, c, g, or t
  modified_base (303)..(303): a, c, t, g, unknown or other
  misc_feature (303)..(303): n is a, c, g, or t
tcagatagagtactcacgaccggtgctcgatttagtgtgagtagtttgggtttggggtctgagagaggagtccacccctgggatcttcaggtgttttcatttggtgatcaggacggaacagagagaactcaccatggagtttgggctgagcggcgtggttctaaggcggctaatttaaaggncagtngngtgnngtgtgngngtggngcgnggcggcgggcgnngngctctctgtgcgctcgtgtagttagttagtagtnatgcatagtacgtcggtcgcgacgcgtcgagggagggcgtggnggtggtcgtcggtcgtagtagtggtcgtaggtggtggtcgtcgtagtattattagtagtacgacgaccgtaccgtacggtaacgggtaccggttaccgtaccgtacgttaccgtacgaacgtaacgtaacgtaacgaaacgtaacgaacgtacgtacgtaacgtacgtacgtaacgtaaacggtaggacgacgtaccgtacgtacgtaccgtaccggaaccgaaccgtaccggtaccgttacgttaacgtttagttaggttacggttaaggtacggtacgtacggtacgggtaacgggtaaccggggtacccggggtacccggtaccgttacgtaccgtaccggtacgggaccgggacgggacggtcggtcggtaccg

SEQ ID NO: 53121 - DNA, 686 bp, Homo sapiens
  misc_feature: GYAE6OF01B0M4Z.29.78.H01.1.454.CMB.1.raw
  modified_base (394)..(394): a, c, t, g, unknown or other
  misc_feature (394)..(394): n is a, c, g, or t
tcagatagagtactcacgaccggtgctcgatttagtgtgagtagtttgggtttgggggtcggcctgggtacggccggggggtcgctgagacctctcctgtgcggtcctctggattaagttttaggagtcatgccatgaactggggtccgccaggctccgagggaaggggctggagtgggtcttcggctattagtggtcagtggtggcgctatatattatgcagacgccctggaagggccgttcaccatttccaggacgacaattcgaagacacgctgtatctgctaaactggagtagcctgagactcgacgacacggcgtctattagtgtgttaaaggcgagctaggaatacgggaccgggccgacgttgaccgaactggggaccagggggacncgtggtccaccgtctccgtacgacgtccctccaccgtaacgggcccacgtccggtaccttaccccccgtacggacccacccctccgtaccgaacgacgcctaacccgtccgtacgggggtccaaccgacggaccaacggccccgtcggggaccgtcggacccgttcgggtacctaaacgggtacctaaccgttcccgaacggttaacccttacgtaacgtccggttagggtacgggtcccggggtaccgtacgggaccgtaacggggcccgtaccggaacgttacggctacg

SEQ ID NO: 53122 - DNA, 563 bp, Homo sapiens
  misc_feature: GYAE6OF01CS8VI.29.78.H01.1.454.CMB.1.raw
  modified_base (325)..(325): a, c, t, g, unknown or other
  misc_feature (325)..(325): n is a, c, g, or t
  modified_base (362)..(362): a, c, t, g, unknown or other
  misc_feature (362)..(362): n is a, c, g, or t
  modified_base (541)..(541): a, c, t, g, unknown or other
  misc_feature (541)..(541): n is a, c, g, or t
tcagatagagtactcacgaccggtgctcgatttagtgtgagtagtttgggtttggggtccgagccatggtgcagactccccagagctctcctcctcctccactgcacagggtctctctcccagcctgtgctgactcaatccgccctctgcctctgccctcccgtgggaggctcggtcaaggtcacctgtactctgagcagtggacacagcagctacgccatcgcttggcatcagcagaggccagacacgggccctgttactgatgacagtcaaacaatgatggcagtcacgaggacgaagggggacggatccctgactcgcttcncagtctccagctcgtgggcctgacgccgtactacccncaacactcccgtacccggcctccgagtctggaggtatggagctagtacttatactgtacgaggtaccgtggggacacgtggactagttcgaggttccgtaccgggaccgggactaaggtccctaccggtcggtccggacacggaccccgaacgggaccccaaccccgtgtccggtaccnccgttccgtcccggttaccccc

SEQ ID NO: 53123 - DNA, 545 bp, Homo sapiens
  misc_feature: GYAE6OF01D3TPZ.29.78.H01.1.454.CMB.1.raw
  modified_base (540)..(540): a, c, t, g, unknown or other
  misc_feature (540)..(540): n is a, c, g, or t
  modified_base (544)..(545): a, c, t, g, unknown or other
  misc_feature (544)..(545): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccggggcccgacttgaccacgtggggccagggggacgctggtcaccgtctcctcagcctccaccacgggcccatccggtccttccccctcggccacccctcctccaacgacgcaccctcgtcggggcacagcagcccgtgggctgcctggcaaggactacttccagtactctatctgaggcgggctggcacggcgnatgnn

SEQ ID NO: 53124 - DNA, 543 bp, Homo sapiens
  misc_feature: GYAE6OF01ECRIY.29.78.H01.1.454.CMB.1.raw
tcagatagagtactcacgaccggtgctcgatttagtgtgagtagtttgggtttgggtctgagagaggagtccacccctgggatcttcaggtgtttcatttggtgatcaggacggaacagagagaactcaccatggagtttgggctgagctggcttttcttgtggctattttaaaaggtgtccagtgtgacgtgcagttggtggagtctgggggcgcctggggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccgttcaccatttccagagacaattcgaagaacacgctgtatctgcaaatggagagcctgagactcgacgacacggccgtctattattgtgtaaaggcgagctggaagtcgggaccgggccgacttgaccacgtggggaccaggggacgcgtggtccg

SEQ ID NO: 53125 - DNA, 557 bp, Homo sapiens
  misc_feature: GYAE6OF01D2EN4.29.78.H01.1.454.CMB.1.raw
tcagatagagtactcacgaccggtgctcgatttagtgtgagtagtttgggtttggggtctgagagaggagtccacccctgggatcttcaggtgttttcatttggtgatcaggacggaacagagagaactcaccatggagtttgggctgagctggctttttcttgtggctattttaaaaggtgtccagtgtgacgtgcagttggtggagtctgggggcgcctggggtacggccgggggggtcgctgagactctcctgtgcggcctctggattaagttttaggagtcatgccatgaactgggtccgccaggctccagggaaggggctggagtggggtctcggctattagtggcagtggtggcgctatatattatgcagacgccctgaagggcccggttcaccatttccagagacaattcgaagaacacgctgtatctgcaaatggagagcctgagactcgacgacacggccgtctattattgtgttaaaggcgagctaggaagtcggggaccgggcccgacgttcgaccacgtcggggccgaggggacgcgtggtcccg

SEQ ID NO: 53126 - DNA, 548 bp, Homo sapiens
  misc_feature: GYAE6OF01D3MHT.29.78.H01.1.454.CMB.1.raw
  modified_base (547)..(548): a, c, t, g, unknown or other
  misc_feature (547)..(548): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccggggcccgacttgaccacgtggggccagggggacgcgtggtcaccgtctcctcagcctccaccaacgggcccatccggtccttccccctggcccaccctccctccaagacgcacctcgtcggggcacagcacgccctgggcctgcctggtcaaggactacttccagtacctctatctgaggcgggctggcaggcgcatgnn

SEQ ID NO: 53127 - DNA, 482 bp, Homo sapiens
  misc_feature: GYAE6OF01DWM2R.29.78.H01.1.454.CMB.1.raw
  modified_base (265)..(265): a, c, t, g, unknown or other
  misc_feature (265)..(265): n is a, c, g, or t
  modified_base (413)..(413): a, c, t, g, unknown or other
  misc_feature (413)..(413): n is a, c, g, or t
  modified_base (479)..(480): a, c, t, g, unknown or other
  misc_feature (479)..(480): n is a, c, g, or t
  modified_base (482)..(482): a, c, t, g, unknown or other
  misc_feature (482)..(482): n is a, c, g, or t
tcagatagagtactcacgaccggtgctcgatttagtgtgagtagtttgggtttggtggtctctctcccagcctgtgctgactcaatcgccctctgcctctgcctccctgggaggctcggtcaaggtcacctgtactctgagcagtggacacagcagctacgccatcgcttggcatcagcagaggccagacacgggccctcgttacttgatgacagtcaacaatgatggcagtcacagcaagggggacggatccctgatcgcttcncagtctccagctctgggcctgagcgctacctcacaatctccggcctcagtctgagatgagctgactatactgtcagacctggggcactggcattcaggtctcggaccgggacaaggtcacgtcgtcgtcacgcccaaggcccaacccnctcgtcacctctcgttcccaccctcctcacgtactctatcgtgagcgggctggcaaggcacatagnngn

SEQ ID NO: 53128 - DNA, 522 bp, Homo sapiens
  misc_feature: GYAE6OF01DKLZA.29.78.H01.1.454.CMB.1.raw
  modified_base (385)..(385): a, c, t, g, unknown or other
  misc_feature (385)..(385): n is a, c, g, or t
  modified_base (502)..(502): a, c, t, g, unknown or other
  misc_feature (502)..(502): n is a, c, g, or t
  modified_base (505)..(505): a, c, t, g, unknown or other
  misc_feature (505)..(505): n is a, c, g, or t
tcagatagagtactcacgaccggtgctcgatttagtgtgagtagtttgggtttggggtccgagccatggtgcagactccccagacgctctcctcctcctccactgcacaggggtctctctcccagcctgtgctgactcaatcgccctctgcctctgcctcccgtggggaggctcggtcaaggtcacctgtactctgagcagtggacacagcagctacgccatcgcttggcatcagcagaggccagacacgggccctgttacttgatgacagtcaacaatgatggcagtcaacaggcgaaggggggacgggatcccgtgactcgcttctcagttcctccagtctcgtgggcctgagcgctactcacaatctccggcctcagtctgngatgaggctgtactattactgtcagaccgtggggcacgtggctattcgaggttcgttcgggaccgggaaccaagggtccaccggtcggtcggtacacggcccgaaggcccaaccctntcncacctcgtcgtcccccg

SEQ ID NO: 53129 - DNA, 541 bp, Homo sapiens
  misc_feature: GYAE6OF01DBP76.29.78.H01.1.454.CMB.1.raw
  modified_base (536)..(536): a, c, t, g, unknown or other
  misc_feature (536)..(536): n is a, c, g, or t
  modified_base (540)..(541): a, c, t, g, unknown or other
  misc_feature (540)..(541): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccggggcccgacttgaccactgggggccagggggacgctggtcaccgtctcctcagcctccaccagggcccatcggtccttccccctggccaccctccctccaacgacgcaccctcgtgggggccacacgcacgccctgggctgcctggtcaaggctacttccagtactctatctgagcggctggcaggcgnatgnn

SEQ ID NO: 53130 - DNA, 582 bp, Homo sapiens
  misc_feature: GYAE6OF01EAEJS.29.78.H01.1.454.CMB.1.raw
  modified_base (181)..(181): a, c, t, g, unknown or other
  misc_feature (181)..(181): n is a, c, g, or t
  modified_base (264)..(264): a, c, t, g, unknown or other
  misc_feature (264)..(264): n is a, c, g, or t
  modified_base (341)..(341): a, c, t, g, unknown or other
  misc_feature (341)..(341): n is a, c, g, or t
  modified_base (359)..(359): a, c, t, g, unknown or other
  misc_feature (359)..(359): n is a, c, g, or t
tcagatagagtactcacgaccggtgctcgatttagtgtgagtagtttgggtttggggtctgagagaggagtccacccctgggatcttcaggtgttttcatttggtgatcaggacggaacagagagaactcaccatggagtttgggctgagcgtgtgtttctaggtggctattttaaaaggngtcagtgtgacgtgcagttggtggagtctgggggcgccgtggggtacggccgggggggtcgctgagctctcctgtgcggcctntggattaagttttaggagtcatgccatgaactgggtccgccaggctccaggggaaggggctgggagtggggctcggntattagtgcagtggtggngctatatattatgcagacgccctgaagggccggttcaccatttccagagacaattacgaagaacaacgctgtatctgacaaatagagagacctgagactacgacgacgaccggccggtaccttatttattagttagttaaaggtacgagcgtaggaaggtaacgggaccggggacccggccgttacgaccgaccgtcggggccggagggacggcgtggtcccg

SEQ ID NO: 53131 - DNA, 548 bp, Homo sapiens
  misc_feature: GYAE6OF01AL6RC.29.78.H01.1.454.CMB.1.raw
  modified_base (543)..(543): a, c, t, g, unknown or other
  misc_feature (543)..(543): n is a, c, g, or t
  modified_base (547)..(547): a, c, t, g, unknown or other
  misc_feature (547)..(547): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccggggccgacttgaccactggggccagggggacgctggtcaccgtctcctcagcctccaccaagggcccatcggtcttccccctcggcaccctcctccaacgacgcaccctctcggggcacgacgcacgccctgggcctgtccgtcggtcaacggactacttccagtacctctactctgagcgggctggcacggcgcntagnc

SEQ ID NO: 53132 - DNA, 714 bp, Homo sapiens
  misc_feature: GYAE6OF01D055P.29.78.H01.1.454.CMB.1.raw
  modified_base (711)..(711): a, c, t, g, unknown or other
  misc_feature (711)..(711): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaaggccggttcaccatttccagagacaattcgaagaacacgctgtatctgcaaatggagagcctgagacctcgacgacgacggccgtacttatttagttgttaggttaaacggacgagtcgtaggtaaacggtaccgggggacccggggacccgtacgttacggaacccgtacggtcggggaccggacggggaccgtcgtcggtaccgtacccgttcctccctcgaccgtccctacccgaaccggaaccgggccctaacgttcccggttccccttcccccgtcggaccccctaccccgtccctaccgaacggacgaccctaacccgtcgggtcggggaccacgacgccgaccggtcccggtcgggtcctcggtcccgtacggtaaccgaacggtaccttacccgttaccgtaacgttacccttacttacgtccgtaggaccgggtccgggtccgtacgggaaccggtaacgggccgacgtaacgtagngcg

SEQ ID NO: 53133 - DNA, 432 bp, Homo sapiens
  misc_feature: GYAE6OF01DLFKX.29.78.H01.1.454.CMB.1.raw
  modified_base (357)..(357): a, c, t, g, unknown or other
  misc_feature (357)..(357): n is a, c, g, or t
  modified_base (412)..(412): a, c, t, g, unknown or other
  misc_feature (412)..(412): n is a, c, g, or t
  modified_base (418)..(432): a, c, t, g, unknown or other
  misc_feature (418)..(432): n is a, c, g, or t
tcagatagagtactcacgaccggtgctcgatttagtgtgagtagtttgggtttgggaggctcggtcaaggtcacctgtactctgagcagtggacacagcagctacgccatcgcttggcatcagcagaggccagacacgggccctcgttacttgatgacagtcaacaatgatggcagtcacagcaagggggacggatccctgatcgcttctcagtctccagctctgggcctgagcgctacctcacaatctccggcctccagtctgagatgagctgacttatactgtcagacctgggcactggcattcagtctcggaccgggacaggtcacgtcgtcggtcagcccaagcccaaccccntcgccactcctcgtccccgcctcctcacgtactctatctgagcggctggcaggcncatagnnnnnnnnnnnnnnn

SEQ ID NO: 53134 - DNA, 560 bp, Homo sapiens
  misc_feature: GYAE6OF01A17V1.29.78.H01.1.454.CMB.1.raw
  modified_base (555)..(555): a, c, t, g, unknown or other
  misc_feature (555)..(555): n is a, c, g, or t
  modified_base (559)..(560): a, c, t, g, unknown or other
  misc_feature (559)..(560): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattatgtgttaaaggcgagctggaatacgggaccggggccgacttgaccactggggccaggggacgctggtcaccgtctcctcagccctccaccaagggcccatccggtcttcccccctcggccaccctcctcccaacgacgccaccctccgtcgggggccaccgagccacggccccgtagggcctcggcccgtggtccaaggacctacttccagtactctatctgagcgggctggcacggcgnatgnn

SEQ ID NO: 53135 - DNA, 531 bp, Homo sapiens
  misc_feature: GYAE6OF01EEP8T.29.78.H01.1.454.CMB.1.raw
  modified_base (509)..(509): a, c, t, g, unknown or other
  misc_feature (509)..(509): n is a, c, g, or t
  modified_base (526)..(526): a, c, t, g, unknown or other
  misc_feature (526)..(526): n is a, c, g, or t
  modified_base (530)..(531): a, c, t, g, unknown or other
  misc_feature (530)..(531): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccgggccgacttgaccactggggccagggggacgctggtcaccgtctcctcagcctccaccaagggcccatcgtccttccccctggcaccctcctccaacgagccacctctggggcacagcagccctgggctgcctggtcaaggctactccagtactctatctgngcgggctggcaaggcgnatgnn

SEQ ID NO: 53136 - DNA, 510 bp, Homo sapiens
  misc_feature: GYAE6OF01DOTPX.29.78.H01.1.454.CMB.1.raw
  modified_base (492)..(492): a, c, t, g, unknown or other
  misc_feature (492)..(492): n is a, c, g, or t
  modified_base (508)..(510): a, c, t, g, unknown or other
  misc_feature (508)..(510): n is a, c, g, or t
tcagatagagtactcacgaccggtgctcgatttagtgtgagtagtttgggtttggtggtctctctcccagcctgtgctgactcaatcgccctctgcctctgcctccctggggaggctcggtcaaggtcacctgtactctgagcagtggacacagcagctacgccatcgcttggcatcagcagaggccagacacgggccctcgttacttgatgacagtcaaacaatgatggcagtcacaggcgaaagggggacggatccctgatcgcttctcagtcctccagctcgtgggcctgagcgctacctcacaatcctccggcctcagtctgaggatgaggctgacttatactgtacagaccgtggggcacgtggctattcgaggtcgttcgggaaccggggaccaacggtccaccgtcgtcggtcacgacccaacggcccaaccccactcgtcactctcgttccccgccctctcacgtactctatcgtgagcgggcnggacaacggcacatgnnn

SEQ ID NO: 53137 - DNA, 569 bp, Homo sapiens
  misc_feature: GYAE6OF01BXI7V.29.78.H01.1.454.CMB.1.raw
  modified_base (564)..(564): a, c, t, g, unknown or other
  misc_feature (564)..(564): n is a, c, g, or t
  modified_base (568)..(569): a, c, t, g, unknown or other
  misc_feature (568)..(569): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccggggcccgacttgaccactggggccagggggacgctggtcaccgtctcctcagccctccaccaacgggcccactcggtccttccccctcggcccaccctcctcccaacgacgccaccctccgtcgggggccaccgacgccacgccccgtggggcctcggcccgtcggtccaacgacctacttccagtacctctatctgaggcgggctggcaaggcganatgnn

SEQ ID NO: 53138 - DNA, 690 bp, Homo sapiens
  misc_feature: GYAE6OF01BKGQA.29.78.H01.1.454.CMB.1.raw
  modified_base (687)..(687): a, c, t, g, unknown or other
  misc_feature (687)..(687): n is a, c, g, or t
tcagatagagtactcacgaccggtgctcgatttagtgtgagtagtttgggtttgggggtcggcctgggtacggccggggggtcgctcgagactctcctgtgcggcctctggattaagtttaggagtcatgccatgaactggtccgccaggctccgagggaaggggcgtggagtgggtcgtcggctattagtggcagtggtggcgctatatattatgcagacgcctgaagggccgttcaccatttccagagacaattcgaagaacacgctgtatctgacaaagtggagagcctagagactcgacgacacggccgtcttattattgtagttaaaggcgagcgtaggaagtacgggaccggggcccgacttcggaccacgtcgggggccgaggggacgcgtcggtccaccggtctccgtacacgtccctaccgaacccgaacgggccccctagttcccgggttccctttccccccgtcggcccctaccccgtcccgtaccgaaacgaccgccctaacccgtcggtacgggggccaacgacgccgacggtcccgtcgggccgtcggtccgtcggtacgaaacggtacccttaccgttaccgtaacgttaccttaccttaacgttccgttaggaacgggtccggggtacccgttcggggaacccggtaaacgggcccgacgtaacgttaggntcg

SEQ ID NO: 53139 - DNA, 557 bp, Homo sapiens
  misc_feature: GYAE6OF01ENT48.29.78.H01.1.454.CMB.1.raw
  modified_base (552)..(552): a, c, t, g, unknown or other
  misc_feature (552)..(552): n is a, c, g, or t
  modified_base (556)..(557): a, c, t, g, unknown or other
  misc_feature (556)..(557): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccggggcccgacttgaccacgtggggccagggggacgctggtcaccgtctcctcagccctccaccaagggcccatcggtccttcccccgtcggccaccctcctccaacgacgccaccctcgtcgggggccacgacgcacgcccgtcgggcctcgcctggtcaaggacctacttccagtacctctactctgagcgggctggcgaggcgnatgnn

SEQ ID NO: 53140 - DNA, 516 bp, Homo sapiens
  misc_feature: GYAE6OF01BAEHW.29.78.H01.1.454.CMB.1.raw
  modified_base (340)..(340): a, c, t, g, unknown or other
  misc_feature (340)..(340): n is a, c, g, or t
  modified_base (381)..(381): a, c, t, g, unknown or other
  misc_feature (381)..(381): n is a, c, g, or t
  modified_base (414)..(414): a, c, t, g, unknown or other
  misc_feature (414)..(414): n is a, c, g, or t
  modified_base (447)..(447): a, c, t, g, unknown or other
  misc_feature (447)..(447): n is a, c, g, or t
tcagatagagtactcacgaccggtgctcgatttagtgtgagtagtttggggtttggggagagctctggggagtctgcaccatggctcggaccccactcctcttcctcaccctcctcctccactgcacagggtctctctcccagcctgtgctgactcaatcgccctctgcctctgcctccctgggaggctcggtcaaggtcacctgtactctgagcagtggacacagcagctacgccatcgcttggcatcagcagaggccagacacgggcctcgttactgatgacagtcaacaatgatggcagtcaacagacgaagggggacgatcccgtgactcgcttcncagtctcagctcgtgggcctgacgcgctacctcaacatccnccggctcagtctgaggatgagtcagactatacngtacaggaccgtgggacacgtggctagttccgnggtcgtcgggaccgggtacaacgggtccaccggtcgtcggtcacggacccaacggcccctaacccgtcg

SEQ ID NO: 53141 - DNA, 569 bp, Homo sapiens
  misc_feature: GYAE6OF01C77YT.29.78.H01.1.454.CMB.1.raw
  modified_base (564)..(564): a, c, t, g, unknown or other
  misc_feature (564)..(564): n is a, c, g, or t
  modified_base (568)..(569): a, c, t, g, unknown or other
  misc_feature (568)..(569): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacggggaccggggcccgacttgaccacgtggggccagggggacgctggtccaccgtctcctcacgcctccaccaagggcccactccggtccttcccccctcggcccaccctcctcccaacgacgccaccctcgtcggggccacgacgccacgccctcgggctcgccgtggtcaacgggactaccttccacgtacctctatctgacggcgggcgtggcacgggcgnatgnn

SEQ ID NO: 53142 - DNA, 548 bp, Homo sapiens
  misc_feature: GYAE6OF01C5Q2M.29.78.H01.1.454.CMB.1.raw
  modified_base (539)..(539): a, c, t, g, unknown or other
  misc_feature (539)..(539): n is a, c, g, or t
tcagatagagtactcacgaccggtgctcgatttagtgtgagtagtttgggtttggggtctgagagaggagtccacccctgggatcttcaggtgttttcatttggtgatcaggacggaacagagagaactcaccatggagtttgggctgagctggcttttcttgtggctattttaaaaggtgtccagtgtgacgtgcagttggtggagtctgggggcgcctggggtacggccgggggggtcgctgagactctcctgtgcggcctctggattaagtttaggagtcatgccatgaactgggtccgccaggctccgagggaaggggctggagtgggtctcggctatagtggcagtggtggcgctatatattatgcagacgccctgaagggccgttcaccatttccagagacaattcgaagaacacgctgtatctgcaaatggagagcctgagactcgacgacacggccgtctattattgtagttaaggcgagcgtggaagtacgggaccggggccgacttgaccacgtcggggccaggggacngtggtcccg

SEQ ID NO: 53143 - DNA, 213 bp, Homo sapiens
  misc_feature: GYAE6OF01CT9B3.29.78.H01.1.454.CMB.1.raw
  modified_base (173)..(213): a, c, t, g, unknown or other
  misc_feature (173)..(213): n is a, c, g, or t
tcagatagagtactcacgaccggtgctcgatttagtgtgagtagtttgggtttgggggtcgtccactcccgccttgacggggtctgccatcagcccaaggcccaaccccactgtcacctctgttcccgccctcctcagttactctatctgagcgggctggcaaggcgcatagnnnnnnnnnnnnnnnnnnnnnnnnnnnnnnnnnnnnnnnnn

SEQ ID NO: 53144 - DNA, 166 bp, Homo sapiens; identical to SEQ ID NO: 53060
  misc_feature: GYAE6OF01EB0E0.29.78.H01.1.454.CMB.1.raw
  modified_base (166)..(166): a, c, t, g, unknown or other
  misc_feature (166)..(166): n is a, c, g, or t

SEQ ID NO: 53145 - DNA, 547 bp, Homo sapiens
  misc_feature: GYAE6OF01BOKJ3.29.78.H01.1.454.CMB.1.raw
  modified_base (516)..(516): a, c, t, g, unknown or other
  misc_feature (516)..(516): n is a, c, g, or t
  modified_base (546)..(547): a, c, t, g, unknown or other
  misc_feature (546)..(547): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccggggcccgacttgaccactggggccagggggacgctggtcaccgtctcctcagcctccaccaagggcccatccggtcttccccctggccaccctcctccaagacgccacctcgtcgggggccacagccagccctgggctgcctggtcaacggactacttccagtaccctntactctgaggcggctggactaggcgcatgnn

SEQ ID NO: 53146 - DNA, 544 bp, Homo sapiens
  misc_feature: GYAE6OF01C2H42.29.78.H01.1.454.CMB.1.raw
  modified_base (538)..(538): a, c, t, g, unknown or other
  misc_feature (538)..(538): n is a, c, g, or t
  modified_base (543)..(544): a, c, t, g, unknown or other
  misc_feature (543)..(544): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgccaggctccagggaagggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctatattgtgttaaaggcgagctggaatacgggaccgggccgacttgaccactggggccaggggacgctggtcaccgtctcctcagcctccaccaagggcccatccggtccttccccctcggcccaccctccctcccaacgacgccaccctcgtcggggccacacgccacgccctgggctcgcctggtcaaggctacttccagtactctatctgagcggcgtgcacggcncatgnn

SEQ ID NO: 53147 - DNA, 582 bp, Homo sapiens
  misc_feature: GYAE6OF01AL7AX.29.78.H01.1.454.CMB.1.raw
  modified_base (469)..(469): a, c, t, g, unknown or other
  misc_feature (469)..(469): n is a, c, g, or t
  modified_base (563)..(563): a, c, t, g, unknown or other
  misc_feature (563)..(563): n is a, c, g, or t
tcagatagagtactcacgaccggtgctcgatttagtgtgagtagtttgggtttgggggttccgggagccaatggtgcagactccccaggagctctcctcctccgtccactgcgaccagggtctctctcccacgccgtgtcgctgactcaatcggccctcctgcctctgcctcctgggaggctcggtccaaggtcacctcgtactctcgagccacgtggacacagcagctacggccatcgcttggccatcagtcacggaggccagacgacgggcccttcggttaacttgtagtcgacgtagtcaacaactaggaactgggactacgtaccactagcgaagggggacggatcccgtggactcgccttactcgacgtacttccggacgtctcgtgggtcctggacgcgtacgtaccgtcacgaactccgtaccggtcctcctagtcctcgagtctggacgctcgactatacngtcagccgtgggcacgtggtactacgttcgaggttacttcggaaccgggtacaggtccacggtcgtcggtcgacggcccgaacggccaacccgntcgacactcgtggtccccg

SEQ ID NO: 53148 - DNA, 547 bp, Homo sapiens
  misc_feature: GYAE6OF01DR4OV.29.78.H01.1.454.CMB.1.raw
  modified_base (543)..(543): a, c, t, g, unknown or other
  misc_feature (543)..(543): n is a, c, g, or t
  modified_base (546)..(547): a, c, t, g, unknown or other
  misc_feature (546)..(547): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccggggcccgacttgaccacgtggggccagggggacgctggtcaccgtctcctcagcctccaccaagggcccatcggtccttccccctggcaccctcctccaagacgcacctcgtcggggcacgagcacgccctgggctcgcctcggtcaacggactacttccacgtactctactctgagcgggctggcaacggcacntgnn

SEQ ID NO: 53149 - DNA, 550 bp, Homo sapiens
  misc_feature: GYAE6OF01A7ZLB.29.78.H01.1.454.CMB.1.raw
  modified_base (534)..(534): a, c, t, g, unknown or other
  misc_feature (534)..(534): n is a, c, g, or t
  modified_base (545)..(545): a, c, t, g, unknown or other
  misc_feature (545)..(545): n is a, c, g, or t
  modified_base (548)..(548): a, c, t, g, unknown or other
  misc_feature (548)..(548): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattatgtgttaaaggcgagctggaatacgggaccggggccgacttgaccactggggccagggggacgctggtcaccgtctcctcagcctccaccaagggcccatccggtcttcccccctggccaccctccctccaacgacgccaccctccgtgggggccacgacgcacgccctgggcctgcctggtcaaggactacttccagtactctatctgacggcgggcnggcaaggcgantgngc

SEQ ID NO: 53150 - DNA, 556 bp, Homo sapiens
  misc_feature: GYAE6OF01BR27Y.29.78.H01.1.454.CMB.1.raw
  modified_base (552)..(552): a, c, t, g, unknown or other
  misc_feature (552)..(552): n is a, c, g, or t
  modified_base (556)..(556): a, c, t, g, unknown or other
  misc_feature (556)..(556): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacggggaccgggcccgacttgaccacgtggggccagggggacgctggtcaccgtctcctcagccctccaccaacgggcccatccggtccttccccctcggccaccctccctcccaacgacgccaccctccgtcgggggccacacgccacgcccgtgggcctgcctggtcaaggacctacttccacgtactctatctgagcgggctggcaggcgnatgn

SEQ ID NO: 53151 - DNA, 548 bp, Homo sapiens
  misc_feature: GYAE6OF01ACVTN.29.78.H01.1.454.CMB.1.raw
  modified_base (543)..(543): a, c, t, g, unknown or other
  misc_feature (543)..(543): n is a, c, g, or t
  modified_base (547)..(548): a, c, t, g, unknown or other
  misc_feature (547)..(548): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgccaggctccagggaagggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccgggcccgacttcgaccacgtggggccaggggacgctggtcacgtctcctcagcctccaccaacgggcccatcggtccttccccctggccaccctcctccaagacgccacctcgtcggggccacgagccacgccctcgggctcgcccgtggtcaaggactacttccacgtactctagtctgagcggctcggcaaggcanatgnn

SEQ ID NO: 53152 - DNA, 551 bp, Homo sapiens
  misc_feature: GYAE6OF01CH5AR.29.78.H01.1.454.CMB.1.raw
  modified_base (550)..(551): a, c, t, g, unknown or other
  misc_feature (550)..(551): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgccaggctccagggaagggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattatgtgttaaaggcgagctggaatacgggaccggggcccgacttgaccactggggccagggggacgcgtggtcaccgtctcctcagccctccaccaacgggcccatccggtccttccccctgggcccaccctcctcccaagacgccaccctcgtcgggggccacgacgcacgccctgggcctcgcctggtcaaggctactccagtactctactctgagcgggctggcaaggcacatgnn

SEQ ID NO: 53153 - DNA, 512 bp, Homo sapiens
  misc_feature: GYAE6OF01BYE3L.29.78.H01.1.454.CMB.1.raw
  modified_base (265)..(265): a, c, t, g, unknown or other
  misc_feature (265)..(265): n is a, c, g, or t
  modified_base (507)..(507): a, c, t, g, unknown or other
  misc_feature (507)..(507): n is a, c, g, or t
  modified_base (510)..(512): a, c, t, g, unknown or other
  misc_feature (510)..(512): n is a, c, g, or t
tcagatagagtactcacgaccggtgctcgatttagtgtgagtagtttgggtttggtggtctctctcccagcctgtgctgactcaatcgccctctgcctctgcctccctgggaggctcggtcaaggtcacctgtactctgagcagtggacacagcagctacgccatcgcttggcatcagcagaggccagacacgggccctcgttacttgatgacagtcaacaatgatggcagtcacagcaagggggacggatccctgatcgcttcncagtctccagctctgggcctgagcgctacctcacaatctccggcctccagtctgaggatgaggctgactattactgtcagaccgtggggcacgtggcattcgaggtcgttcgggaccggggaccaaggtccaccggtcgtcggtcacgacccaacggcccaacccactcgtctacctcttccgttcccgccctcctccacgtacgttcctacgtcgtcgagcgggcgtcgcgacggcgacanagnnn

SEQ ID NO: 53154 - DNA, 611 bp, Homo sapiens
  misc_feature: GYAE6OF01D6AU1.29.78.H01.1.454.CMB.1.raw
  modified_base (609)..(609): a, c, t, g, unknown or other
  misc_feature (609)..(609): n is a, c, g, or t
  modified_base (611)..(611): a, c, t, g, unknown or other
  misc_feature (611)..(611): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctaggaatacgggaccggggcccgacttcgaccacgtggggccgaggggacgcgtcggtcaccgtctcctcacgcctccaaccgaacgggcccacgtccggtcctttcccccctcgggcccacccctcctcccaacgacgccacccgtcgtcgggggccacgacgccacgcccgtgggcctcgccgtcggtccgaaggaccttaccgttccgaacgttaccgtcttacgtcgtggacggccgggacgtcgggaccgaacgggaccgaccgtataggngn

SEQ ID NO: 53155 - DNA, 570 bp, Homo sapiens
  misc_feature: GYAE6OF01BHPGT.29.78.H01.1.454.CMB.1.raw
  modified_base (252)..(252): a, c, t, g, unknown or other
  misc_feature (252)..(252): n is a, c, g, or t
  modified_base (382)..(382): a, c, t, g, unknown or other
  misc_feature (382)..(382): n is a, c, g, or t
  modified_base (445)..(445): a, c, t, g, unknown or other
  misc_feature (445)..(445): n is a, c, g, or t
  modified_base (560)..(560): a, c, t, g, unknown or other
  misc_feature (560)..(560): n is a, c, g, or t
tcagatagagtactcacgaccggtgctcgatttagtgtgagtagtttgggtttggggggaagaggaagactgacggtccacccctgggatcttcaggtgttttcatttggtgatcaggacggaacagagagaactcaccatggagtttgggctgagcggtgtcgtttctaggtggctaattttaaaaggtgtccagtgtgacgtgcagttggtggagtctgggggcgccgtggggtacggccgggggggtcnctgagctctcctgtgcggctctggattaagttttaggatcatgcatgaactgggtccgccaggctccgaggggaaggggctggagtgggtctcggctattgtggcagtggtgcgctatatatatgcagcncctgaacggcgttcacatttccagagacattacgaagaacacgctgtatctgacaaatggganacgcctgagactcgacgacgaccgggctacttattagttgtaggttaaaggcgtaagcgtaggaacgtacggggacccgggcctacgttgacctaggtcggggaccagggggacngtgggtaccc

SEQ ID NO: 53156 - DNA, 521 bp, Homo sapiens
  misc_feature: GYAE6OF01CUEJI.29.78.H01.1.454.CMB.1.raw
  modified_base (514)..(514): a, c, t, g, unknown or other
  misc_feature (514)..(514): n is a, c, g, or t
  modified_base (519)..(521): a, c, t, g, unknown or other
  misc_feature (519)..(521): n is a, c, g, or t
tcagatagagtactcacgaccggtgctcgatttagtgtgagtagtttgggtttggtggtctctctcccagcctgtgctgactcaatcgccctctgcctctgcctccctgggaggctcggtcaaggtcacctgtactctgagcagtggacacagcagctacgccatcgcttggcatcagcagaggccagacacgggccctcgttacttgatgacagtcaaacaatgatggcagtcacaggcgaagggggacggatccctgatcgcttctcagtctccagccttcgtgggcctagagccgctacctcactaatcctccggcctccagtctagaggtatcggaggctgtaacttatttactgtcagtaccgtggggctacgtggctattcgaggttccgttacgggaccgggacaaggtccaccggtcgtcggcacgcccaaggcccaacccatcgtccacgtctaccgttcccaccctctacacgttactctatcgtggacgcggctggacaggcnaatgnnn

SEQ ID NO: 53157 - DNA, 562 bp, Homo sapiens
  misc_feature: GYAE6OF01B7MHP.29.78.H01.1.454.CMB.1.raw
  modified_base (182)..(182): a, c, t, g, unknown or other
  misc_feature (182)..(182): n is a, c, g, or t
  modified_base (295)..(295): a, c, t, g, unknown or other
  misc_feature (295)..(295): n is a, c, g, or t
  modified_base (345)..(345): a, c, t, g, unknown or other
  misc_feature (345)..(345): n is a, c, g, or t
  modified_base (349)..(349): a, c, t, g, unknown or other
  misc_feature (349)..(349): n is a, c, g, or t
  modified_base (351)..(351): a, c, t, g, unknown or other
  misc_feature (351)..(351): n is a, c, g, or t
  modified_base (368)..(368): a, c, t, g, unknown or other
  misc_feature (368)..(368): n is a, c, g, or t
  modified_base (415)..(415): a, c, t, g, unknown or other
  misc_feature (415)..(415): n is a, c, g, or t
  modified_base (419)..(419): a, c, t, g, unknown or other
  misc_feature (419)..(419): n is a, c, g, or t
  modified_base (424)..(424): a, c, t, g, unknown or other
  misc_feature (424)..(424): n is a, c, g, or t
  modified_base (449)..(449): a, c, t, g, unknown or other
  misc_feature (449)..(449): n is a, c, g, or t
tcagatagagtactcacgaccggtgctcgatttagtgtgagtagtttgggtttggggtctgagagaggagtccacccctgggatcttcaggtgttttcatttggtgatcaggacggaacagagagaactcaccatggagtttgggctgagcggtcgtgttctaggtcggctaatttaaaggngtcagtgtgacgtgcagttggtgagtctggggcgcctgggtacggccgggggtcgctgagactctcctgtgccggcctctaggatttaagtttggatcatgcatgaactggcncaggctccgagggaaggggtctggagtggtctcggctatgtggcagtggnggcntntatatatgcagacgccngaaggcggttcactacttcacgagacaattacgaagaacacgacttntatntaganaagtagagacgtacgtacgacgacncgacgacgacgtcgtacttattagttagtagtaaggtacgagtacgtaggtacggtacgggaccgggaccggtcgtacgtaccgacggtcggacggacggcggtcgtcggtcg

SEQ ID NO: 53158 - DNA, 552 bp, Homo sapiens
  misc_feature: GYAE6OF01BUYNG.29.78.H01.1.454.CMB.1.raw
  modified_base (545)..(545): a, c, t, g, unknown or other
  misc_feature (545)..(545): n is a, c, g, or t
  modified_base (550)..(550): a, c, t, g, unknown or other
  misc_feature (550)..(550): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattatgtgttaaaggcgagctggaatacggggaccggggcccgacttgaccacgtggggccagggggacgctggtcaccgtctcctcagcctccacaacgggcccactcggtccttccccctcggcccaccctcctccaacgacgcacctcgtcgggggcacacgcacgccctcgggctcggcctggtcaaggactacttccagtacctctatctgagcggctggcaacggcgnagtgncg

SEQ ID NO: 53159 - DNA, 622 bp, Homo sapiens
  misc_feature: GYAE6OF01CJXN6.29.78.H01.1.454.CMB.1.raw
  modified_base (382)..(382): a, c, t, g, unknown or other
  misc_feature (382)..(382): n is a, c, g, or t
  modified_base (619)..(619): a, c, t, g, unknown or other
  misc_feature (619)..(619): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgccaggctccgagggaaggggctggagtgggtctcggctattagtggcagtggtggcgctatatattatgcagacgccctgaagggccgttcaccatttccagagacaattcgaagaacacgctgtatctgacaaatggagagcctagagactcgacgacacggccgtctattatgtagttaaaggcgagctaggaatacggggaccgggccgacttgaccacgtggggccaggggacncgtggtcaccgtctcctcagccctccaccgaacggccactcggtccttcccctcggccaccctcctaccaacgcgaccacctcgtcggggcacgagaccgacgcccgtcgggctcggccgtacggttaccgaacgggtacctaaccgttaccgaccgttaaccttacctaacgttccttagggaaccggccggggtccgtacggggtaccgtaaacggggccgaccgtacgtaaggngcg

SEQ ID NO: 53160 - DNA, 552 bp, Homo sapiens
  misc_feature: GYAE6OF01CEODQ.29.78.H01.1.454.CMB.1.raw
  modified_base (547)..(547): a, c, t, g, unknown or other
  misc_feature (547)..(547): n is a, c, g, or t
  modified_base (551)..(552): a, c, t, g, unknown or other
  misc_feature (551)..(552): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtagttaaaggcgagctggaatacgggaccgggccgacttgaccacgtggggccaggggacgctggtcaccgtctcctcagccctccaccaagggcccatcggtccttccccctggccctaccctcctaccaagacgccacctcgtggggccacgagcacgccctcgggctcgcctggtcaacggacctacttccagtacctctatctgacgcgggctggctaaggcanatgnn

SEQ ID NO: 53161 - DNA, 767 bp, Homo sapiens
  misc_feature: GYAE6OF01B4HQ4.29.78.H01.1.454.CMB.1.raw
  modified_base (307)..(307): a, c, t, g, unknown or other
  misc_feature (307)..(307): n is a, c, g, or t
tcagatagagtactcacgaccggtgctcgatttagtgtgagtagtttgggtttggggcgcctgggtacggccgggggtcgggctgagactctcctcgtgcggccgtctggagtaagttttaggtaggcatgccactgaactagggtccggccaggcgtccagggaagggggcgtggaggtgggtcgtcggcgtattagttggcgagtggtggcggctatatattatgcacgacgccctcgaagggccggttccaccatttccagagacaattcgaagaacacgctgtatctgcaaataggagagccngtagactcgcgacacggccgtctatttagttgtgtttaaggacggcgtgtcggaagtaaccggggtaccggggggaccccgtaccttagtaccgacgtcggggggccgacggggacggcctcggtccgtacccgtaccctttccctccgacgtcccgtacccctaccccgaaaccggggacccgaccggtacccggttccccgtttcccccccgttcccgggtaccgaccccctacccccgttaccctaagaacccgggcgaaccccttccggttccgggggccggacgaccggccgaccggcccgttccgggcgtaccgtccggtccgtacggtaacggaaacccgttccgttaaccctacccggtacgttacctttaaccgttccgtggttaaccggggcccggggtacccggttaccggggacgtaaacggggacccggtaccgtacgtaaggctag

SEQ ID NO: 53162 - DNA, 575 bp, Homo sapiens
  misc_feature: GYAE6OF01C38WS.29.78.H01.1.454.CMB.1.raw
  modified_base (559)..(559): a, c, t, g, unknown or other
  misc_feature (559)..(559): n is a, c, g, or t
tcagatagagtactcacgaccggtgctcgatttagtgtgagtagtttgggtttggggggagagaggagtccacccctgggatcttcaggtgttttcatttggtgatcaggacggaacagagagaactcaccatggagtttgggctgagctggctttttctgtggctattttaaaaggtgtccagtgtgacgtgcagttggtggagtctgggggcgcctggggtacggccgggggggtcgctgagactctcctgtgcggcctctggattaagtttaggagtcatgccatgaactgggtccgccaggctccgaggggaagggctgggagtgggtctcggctattaggtggcagtggtggcgctatatattatgcagacgccctggaacgggcgttcacctatttccagagactaatcgaagaacacgctagtatctagacaaatggagagcctgagactcgacgacgacggccgtactattatgtagttaaggcgagcgtggaaacgtaccggggaccggggcccgagttcggacccgacgtcggggcccgaggggaccgngtcggtcgcccgtccg

SEQ ID NO: 53163 - DNA, 195 bp, Homo sapiens
  misc_feature: GYAE6OF01APLE0.29.78.H01.1.454.CMB.1.raw
  modified_base (172)..(195): a, c, t, g, unknown or other
  misc_feature (172)..(195): n is a, c, g, or t
tcagatagagtactcacgaccggtgctcgatttagtgtgagtagtttgggtttgggggtcgtccactcccgccttgacggggctgccatcagtcccaaggcctaaccccactgtcactctgttcccaccctcctcagtactctatctgagcgggctggcaaggcgcattagnnnnnnnnnnnnnnnnnnnnnnnn

SEQ ID NO: 53164 - DNA, 569 bp, Homo sapiens
  misc_feature: GYAE6OF01ELOQZ.29.78.H01.1.454.CMB.1.raw
  modified_base (347)..(347): a, c, t, g, unknown or other
  misc_feature (347)..(347): n is a, c, g, or t
  modified_base (567)..(567): a, c, t, g, unknown or other
  misc_feature (567)..(567): n is a, c, g, or t
tcagatagagtactcacgaccggtgctcgatttagtgtgagtagtttgggtttggtggtctctctcccagcctgtgctgactcaatcgccctctgcctctgcctccctgggaggctcggtcaaggtcacctgtactctgagcagtggacacagcagctacgccatcgcttggcatcagcagaggccagacacgggccctcgttacttgatgacagtcaacaatgatggcagtcacagcgaaagggggacggatccctgatcgcttctcagtcctccagctcgtgggcctgacgcgctacctcacatccgtccggcctccagtctgaggatgaggctagactattacngtcagtccgtgggctacgtggctagttcgacggttccgtaccgggaaccggggacctaacggtccaccggttcgtccggtacacgaccccgaaggccccaaaccctcgtcgtaccacgttcctaccgttccccacccgtcctaccgtaacgttccttcctaagtccgtaggtacggccgggtccgtagggacccgaacgggtccgtacgtaagtacggcngc

SEQ ID NO: 53165 - DNA, 569 bp, Homo sapiens
  misc_feature: GYAE6OF01EQNTO.29.78.H01.1.454.CMB.1.raw
  modified_base (242)..(242): a, c, t, g, unknown or other
  misc_feature (242)..(242): n is a, c, g, or t
  modified_base (457)..(457): a, c, t, g, unknown or other
  misc_feature (457)..(457): n is a, c, g, or t
tcagatagagtactcacgaccggtgctcgatttagtgtgagtagtttgggtttggggtctgagagaggagtccacccctgggatcttcaggtgttttcatttggtgatcaggacggaacagagagaactcaccatggagtttgggctgagcgtgcgttttctagtggctattttaaaaggtgtccagtgtgacgtgcagttggtggagtctgggggcgcctggggtacggccgggggggtcnctgagactctcctgtgcggcctctggattaagttttaggagtcatgccatgaactgggtccgccaggctccaggggaaggggctggagtgggtctcggctattagtggcaggtggtggcgctatatattatgcagacgccctggaacgggccggttcacctatttccagagacaattcgaagaacacgctgtatctgacaaatggagagcctganactcgacgacacggccgtatattatgtagttaaaggcgtagcgtaggaacgtacggggaccggggcccgacgttcgaccacggtcggggaccaggggacgtcgtggtacccg

SEQ ID NO: 53166 - DNA, 648 bp, Homo sapiens
  misc_feature: GYAE6OF01A44DN.29.78.H01.1.454.CMB.1.raw
tcagatagagtactcacgaccggtgctcgatttagtgtgagtagtttgggtttggggtccgagccatggtgcagacctccccagagctctcctcctcctccactgcacagggtctctcctcccagcctgtgctgactcaatccgccctctgcctctcgccctccgtgggagctcggtcaaggtcacctgtactctgagcagtgacacagcagctacgccatcgcttggcatcagcagacggccagaccgaccgggcccttgttactgatgacagtacaaacatgatggacagtcacgaggacggaagggggacgactcccgtagactcgtacttcgacacgtcctaccgagtctcggtcgggcctagggaccgtcccgtaccttaaccctcaaccgtaaccgttcccgtccccggtacccttaccgtacggttccgtagggaacgggtacgtacgggtaacggtccttaacggtaacctttaacgtttaccgtcgtaccgaacggtacccggtggggacctacggtcggtactacgttcgtacgggtccgttaccgggaccgggtacctaggtccgaccggtcggtcgtacgaccgacccgaacggaccccaacccgtcgttcacctaccttcccgtccgttaccccc

SEQ ID NO: 53167 - DNA, 537 bp, Homo sapiens
  misc_feature: GYAE6OF01CU1O9.29.78.H01.1.454.CMB.1.raw
  modified_base (380)..(380): a, c, t, g, unknown or other
  misc_feature (380)..(380): n is a, c, g, or t
  modified_base (425)..(425): a, c, t, g, unknown or other
  misc_feature (425)..(425): n is a, c, g, or t
  modified_base (441)..(441): a, c, t, g, unknown or other
  misc_feature (441)..(441): n is a, c, g, or t
  modified_base (457)..(457): a, c, t, g, unknown or other
  misc_feature (457)..(457): n is a, c, g, or t
  modified_base (532)..(532): a, c, t, g, unknown or other
  misc_feature (532)..(532): n is a, c, g, or t
  modified_base (534)..(534): a, c, t, g, unknown or other
  misc_feature (534)..(534): n is a, c, g, or t
  modified_base (536)..(537): a, c, t, g, unknown or other
  misc_feature (536)..(537): n is a, c, g, or t
tcagatagagtactcacgaccggtgctcgatttagtgtgagtagtttgggtttggggcgcctgggtacggccggggggtcgctgagactctcctgtgcggcctcgtggaattaagttttaggagtacatgccatgaactgggtccgccaggctccagggaaggggctggagtgggtctcggctattagtggcagtggtggcgctatatattatgcagacgccctgaagggccggttcaccatttccagagacaattcgaaagaacacgctgtatctgcaaatggagagcctgagactcgacgacacgggccgtctattattgtgttaaaggcgagctgaatacgggccgggccacttgaccacgtcggggccaggggacncgtggtcacgtctcctcagcctccacaggccagtcgtcttccccngccacctcctaccagncacctcgtcgggcacngcacgcccgtgggcctcggcctggtaccaaggtacctacgttaccagtactctatctgaggcggctggcaggcgnangnn

SEQ ID NO: 53168 - DNA, 581 bp, Homo sapiens
  misc_feature: GYAE6OF01ARYWS.29.78.H01.1.454.CMB.1.raw
  modified_base (325)..(325): a, c, t, g, unknown or other
  misc_feature (325)..(325): n is a, c, g, or t
tcagatagagtactcacgaccggtgctcgatttagtgtgagtagtttgggtttggggtccgagccatggtgcagactccccagagctctcctcctcctccactgcacagggtctctctcccagcctgtgctgactcaatcgccctctgcctctgcctcccgtgggaggctcggtcaaggtcacctgtactctgagcagtggacacagcagctacgccatcgcttggcatcagcagaggccagacaccgggccctgttactgatgacagtcaacatgatggcagtcacaggacggaagggggacggactcccgtagactcgcttcncagtcctccagtctcgtcgggcctggacgcgtcctacctcacactccgtccggcctccgagtcctaggaggtactggacgcttagtaacttatttacgcgtacgacggtccgttggggctacggtggactagttcgacgggttccgtaccgggaaccgggtacctaacgggtccaccggttcggtccggtacaccggtccccgaacggtacccccaaccccgtatcccgtaccacccgttccgttcccgtaccccc

SEQ ID NO: 53169 - DNA, 634 bp, Homo sapiens
  misc_feature: GYAE6OF01C6U6I.29.78.H01.1.454.CMB.1.raw
  modified_base (630)..(630): a, c, t, g, unknown or other
  misc_feature (630)..(630): n is a, c, g, or t
  modified_base (633)..(633): a, c, t, g, unknown or other
  misc_feature (633)..(633): n is a, c, g, or t
tcagatagagtactcacgaccggtgctcgatttagtgtgagtagtttgggtttggtggtctctctcccagcctgtgctgactcaatcgccctctgcctctgcctccctgggaggctcggtcaaggtcacctgtactctgagcagtggacacagcagctacgccatcgcttggcatcagcagaggccagacacgggcctcgttactgatgacagtcaacaatgatggcagtcacgaggcgaaggggggcggactcccgtgatcgcttctcagtctccagtctcgtgggcctggacgccgacctacctcaacactccgtccggcctcgagtctggaggtatggagtctagacttattaccgtgtaccaaggtaccgtggggaccacgtggactagttcgacgggttcccgttaccggggaacccgggtaacctaacgggtcccgtaccgggttcgtacccggtacgaaccggcccccgaaagggcccccctaaaacccgtgtcccggtaccctaaccgttcccgttaccgttcccccaacccgttccgtaccgtaaccgttaccctccgttaacgtcggacgggtaccgggccgggtctacggggaacgaacgggtccgtactaaggtacgncgng

SEQ ID NO: 53170 - DNA, 625 bp, Homo sapiens
  misc_feature: GYAE6OF01BRD98.29.78.H01.1.454.CMB.1.raw
  modified_base (623)..(623): a, c, t, g, unknown or other
  misc_feature (623)..(623): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacggggaccggggcccgacttgaccactggggccagggggacgctggtcaccgtctcctcagccctccaccaagggcccactcggtccttccccctcggccacccgtcctccaacgacgccaccctccgtcgggggccacgacgccgacgccccgtcggggccgtcggtcccgttcgggtccgtaaacgggtaccttaaccgttcccacggttacctccttaacgttccgttaggacggtccggggccgtcgggaccgtaaacggggccggaccgaacgttaggncg

SEQ ID NO: 53171 - DNA, 596 bp, Homo sapiens
  misc_feature: GYAE6OF01ARHL2.29.78.H01.1.454.CMB.1.raw
tcagatagagtactcacgaccggtgctcgatttagtgtgagtagtttgggtttgggggcggcctgggtacggcccggggggtcgctgagactctcctgtgcggcctctggattaagttttaggagtcatgccatgaactgggtccgccaggtctccagggaaggggctgggtagtgggtctcggcttattagtggcagtggtggcgctatatattatgcagacggccctgaagggccggttcacccagtttccagagacaattcgaagaacacgctgtatctgctaaaatcggtagagcctgagactcgacgacacggccgtctatattgtgttaaaggcgagctggaatacgggaccgggccgactgaccactcggggccagggggacgcgtgggtcaccgtctcctcagcctccaccgaacgggcccagtccggtccttccccctacgccctacccgtcctccacgtcgacgccacctcgtcggggccacgacgcgacgtacccgtggtcctcgccctggtaccacgggtacctacgtccacgtacctcgttatcgtaggtcgcgggtctacggtacaacggcgacgtagcgcg

SEQ ID NO: 53172 - DNA, 521 bp, Homo sapiens
  misc_feature: GYAE6OF01B6U3A.29.78.H01.1.454.CMB.1.raw
  modified_base (406)..(406): a, c, t, g, unknown or other
  misc_feature (406)..(406): n is a, c, g, or t
tcagatagagtactcacgaccggtgctcgatttagtgtgagtagtttggggtttggggagagctctggggagtctgcaccatggctcggaccccactcctcttcctcaccctcctcctccactgcacagggtctctctcccagcctgtgctgactcaatcgccctctgcctctgcctcccgtgggaggctcggtcaaggtcacctgtactctgagcagtggacacagcagctacgccatcgcttggcatcagcagagcagacacggcctcgtacttgatgacagtcaacatgatggcagtcacgagacgaaggggacggactccctgactcgcttctcgagtcctcgagtctcgtcggcctgacgccgtctacctcactaactccgtccgcctacgagtctggagntggacggctgaacttagttcgtgtacagtaccgtgggctacgtgctagttcgaggtccgttacgggaccggacaacggtccgaccgtcgtcgtcacgaccacggcccaaccgtcg

SEQ ID NO: 53173 - DNA, 544 bp, Homo sapiens
  misc_feature: GYAE6OF01EKKZP.29.78.H01.1.454.CMB.1.raw
  modified_base (543)..(544): a, c, t, g, unknown or other
  misc_feature (543)..(544): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccgggccgacttgaccacgtggggccagggggacgctggtcaccgtctcctcagcctccaccaaggcccatcggtcttccccctggccaccctcctccaacgacgccacctcgtcggggcacagcagcccgtgggctgcctggtcaaggacctacttccacgtactctatctgaggcgggctggcgaacggcgcatgnn

SEQ ID NO: 53174 - DNA, 605 bp, Homo sapiens
  misc_feature: GYAE6OF01BEOKG.29.78.H01.1.454.CMB.1.raw
  modified_base (241)..(241): a, c, t, g, unknown or other
  misc_feature (241)..(241): n is a, c, g, or t
  modified_base (298)..(298): a, c, t, g, unknown or other
  misc_feature (298)..(298): n is a, c, g, or t
  modified_base (344)..(344): a, c, t, g, unknown or other
  misc_feature (344)..(344): n is a, c, g, or t
  modified_base (351)..(351): a, c, t, g, unknown or other
  misc_feature (351)..(351): n is a, c, g, or t
  modified_base (355)..(355): a, c, t, g, unknown or other
  misc_feature (355)..(355): n is a, c, g, or t
  modified_base (364)..(364): a, c, t, g, unknown or other
  misc_feature (364)..(364): n is a, c, g, or t
  modified_base (372)..(372): a, c, t, g, unknown or other
  misc_feature (372)..(372): n is a, c, g, or t
  modified_base (432)..(432): a, c, t, g, unknown or other
  misc_feature (432)..(432): n is a, c, g, or t
tcagatagagtactcacgaccggtgctcgatttagtgtgagtagtttgggtttggggtctgagagaggagtccacccctgggatcttcaggttgttttcatttggtgatcaggacggaacagagagaactcaccatggagtttgggctgagcgtgtgtttctaggtgctaatttaaaggtgtcagtgtgacgtgcagttggtggagtcgtggggcgccgtggggtacggccgggggggtcncgtgagctctctgtgcgccttgtggattaagtttaggatcatgcatgaactggtccncaggctccgagggagggctgggagtgggtctcggctattggtgcgngtggtgngctntatatatgnagacgccngaaggccggtcacctactttccagagactaattacgaagaacacgactagtatactgaanaagagagagcgtacgagacgacgaccgaacgaccggaccgtacttatttagttaggttaggtaaggtacggtacgtacgtacgggtaacgggtaaccggggtacccggggtacccggtaccggtacgaccgaaccggtacgggaccgggacggggaccggtcggtcggtaccg

SEQ ID NO: 53175 - DNA, 543 bp, Homo sapiens
  misc_feature: GYAE6OF01AZV1I.29.78.H01.1.454.CMB.1.raw
  modified_base (538)..(538): a, c, t, g, unknown or other
  misc_feature (538)..(538): n is a, c, g, or t
  modified_base (542)..(543): a, c, t, g, unknown or other
  misc_feature (542)..(543): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaaatggagagcctgagactcgacgacacggccgtctattatgtgttaaaggcgagctggaatacgggaccgggccgacttgaccactggggccaggggacgctggtcaccgtctcctcagcctccaccaagggcccatccggtcttccccctggccaccctcctccaacgacgccacctcgtgggggccacgacgcacgcccgtgggctcgcctggtcaaggactactccagtactctactctgacggcggctggcaggcgnatgnn

SEQ ID NO: 53176 - DNA, 591 bp, Homo sapiens
  misc_feature: GYAE6OF01B2ZA6.29.78.H01.1.454.CMB.1.raw
  modified_base (588)..(589): a, c, t, g, unknown or other
  misc_feature (588)..(589): n is a, c, g, or t
  modified_base (591)..(591): a, c, t, g, unknown or other
  misc_feature (591)..(591): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagccggaatacgggaccggggcccgacttgaccacgtggggccagggggacgctggtcaccgtctcctcagcctccaccaagggcccatcggtccttccccctcggccacccctcctccaacgacgccaccctcgtcgggggccacgacgcacgccccgtggggcctcggcccgttcgggtccgaaacgggaccttaccttcccacggttaccttcctacttccgtggacggccggggctcgggcaagggcgacatagnngn

SEQ ID NO: 53177 - DNA, 547 bp, Homo sapiens
  misc_feature: GYAE6OF01C02K5.29.78.H01.1.454.CMB.1.raw
  modified_base (282)..(282): a, c, t, g, unknown or other
  misc_feature (282)..(282): n is a, c, g, or t
  modified_base (378)..(378): a, c, t, g, unknown or other
  misc_feature (378)..(378): n is a, c, g, or t
  modified_base (546)..(547): a, c, t, g, unknown or other
  misc_feature (546)..(547): n is a, c, g, or t
tcagatagagtactcacgaccggtgctcgatttagtgtgagtagtttgggtttggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatgganagcctgagactcgacgacacggccgtctattattgtgttaaaggcgagctggaatacgggaccgggccgacttgaccacgtggggccagggggacncgtgggtcaccgtctcctcacgccctccaccaacgggcccatcggtccttccccctggccaccctcctaccaagacgcacctctggggcacagcagccctcgggctgcctggtcaaggactacttccacgtactctatctgacgcgggctggactaaggcgacatagnn

SEQ ID NO: 53178 - DNA, 510 bp, Homo sapiens
  misc_feature: GYAE6OF01D06SH.29.78.H01.1.454.CMB.1.raw
tcagatagagtactcacgaccggtgctcgatttagtgtgagtagtttgggtttggggtccgagccatggtgcagactccccagagctctcctcctcctccactgcacagggtctctctcccagcctgtgctgactcaatcgccctctgcctctgcctccctgggaggctcggtcaaggtcacctgtactctgagcagtggacacagcagctacgccatcgcttggcatcagcagaggccagacacgggccctcgttacttgatgacagtcaacaatgatggcagtcacagcgaagggggacggatccctgatcgcttctcagtctccagctcgtgggcctgagcgctacctcacatcctccggcctccagtctgaggatggaggctgactattactgtcagaccgtggggcacgtggactagttcgaggtccgttcgggaccgggaccaaggtccaccggtcgtcggtcacggcccaacggcccaaccccgctcgtcacctctcgtcccc

SEQ ID NO: 53179 - DNA, 539 bp, Homo sapiens
  misc_feature: GYAE6OF01AICKD.29.78.H01.1.454.CMB.1.raw
  modified_base (388)..(388): a, c, t, g, unknown or other
  misc_feature (388)..(388): n is a, c, g, or t
tcagatagagtactcacgaccggtgctcgatttagtgtgagtagtttgggtttggggtccgagccatggtgcagactccccagagctctcctcctcctccactgcacagggtctctctcccagcctgtgctgactcaatcgccctctgcctctgcctcccgtgggaggctcggtcaaggtcacctgtactctgagcagtggacacagcagctacgccatcgcttggcatcagcagaggccagacacgggccctgttactgatgacagtcaacatgatggcagtcacgagcgaagggggacggatcccgtgatcgcttctcagtcctccgagcctcgtgggcctggacgcgctacctcaacaactccgtcccggcctccgagtctgagntgaggctgacttattacgtgtcagaccgtggggcctacgtggctagttccgacgggttccgttaccggggacccgggtaccacgggtccaccggtcggtccgtcgacgcccgaacggcccaacccgtctcgtaccacctcgtcgtcccccg

SEQ ID NO: 53180 - DNA, 632 bp, Homo sapiens
  misc_feature: GYAE6OF01CK9LP.29.78.H01.1.454.CMB.1.raw
  modified_base (629)..(629): a, c, t, g, unknown or other
  misc_feature (629)..(629): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtaatctgcaaatggagagcctgagactcgacgacacggccgtctattattgtagttaaaggcgagctaggaatacgggaccggggccgacttgaccacgtggggccagggggacgctggtccaccgtctccctcacggccctccaccgaacgggcccacgtccggtccttcccccctcggcccaccctccctccaacgacgccaacctccgtcgggggcaccgagccacggccccgtgggcctcggcccgttcggtaccgaaacggtaccttaaccgttccctaacgttaccttaccttaacgttccgttaggaacggccggggtcgttcgggaccgaaacgggccggacaacgttaaggnacg

SEQ ID NO: 53181 - DNA, 625 bp, Homo sapiens
  misc_feature: GYAE6OF01BMDFU.29.78.H01.1.454.CMB.1.raw
  modified_base (623)..(623): a, c, t, g, unknown or other
  misc_feature (623)..(623): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacggggaccggggcccgacttgaccacgtgggggccagggggacgcgtggtcaccgtctcctcacgccctccaccgaacgggcccactccggtccttcccccgtcggcccaccctccctcccaacgacgccacccgtccgtcgggggccaccgacgccgacgccccgtcggggccgtcggcccgtcgggtacgaacgggaccttaccgttacccgacgttaccttcctacgttccgtggtacggccggggccgttcgggaccgtaacgggccgacgacgttaggngc

SEQ ID NO: 53182 - DNA, 618 bp, Homo sapiens
  misc_feature: GYAE6OF01AKPLS.29.78.H01.1.454.CMB.1.raw
  modified_base (615)..(615): a, c, t, g, unknown or other
  misc_feature (615)..(615): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacggggaccggggcccgacttgaccacgtggggccaggggacgctggtcaccgtctcctcagccctccaccgaacgggcccatccggtccttcccccgtcggccaccctccctcccaacgacgccaccctcgtcgggggccacgacgccacgccccgtgggcctcggtcccgtcggtacgaacgggtacctaccgttcccgacgttaccttccttaacgttccgttaggacggtccggggccgtcgggaccgtaaacggggccgacgtaacgtaggntcg

SEQ ID NO: 53183 - DNA, 606 bp, Homo sapiens
  misc_feature: GYAE6OF01C9B28.29.78.H01.1.454.CMB.1.raw
tcagatagagtactcacgaccggtgctcgatttagtgtgagtagtttgggtttggggtccgagccatggtgcagactccccagagctctcctcctcctccactgcacagggtctctctcccagcctgtgctgactcaatcgccctctgcctctgcctcccgtgggaggctcggtcaaggtcacctgtactctgagcagtggacacagcagctacgcatcgcttggcatcagcagagcagacgacgggcctcgttactgatgacagtacaacaatgatggcagtcacgagacggaagggggacggatcccgtgactcgcttctcagtctacgagtcgtcgtcgggctggacgcgtcctaccgtcacgtactccgtccggcctaccgagtcgtagagtagtcgacggtctagtacttattacgtcgtacgacggtaccgtggggacctaggtcggacttacgttcgtacgggttccgttaccggggaacccgggtaccgtacggtcccgtaccggttccggtccgggtaccaaccggtacccccgaacgggacccccctaaacccgtaccgttacgtccctaacccgttccgttcccgttaccccccg

SEQ ID NO: 53184 - DNA, 619 bp, Homo sapiens
  misc_feature: GYAE6OF01CG5Z3.29.78.H01.1.454.CMB.1.raw
  modified_base (611)..(611): a, c, t, g, unknown or other
  misc_feature (611)..(611): n is a, c, g, or t
tcagatagagtactcacgaccggtgctcgatttagtgtgagtagtttgggtttggtggtctctctcccagcctgtgctgactcaatcgccctctgcctctgcctccctgggaggctcggtcaaggtcacctgtactctgagcagtggacacagcagctacgccatcgcttggcatcagcagaggccagacacgggccctcgttacttgatgacagtcaacaatgatggcagtcacagcgaagggggacggatcctgatcgcttctcggtctccagctcgtgggcctggacgcgctacctcacaactctccggcctccagtctgaggatgaggctgactattactgtcagaccgtggggctacgtggctagttcgagggttccgttacgggaccggggtaaccaagggtccacccggtcggtccgggtaccacggaccccgaaacggcccaaaccccgcgttcgtacctaaccgttccttccgttaccccctaaccccgttccttaccgtaacgttacccttccgttaacttcccgttacgggaaccggtccgggggtaccttacgggggacccgtaaaacgggggtccccgtaacgtaaacgttaacggcncgcgtacg

SEQ ID NO: 53185 - DNA, 546 bp, Homo sapiens
  misc_feature: GYAE6OF01D0Z96.29.78.H01.1.454.CMB.1.raw
  modified_base (542)..(542): a, c, t, g, unknown or other
  misc_feature (542)..(542): n is a, c, g, or t
  modified_base (546)..(546): a, c, t, g, unknown or other
  misc_feature (546)..(546): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccggggcccgacttgaccacgtgggggccagggggacgctggtcaccgtctcctcacgcctccaccaagggcccatccggtccttccccctggccaccctcctcccaagcgccaccctcgtcggggccacagcacgccctgggcctcgcctggtcaaggactacttccagtactctatctgagcgggctggacaggcnatgn

SEQ ID NO: 53186 - DNA, 488 bp, Homo sapiens
  misc_feature: GYAE6OF01AON69.29.78.H01.1.454.CMB.1.raw
  modified_base (423)..(423): a, c, t, g, unknown or other
  misc_feature (423)..(423): n is a, c, g, or t
  modified_base (483)..(483): a, c, t, g, unknown or other
  misc_feature (483)..(483): n is a, c, g, or t
  modified_base (486)..(488): a, c, t, g, unknown or other
  misc_feature (486)..(488): n is a, c, g, or t
tcagatagagtactcacgaccggtgctcgatttagtgtgagtagtttgggtttggtggtctctctcccagcctgtgctgactcaatcgccctctgcctctgcctccctgggaggctcggtcaaggtcacctgtactctgagcagtggacacagcagctacgccatcgcttggcatcagcagaggccagacacgggccctcgttacttgatgacagtcaacaatgatggcagtcacagcaaggggacgggatccctgatcgcttctcagtctccagctctgggcctgagcgctacctcacaatctccggcctccagtctgaggatgaggctgactattactgtcagacctggggcacgtggcattcaggtcttcggaccggggaccaaggtcaccggtcgtcggtcagcccaaggcccaacccnctcgtcactctcgttcccaccctcctcagtacctctatctgagcgggctggcaggcgcancgnnn

SEQ ID NO: 53187 - DNA, 560 bp, Homo sapiens
  misc_feature: GYAE6OF01ERTXC.29.78.H01.1.454.CMB.1.raw
  modified_base (425)..(425): a, c, t, g, unknown or other
  misc_feature (425)..(425): n is a, c, g, or t
tcagatagagtactcacgaccggtgctcgatttagtgtgagtagtttgggttggggtccgagccatggtgctagactccccagagcgtacgtcctcctcctccactgcacacggtctctctcccagcctgtgctgactcaatccgccctctgcctctcgcctcccgtgggaggctcggtcaaggtccacctgtactctgagcagtggacacagcagctacgccatcgcttggcatcagcagaggccagacacgggccctgttactgatgacagtcaacaatgatggcagtcacgagaccggaagggggacggatccctgatcgtcttcactacgtctccgagctcgtcgggcctggacgccgtctaacctcaactactcccgccccggtctccagttccaggagactggacgctgtactattacngtcacgtcgtgggcagtgctattcgaggttccgtacgggaccgggactacggtcgaccggttcggtccgtagaccggaaccccgtaacggacccccaaacccgtcgtcgacctaccgttctcccggttccccccg

SEQ ID NO: 53188 - DNA, 666 bp, Homo sapiens
  misc_feature: GYAE6OF01BYSVW.29.78.H01.1.454.CMB.1.raw
  modified_base (287)..(287): a, c, t, g, unknown or other
  misc_feature (287)..(287): n is a, c, g, or t
  modified_base (319)..(319): a, c, t, g, unknown or other
  misc_feature (319)..(319): n is a, c, g, or t
tcagatagagtactcacgaccggtgctcgatttagtgtgagtagtttgggtttggggtccgagccatggtgcagactccccagagctctcctcctccactgcacagggtctctctcccagcctgtgctgactcaatcgccctctgcctctgccctcccgtgggaggctcggtcaaggtcacctgtactctgagcagtggacacagcagctacgccatcgcttggcatcagcagaggccagacacgggccctcgttactgatgacagtacaacaatgatggcagtcanagcgaagggggacggatcccgtgatcgcttcncagtctcagctcgtcgggcctggacgccgcctacctcaacaacttccgtacccggccctacccgtaggttcctagggaaggtacgtgggaacggtccttacggtaactttaacgtttaccgtcggttaccgaacgggtacccggttcgggggacctaacggttcggacctacgtttccggaacgggtttcccgttaccgggggaacccggggtaaccgtaaacgggtcccgtaccgggttccggttaccgggtcccgaaccggacccccgaaaccgggacccccctaaacccccgtacgttccggttaccctaacccgttcccggtttccggttcccccccgtcccc

SEQ ID NO: 53189 - DNA, 564 bp, Homo sapiens
  misc_feature: GYAE6OF01CY9SZ.29.78.H01.1.454.CMB.1.raw
  modified_base (562)..(564): a, c, t, g, unknown or other
  misc_feature (562)..(564): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaaatggagagcctgagactcgacgacacggccgtctattattgtgttaaaggcgagctggaatacgggaccggggcccgacttgaccacgtggggcccagggggacgctggtcaccgtctcctcagcctccaccagggcccactccggtccttccccctggcccaccctcctccaacgacgccaccctcgtcgggggccacgacgccggcccgtgggcctcggccctggtcaacgggtactacttccagtacctctatctgagcgggctcgggcaaggcgacatannn

SEQ ID NO: 53190 - DNA, 549 bp, Homo sapiens
  misc_feature: GYAE6OF01BS1FP.29.78.H01.1.454.CMB.1.raw
  modified_base (544)..(544): a, c, t, g, unknown or other
  misc_feature (544)..(544): n is a, c, g, or t
  modified_base (548)..(549): a, c, t, g, unknown or other
  misc_feature (548)..(549): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattatgtgttaaaggcgagctggaatacggggaccggggcccgacttcgaccacgtgggggccagggggacgctggtcaccgtctcctcagccctccaccaaggcccatcggtcttccccctggccaccctcctacccaacgacgccaccctcgtcgggggcacgacgcacgcccgtgggctgcctggtcaagactacttccagtactctactctgacgcggctggcaaggcnatgnn

SEQ ID NO: 53191 - DNA, 552 bp, Homo sapiens
  misc_feature: GYAE6OF01DSCC2.29.78.H01.1.454.CMB.1.raw
  modified_base (294)..(294): a, c, t, g, unknown or other
  misc_feature (294)..(294): n is a, c, g, or t
  modified_base (302)..(302): a, c, t, g, unknown or other
  misc_feature (302)..(302): n is a, c, g, or t
  modified_base (402)..(402): a, c, t, g, unknown or other
  misc_feature (402)..(402): n is a, c, g, or t
  modified_base (461)..(461): a, c, t, g, unknown or other
  misc_feature (461)..(461): n is a, c, g, or t
  modified_base (549)..(549): a, c, t, g, unknown or other
  misc_feature (549)..(549): n is a, c, g, or t
tcagatagagtactcacgaccggtgctcgatttagtgtgagtagtttgggtttgggggtcggcctgggtacggccgggggggtcgctggagactctcctgtgcggcctctggatttaagttttaggagtcatcgccattgaactgggtccgccacggctccagggaagggctggagtgggtcgtcggctattagtggcagtggtggcgctatatattatgcagacgcccctgaagggccggttcaccattttccagagacaattcgaagaacacgctgtatctgacaaatgganagcctganactcgacgacaacggccgtactattatgtgttaaaggcgagctggaatacgggccgggccgagttcgaccactggggccaggggacgctggtcaccgtcncctcagcctccaccaggccatcgtctccctgcacctctcagagcacctcgtggggcacngcacgcctggctgcctggtcaaggactacgttcctagtacgtcgtacgtcgtggacggcgggcgtgggaccgtaacggacgcaactgngcg

SEQ ID NO: 53192 - DNA, 166 bp, Homo sapiens
  misc_feature: GYAE6OF01DFWZJ.29.78.H01.1.454.CMB.1.raw
  modified_base (166)..(166): a, c, t, g, unknown or other
  misc_feature (166)..(166): n is a, c, g, or t
tcagatagagtactcacgaccggtgctcgatttagtgtgagtagtttgggtttggggtctccactcccgccttgacgggctgccatcagcccaaggccaaccccactgtcactctgttcccgccctcctcagtactctatctgagcgggctggcaaggcgcatagn

SEQ ID NO: 53193 - DNA, 549 bp, Homo sapiens
  misc_feature: GYAE6OF01BY7GP.29.78.H01.1.454.CMB.1.raw
  modified_base (548)..(549): a, c, t, g, unknown or other
  misc_feature (548)..(549): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccgggcccgacttgaccacgtggggccagggggacgctggtcaccgtctcctcagccctccaccaagggcccatccggtccttccccctcggccaccctccctccaacgacgcacctcgtcggggcacagcacgccctgggcctgcctggtcaaggacctacttccagtactctatctgaggcgggctggcgacggcgacatgnn

SEQ ID NO: 53194 - DNA, 641 bp, Homo sapiens
  misc_feature: GYAE6OF01EGCA8.29.78.H01.1.454.CMB.1.raw
  modified_base (639)..(640): a, c, t, g, unknown or other
  misc_feature (639)..(640): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtagttaaaggcgagctaggaagtacggggaccggggcccgacttcgaccacgtgggggccagggggacgcgtggtcaccggtctcctcacgccctcccaacccgaacgggccccaacgttcccgggttcctttcccccccgttcgggccctacccccgtccctacccaaacggacgcccgtaaccctccggtcgggggccaacgacggccgacgccccgtcggggcctcggcccgttcggtacgaacggaccttaccttccgtacgttacctactacgttccgtaggacggtcgggcgtcggaccgaacgggcgacagtgnng

SEQ ID NO: 53195 - DNA, 552 bp, Homo sapiens
  misc_feature: GYAE6OF01D24TX.29.78.H01.1.454.CMB.1.raw
  modified_base (547)..(547): a, c, t, g, unknown or other
  misc_feature (547)..(547): n is a, c, g, or t
  modified_base (551)..(552): a, c, t, g, unknown or other
  misc_feature (551)..(552): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaagggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacggggaccgggcccgacttgaccacgtcggggccaggggacgctggtcaccgtctcctcagccctccaccaggcccatcggtccttccccctggcccaccctcctccaagacgccacctcgtcgggggccacacgcacgcccgtgggctcgcctggtcaacggactaccttccagtacctctatctgacggcgggctggcgaaggcanatgnn

SEQ ID NO: 53196 - DNA, 491 bp, Homo sapiens
  misc_feature: GYAE6OF01BVT3Z.29.78.H01.1.454.CMB.1.raw
  modified_base (323)..(323): a, c, t, g, unknown or other
  misc_feature (323)..(323): n is a, c, g, or t
  modified_base (423)..(423): a, c, t, g, unknown or other
  misc_feature (423)..(423): n is a, c, g, or t
  modified_base (484)..(484): a, c, t, g, unknown or other
  misc_feature (484)..(484): n is a, c, g, or t
  modified_base (489)..(490): a, c, t, g, unknown or other
  misc_feature (489)..(490): n is a, c, g, or t
tcagatagagtactcacgaccggtgctcgatttagtgtgagtagtttgggtttggtggtctctctcccagcctgtgctgactcaatcgccctctgcctctgcctccctgggaggctcggtcaaggtcacctgtactctgagcagtggacacagcagctacgccatcgcttggcatcagcagaggccagacacgggccctcgttacttgatgacagtcaacaatgatggcagtcacagcgaagggggacggatccctgatcgcttctcagtctccagctctgggcctgagcgctacctcacatcctccggcctcagtctgaggntgaggctgactattactgtcagacctggggcacgtggcagttcgaggtcttcgggaccgggacaaggtcaccggtcgcgtcacgcccaaggcccaacccntcgtcactcgtcgttcccgcctcctcacgtactctactcgtgaggcggctgggacaaggcncatgnnc

SEQ ID NO: 53197 - DNA, 521 bp, Homo sapiens
  misc_feature: GYAE6OF01BGX7E.29.78.H01.1.454.CMB.1.raw
tcagatagagtactcacgaccggtgctcgatttagtgtgagtagtttgggtttggggtccgagccatggtgcagactccccagagctctcctcctcctccactgcacagggtctctctcccagcctgtgctgactcaatcgccctctgcctctgcctccctgggaggctcggtcaaggtcacctgtactctgagcagtggacacagcagctacgccatcgcttggcatcagcagaggccagacacgggccctcgttacttgatgacagtcaacaatgatggcagtcacagcaagggggacggatccctgatcgcttctcagtctccagctcgtgggcctgagcgctacctcacaatcctccggcctccagtctgaggatgaggctgactattactgtcagacccgtggggccacgtggctagttcagggttccttacgggacccggggtaccaagggtccaccggtcggtcggtcacggccccaaggccccaacccacgtcgtaccactcgtcgttccccg

SEQ ID NO: 53198 - DNA, 515 bp, Homo sapiens
  misc_feature: GYAE6OF01EUUIY.29.78.H01.1.454.CMB.1.raw
  modified_base (339)..(339): a, c, t, g, unknown or other
  misc_feature (339)..(339): n is a, c, g, or t
  modified_base (427)..(427): a, c, t, g, unknown or other
  misc_feature (427)..(427): n is a, c, g, or t
  modified_base (512)..(513): a, c, t, g, unknown or other
  misc_feature (512)..(513): n is a, c, g, or t
tcagatagagtactcacgaccggtgctcgatttagtgtgagtagtttgggtttggtggtctctctcccagcctgtgctgactcaatcgccctctgcctctgcctccctgggaggctcggtcaaggtcacctgtactctgagcagtggacacagcagctacgccatcgcttggcatcagcagaggccagacacgggccctcgttacttgatgacagtcaacaatgatggcagtcacagcgaagggggacggatccctgatcgcttctcagtctccagctcgtgggcctgacgcgctacctcacatctccgctccagtctgagatgaggctgactattacngtcagacctggggcacgtggctattcgagggttcttacgggaccgggaccaaggtccaccgtcgtcggtcacgcccaggcccaacccnctcgtccaccgttctcgttccccaccttcctccagttacctctactccgtcgaggccgggctcgggacaacgggccacagtacgnngc

SEQ ID NO: 53199 - DNA, 564 bp, Homo sapiens
  misc_feature: GYAE6OF01A0PE6.29.78.H01.1.454.CMB.1.raw
  modified_base (559)..(559): a, c, t, g, unknown or other
  misc_feature (559)..(559): n is a, c, g, or t
  modified_base (563)..(564): a, c, t, g, unknown or other
  misc_feature (563)..(564): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccggggcccgacttgaccacgtgggggccagggggacgcgtggtcaccggtctcctcacgcctccaccaagggcccatcggtcttccccctggccaccctccctcccaacgacgccacctcgtcgggggccacgacgccacgccccgtgggctcgccgtggtcaacggactaccttccacgtactctatctgacggcgggctggcgaggcgacntagnn

SEQ ID NO: 53200 - DNA, 552 bp, Homo sapiens
  misc_feature: GYAE6OF01B07GB.29.78.H01.1.454.CMB.1.raw
  modified_base (551)..(552): a, c, t, g, unknown or other
  misc_feature (551)..(552): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccggggccgacttgaccactggggccagggggacgctggtcaccgtctcctcagccctccaccaagggcccatccggtcttccccctcggccacccctcctcccaacgacgccaccctccgtgggggccacgacgccagccctcgggctgcctggtcaaggactacttccacgtactctatctgaggcgggctggcaggcgcatgnn

SEQ ID NO: 53201 - DNA, 600 bp, Homo sapiens
  misc_feature: GYAE6OF01CKW99.29.78.H01.1.454.CMB.1.raw
  modified_base (243)..(243): a, c, t, g, unknown or other
  misc_feature (243)..(243): n is a, c, g, or t
  modified_base (461)..(461): a, c, t, g, unknown or other
  misc_feature (461)..(461): n is a, c, g, or t
tcagatagagtactcacgaccggtgctcgatttagtgtgagtagtttgggtttggggtctgagagaggagtccacccctgggatcttcaggtgttttcatttggtgatcaggacggaacagagagaactcaccatggagtttgggctgagctggctttttcttgtggctaattttaaaaggtgtccagtgtgacgtgcagttggtggagtctgggggcgccgtgggtacggccgggggggtcnctgagactctcctgtgcggcctctggattaagttttaggagtcatgccatgaactgggtccgccaggctccgaggggaaggggctggagtgggtctcggctagttaggtggcagtggtggcgctatatattatgcagacgcccgtggaacgggtccgttacacctatttccagagaactaattacgaaagaacacgctagtatctagacaaagtgganagcctagacgacgtcgaacgacgaccggcctatattattaggtagttaaaggcgtaagcgtaggaaacgtaccggggacccggggcccgtacgttacggaccctacggtcggggaccgaggggaccgcgtcggtacccg

SEQ ID NO: 53202 - DNA, 570 bp, Homo sapiens
  misc_feature: GYAE6OF01CWQJP.29.78.H01.1.454.CMB.1.raw
  modified_base (565)..(565): a, c, t, g, unknown or other
  misc_feature (565)..(565): n is a, c, g, or t
  modified_base (570)..(570): a, c, t, g, unknown or other
  misc_feature (570)..(570): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccggggccgacttgaccactggggccaggggacgctggtcaccgtctcctcagcctccaccaagggcccatccggtccttccccccgtcggcccaccctccctacccaacgacgccaccctcgtcgggggccacgacgccgacgcccctggggcctcggccctgggtaccaacggacctaaccttccagtacctctactctgagcgggctggcacggcganatagn

SEQ ID NO: 53203 - DNA, 611 bp, Homo sapiens
  misc_feature: GYAE6OF01AJQHP.29.78.H01.1.454.CMB.1.raw
  modified_base (235)..(235): a, c, t, g, unknown or other
  misc_feature (235)..(235): n is a, c, g, or t
  modified_base (324)..(324): a, c, t, g, unknown or other
  misc_feature (324)..(324): n is a, c, g, or t
tcagatagagtactcacgaccggtgctcgatttagtgtgagtagtttgggtttggggtccgagccatggtgcagactcccagagctctcctcctcctccactgcacagggtctctctcccagcctgtgctgactcaatcgccctctgcctctgcctccctgggaggctcggtcaaggtcaccgtgtactctgagcagtggacacagcagctacgccatcgcttggcatcagcagnggccagacacgggcctcgttacttgatgacagtcaacaatgatggcagtcacaggcgaaggggggacggatcccgtgactcggctttcncgagtctccagctcgtcgggcctggacgcgctacctcaacatcctaccggccttccgagttctaggaggtatcggacggcttaggtaaccttagtttaccgtcggtccaacgggtacccgtgggggacctacggtcggaccttagttccggacgggtttacccgttaccggggaaccggggtaccaacgggttcccgaccgggttcggtccggtaccgaccggccccgaaacgggccccctaaaccccgtcgttcggtaccctaccgttccgttccggttacccccc

SEQ ID NO: 53204 - DNA, 205 bp, Homo sapiens
  misc_feature: GYAE6OF01BNTCN.29.78.H01.1.454.CMB.1.raw
  modified_base (202)..(205): a, c, t, g, unknown or other
  misc_feature (202)..(205): n is a, c, g, or t
tcagatagagtactcacgaccggtgctcgatttagtgtgagtagtttgggtttgggctcaactttcttgtccaccaagggcccatcggtcttccccctggcaccctcctccaagagcacctctgggggcacagcggccctgggctgcctggtcaaggactacttccctcgcgatatctgagcgggctggcaaggcgcatagnnnn

SEQ ID NO: 53205 - DNA, 510 bp, Homo sapiens
  misc_feature: GYAE6OF01ACPEW.29.78.H01.1.454.CMB.1.raw
  modified_base (318)..(318): a, c, t, g, unknown or other
  misc_feature (318)..(318): n is a, c, g, or t
  modified_base (395)..(395): a, c, t, g, unknown or other
  misc_feature (395)..(395): n is a, c, g, or t
  modified_base (488)..(488): a, c, t, g, unknown or other
  misc_feature (488)..(488): n is a, c, g, or t
tcagatagagtactcacgaccggtgctcgatttagtgtgagtagtttgggtttggggtccgagccatggtgcagactccccagagctctcctcctcctccactgcacagggtctctctcccagcctgtgctgactcaatcgccctctgcctctgcctccctgggaggctcggtcaaggtcacctgtactctgagcagtggacacagcagctacgccatcgcttggcatcagcagaggccagacacgggccctgttacttgatgacagtcaacaatgatggcagtcacagcaagggggcggatcccgtgactcgcttcncagtctccagctcgtgggcctgacgccgctacctcactatcctccggcctcagtctggagatgagctgactattacngtcagaccgtgggcacgtggctagttcaggtcttcgggaccgggtaccaggtccaccgttcggtcggtcacgcccgaacggcccaaccccgtntcgtaccacctctcgttccccc

SEQ ID NO: 53206 - DNA, 178 bp, Homo sapiens
  misc_feature: GYAE6OF01C9YVR.29.78.H01.1.454.CMB.1.raw
  modified_base (163)..(178): a, c, t, g, unknown or other
  misc_feature (163)..(178): n is a, c, g, or t
tcagatagagtactcacgaccggtgctcgatttagtgtgagtagtttgggttggggtctccactcccgccttgacgggctgccatcagcccaaggccaacccactgtcactctgttcccgccctcctcagtactctatctgagcggctggcaaggcgcatagnnnnnnnnnnnnnnnn

SEQ ID NO: 53207 - DNA, 573 bp, Homo sapiens
  misc_feature: GYAE6OF01B8RYO.29.78.H01.1.454.CMB.1.raw
  modified_base (572)..(573): a, c, t, g, unknown or other
  misc_feature (572)..(573): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccgggccgacttcgaccacgtggggccagggggacgctggtcaccgtctcctcagccctccaccgaagggcccatccggtccttccccccgtggcccacccctccctcccaacgacgccaccctccgtcgggggccacgacgccacgcccgtgggcctcgcccgtggtccaaggacctacgttccagttacctctatcgtgaggccgggctggcgaaggcgacagtgnn

SEQ ID NO: 53208 - DNA, 545 bp, Homo sapiens
  misc_feature: GYAE6OF01EBQVY.29.78.H01.1.454.CMB.1.raw
  modified_base (544)..(545): a, c, t, g, unknown or other
  misc_feature (544)..(545): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccgggcccgacttgaccacgtggggccagggggacgctggtcaccggtctcctcagcctccaccaagggcccatccggtcttccccctggccaccctcctccaacgacgccacctctcgggggcacacgcacgccctgggctcgcctggtcaaggactacttccagtactctatctgagcgggctggacaggcacatgnn

SEQ ID NO: 53209 - DNA, 690 bp, Homo sapiens
  misc_feature: GYAE6OF01D7XFK.29.78.H01.1.454.CMB.1.raw
tcagatagagtactcacgaccggtgctcgatttagtgtgagtagtttgggtttgggggtcggcctgggtacggccggggggtcgctgagacctctcctgtgccggtcctctggattaagttttaggagtcatgccatgaactgggtccgccaggctccgagggaaggggctggagtgggtcttcggctattagtggtcaggtggtggcgctatagtattatgcaggacgcccgtggaagggcccgtttcacccatttccgaggacgacaattccgaagaaccacgctgtactctgactaaacgtggagtagcctgacgacgtcgacgacacggccgtctacgttagttggtagttaaggcgagcgtaggaatacgggaccggccgagttcgaccgagtcggggaccgaggggactcgtcggtaccaccggtctcccgtacgacgtccctaccgacccgtaacggcccgacgtccgtcccgttacccccgtcggaccctaccccgtcccgtacccgaacgacgcctacccgtccgtacgggaccacgacgccgacggcccgtagggccgtcggtacccgtcggtacctaacggtaccctaccgttacccgtacgtaccgtacgttacgtccggtacggtacgggtccgggtacgtacgggtaccggaacggccgaccgtacgtacgcgtcg

SEQ ID NO: 53210 - DNA, 564 bp, Homo sapiens
  misc_feature: GYAE6OF01CX3P5.29.78.H01.1.454.CMB.1.raw
  modified_base (320)..(320): a, c, t, g, unknown or other
  misc_feature (320)..(320): n is a, c, g, or t
  modified_base (563)..(564): a, c, t, g, unknown or other
  misc_feature (563)..(564): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtnttaaaggcgagctggaatacggggaccggggccgacttgaccacgtggggccaggggacgcgtggtcaccgtctccctcacgcctccgaccaacgggcccatccggtccttcccccctcggccaccctccctcccaagacgcaccctcgtcgggggcaccgacgccacgcccctgggcctcgccctggtcaaggactaccttccatacctctatctgacggcgggctggcaacggcgcatagnn

SEQ ID NO: 53211 - DNA, 598 bp, Homo sapiens
  misc_feature: GYAE6OF01CDOTQ.29.78.H01.1.454.CMB.1.raw
  modified_base (596)..(596): a, c, t, g, unknown or other
  misc_feature (596)..(596): n is a, c, g, or t
  modified_base (598)..(598): a, c, t, g, unknown or other
  misc_feature (598)..(598): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccggggcccgacttgaccacgtggggccagggggacgctggtcaccgtctcctcagccctccaccagggcccatccggtccttccccctcggccaccctcctcccaacgacgccaccctccgtcgggggccacgacgccgacgcccgtcggggcctcggcccgtgggtaccaacgggtaccttaccgttcccacgttacctcttacgtcctggacggccggggcctgggaccgaacgggccgacgacgtagngn

SEQ ID NO: 53212 - DNA, 494 bp, Homo sapiens
  misc_feature: GYAE6OF01AUQE8.29.78.H01.1.454.CMB.1.raw
  modified_base (416)..(416): a, c, t, g, unknown or other
  misc_feature (416)..(416): n is a, c, g, or t
  modified_base (491)..(492): a, c, t, g, unknown or other
  misc_feature (491)..(492): n is a, c, g, or t
  modified_base (494)..(494): a, c, t, g, unknown or other
  misc_feature (494)..(494): n is a, c, g, or t
tcagatagagtactcacgaccggtgctcgatttagtgtgagtagtttgggtttggtggtctctctcccagcctgtgctgactcaatcgccctctgcctctgcctccctgggaggctcggtcaaggtcacctgtactctgagcagtggacacagcagctacgccatcgcttggcatcagcagaggccagacacgggccctcgttacttgatgacagtcaacaatgatggcagtcacagcaagggggacgggatccctgatcgcttctcagtctccagctctgggcctgagcgctacctcacaatctccggcctccagtctgaggatgaggctgactatactgtcagacctggggcacgtggcattcaggtcttcggaccgggacaggcacgtcgcggtcagcccaaggcccaacccnctcgtcactctcgttccccaccctctcacgtctctactcgtcgagcgggtctggaccaacgggtccacaatacgnngn

SEQ ID NO: 53213 - DNA, 537 bp, Homo sapiens
  misc_feature: GYAE6OF01BG27H.29.78.H01.1.454.CMB.1.raw
  modified_base (532)..(532): a, c, t, g, unknown or other
  misc_feature (532)..(532): n is a, c, g, or t
  modified_base (536)..(537): a, c, t, g, unknown or other
  misc_feature (536)..(537): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccggggcccgacttgaccactggggccagggggacgctggtcaccgtctcctcagcctccaccaagggcccatccggtcttccccctggccaccctcctccaacgacgcacctcgtcggggcacacgcacgccctgggctgcctggtcaggactacttccagtctctatctgagcggctggcaggcgnatgnn

SEQ ID NO: 53214 - DNA, 567 bp, Homo sapiens
  misc_feature: GYAE6OF01CXY1C.29.78.H01.1.454.CMB.1.raw
  modified_base (211)..(211): a, c, t, g, unknown or other
  misc_feature (211)..(211): n is a, c, g, or t
  modified_base (434)..(434): a, c, t, g, unknown or other
  misc_feature (434)..(434): n is a, c, g, or t
  modified_base (516)..(516): a, c, t, g, unknown or other
  misc_feature (516)..(516): n is a, c, g, or t
  modified_base (520)..(521): a, c, t, g, unknown or other
  misc_feature (520)..(521): n is a, c, g, or t
  modified_base (524)..(524): a, c, t, g, unknown or other
  misc_feature (524)..(524): n is a, c, g, or t
  modified_base (528)..(528): a, c, t, g, unknown or other
  misc_feature (528)..(528): n is a, c, g, or t
  modified_base (534)..(534): a, c, t, g, unknown or other
  misc_feature (534)..(534): n is a, c, g, or t
  modified_base (539)..(539): a, c, t, g, unknown or other
  misc_feature (539)..(539): n is a, c, g, or t
  modified_base (544)..(544): a, c, t, g, unknown or other
  misc_feature (544)..(544): n is a, c, g, or t
  modified_base (548)..(548): a, c, t, g, unknown or other
  misc_feature (548)..(548): n is a, c, g, or t
  modified_base (550)..(550): a, c, t, g, unknown or other
  misc_feature (550)..(550): n is a, c, g, or t
  modified_base (555)..(555): a, c, t, g, unknown or other
  misc_feature (555)..(555): n is a, c, g, or t
  modified_base (558)..(558): a, c, t, g, unknown or other
  misc_feature (558)..(558): n is a, c, g, or t
  modified_base (560)..(561): a, c, t, g, unknown or other
  misc_feature (560)..(561): n is a, c, g, or t
  modified_base (563)..(563): a, c, t, g, unknown or other
  misc_feature (563)..(563): n is a, c, g, or t
  modified_base (565)..(565): a, c, t, g, unknown or other
  misc_feature (565)..(565): n is a, c, g, or t
tcagatagagtactcacgaccggtgctcgatttagtgtgagtagtttgggtttgggaggctcggtcaaggtcacctgtactctgagcagtggacacagccagctacgccatcgcttggcatcagcagaggccagacaccgggcctgttacttgatgacagtcaacaatgactggcagtccacagcaaggggcggatcccgtgatcgcttcncagtctccagctcgtgggcctagacgtcgtacttaccgtcacaatcctacccggaccttccgaagtcctaggaacggtctgacggtccttggacttattacctgtaccaaggtaccttgggggacctacgtcgggcctacgtttcgagggttccttcgggaccggggtactaaggtccaaccggttcgtccgggtcaacggcccctaaaggtcccaacccctntcgtaccaccttctccgttccccaccctcctacctacgttactctatcgtgacgtcggtctcggacaaggtccagagtacgnctcnnctntcgngcgtanacgtnacgcntacncngtacnctncnncntntc

SEQ ID NO: 53215 - DNA, 553 bp, Homo sapiens
  misc_feature: GYAE6OF01A14WT.29.78.H01.1.454.CMB.1.raw
  modified_base (547)..(547): a, c, t, g, unknown or other
  misc_feature (547)..(547): n is a, c, g, or t
  modified_base (551)..(552): a, c, t, g, unknown or other
  misc_feature (551)..(552): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacggggaccggggccgacttgaccacgtggggccaggggacgcgtggtcaccgtctcctcagcctccaccagggcccatcgtcttccccctcggccaccctcctcccaacgacgccaccctcgtcgggggcacgacgccgacgccctgggctcgcccttggtcaaggactacttccagtacctctatctgagcggcgtggcgacggcgnatgnng

SEQ ID NO: 53216 - DNA, 779 bp, Homo sapiens
  misc_feature: GYAE6OF01DMQ45.29.78.H01.1.454.CMB.1.raw
  modified_base (775)..(775): a, c, t, g, unknown or other
  misc_feature (775)..(775): n is a, c, g, or t
tcagatagagtactcacgaccggtgctcgatttagtgtgagtagtttgggtttgggggtcggcctggggtacggccggggggtcgctgagactcgtcctcgtgcggcctctggattaaggttttaggagtcatgccatgaactgggtcccgccaggctccgagggtaaggggctggagtgggtcgttcggtctattagtggtacagtggtggcgctagtatattatgcgaggacggcccgtggaacgggtccggttcaccgtacgtttcccagagacaattcgaagaacacgctgtatcgtgacaaagtggagagcctagacgactacgacgacgaccggccgtctagttattggtaggtaaaggcgagcgtagggaacgttaccggggacccgggtacccgtacgttacgaacccgtacggtacgggggaccgaagggggtaccgacgttacgggtacctacccggttctcccgttcgacggtacccctacccgaacccggtaacggggacccctaccgttccggtccccttccccccgtcggtacccctaaccccgtcccgttaccgaacgaccgacccgtaaccgtaccggtacggggaccctaacgacggtaccgacggtcccgtacggggacctccgggtacccgttaacgggtaaccgaaaccgggtaccgtaacccggttacccgttacgttacccttacgttaccgttaccgtgggtaacggtccgggtaccgtacgggaccgtaagggtacccgtatacgtcggtntacg

SEQ ID NO: 53217 - DNA, 682 bp, Homo sapiens
  misc_feature: GYAE6OF01A808T.29.78.H01.1.454.CMB.1.raw
tcagatagagtactcacgaccggtgctcgatttagtgtgagtagtttgggtttggggtctgagagaggagtccacccctgggatcttcaggtgttttcatttggtgatcaggacggaacagagagaactcaccatggagtttgggctgagcgtggtcgttttcttagtggctaattttaaaaggtgtccagtgtgacgtgcagttggtggagtcgtgggggcgcctgggtacggccgggggggtcgctgagactctcctgtgcggcctctggattaagttttaggagtcatgccatgaactgggtccgccaggctccgaggggaaggggctgggagtgggtctcggctagttagtggcaggtggtggcgctatatattatgcagaccgcccgtggaacggggtcccggtttacaaccgtatttcccagtacgactaactttcggaaacgaacaccggctaggtatccgttgactaaagtgggagagccctggacgactcggaccgaacgaccggtccgttacttaatttacgttaggtagtttaaacgggcgtaggtacgtaggggaaacgttacccggggggaacccgggggtacccccggaacggtttaccggaaccccgtaacgggttccggggggaccccgggaagggggggcccgtccggttcggggtaacccccgg

SEQ ID NO: 53218 - DNA, 671 bp, Homo sapiens
  misc_feature: GYAE6OF01CZE8C.29.78.H01.1.454.CMB.1.raw
  modified_base (243)..(243): a, c, t, g, unknown or other
  misc_feature (243)..(243): n is a, c, g, or t
  modified_base (269)..(269): a, c, t, g, unknown or other
  misc_feature (269)..(269): n is a, c, g, or t
  modified_base (308)..(308): a, c, t, g, unknown or other
  misc_feature (308)..(308): n is a, c, g, or t
  modified_base (319)..(319): a, c, t, g, unknown or other
  misc_feature (319)..(319): n is a, c, g, or t
tcagatagagtactcacgaccggtgctcgatttagtgtgagtagtttgggtttggggtccgagccatggtgcagactccccagagctctcctcctcctccactgcacagggtctctctcccagcctgtgctgactcaatcgccctctgcctctgccctcccgtgggagctcggtcaaggtcacctgtactctgagcagtgacacagcagctacgccatcgcttggcatcagcagagccagacncggcctgttactgatgacagtacaanaatgatggcagtcacgagacggaagggggacgatcccgngactcgcttcncacgtcctacgagcttcgtcgggcctggacgtccgaccttacctcaactactccgtcccggccttccgagttccgtaggaacggtatacgggacggtcttaggtaaccttaattaccgtggtaccgaacgggtacccgttgggggacctaccggttcgggactacgtttaccggacgggtttacccggttaccgggggaaccccggggtaacctaaacgggttccccgtaacccgggttccgggtaccgggtaccaaaccgggtcccccaaaacccggggtaccccccaaacccccggtaccgtttacgggtaccctacccgttccccgttacccggtttaacccccccccg

SEQ ID NO: 53219 - DNA, 536 bp, Homo sapiens
  misc_feature: GYAE6OF01BFB0Y.29.78.H01.1.454.CMB.1.raw
tcagatagagtactcacgaccggtgctcgatttagtgtgagtagtttgggtttggggtccgagccatggtgcagactccccagagctctcctcctcctccactgcacagggtctctctcccagcctgtgctgactcaatcgccctctgcctctgcctccctgggaggctcggtcaaggtcacctgtactctgagcagtggacacagcagctacgccatcgcttggcatcagcagaggccagacacgggccctcgttacttgatgacagtcaacaatgatggcagtcacagcgaagggggacggatccctgatcgcttctcagtctcagctcgtgggcctgacgcgctacctcacaactccgtccggcctcacgtctggaggatggaggctgacttattactgtcacggaccgtggggctacgtggctagttcgacgggttccgtacggggaccgggaccaacgggtccacccggtcggtcggtcacggcccgaacggccccaaccccgtctcgtaccacttccgtccgttaccccc

SEQ ID NO: 53220 - DNA, 552 bp, Homo sapiens
  misc_feature: GYAE6OF01A1KXS.29.78.H01.1.454.CMB.1.raw
  modified_base (384)..(384): a, c, t, g, unknown or other
  misc_feature (384)..(384): n is a, c, g, or t
  modified_base (550)..(552): a, c, t, g, unknown or other
  misc_feature (550)..(552): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagccgggaatacggggaccggggcccgacttgacccactggggccagggggacncgtggtcaccggtctcctcagcctccaccaagggccccatccggtcttccccctggccacccctcctcccaagacgcaccctcgtgggggcacgagcagccctgggcctgcctggtcaaggctactccagtactctatctgagcgggctgggcaaggcgacatagnnn

SEQ ID NO: 53221 - DNA, 798 bp, Homo sapiens
  misc_feature: GYAE6OF01BZW9F.29.78.H01.1.454.CMB.1.raw
  modified_base (240)..(240): a, c, t, g, unknown or other
  misc_feature (240)..(240): n is a, c, g, or t
  modified_base (301)..(301): a, c, t, g, unknown or other
  misc_feature (301)..(301): n is a, c, g, or t
  modified_base (356)..(356): a, c, t, g, unknown or other
  misc_feature (356)..(356): n is a, c, g, or t
tcagatagagtactcacgaccggtgctcgatttagtgtgagtagtttgggtttgggtctgagagaggagtccacccctgggatcttcaggtgttttcatttggtgatcaggacggaacagagagaactcaccatggagtttgggctgagctggtcttttcttgtggctaatttaaaaggtgtcagtgtgacgtgcagttggtggagtcgtgggggcgcctggggtacggccggggggtcncgtgagactctcctgtgcggcctctggattaagtttaggagtcatgccatgactgggtccncaggctccgagggaaggggctggagtggtctcggctatagtggcagtggtggcgntagtatatatcgacagaccgcccgtaggaacggggtcccggtttacaaccctacgttttcccgaagggtaacgaaccgtaaagttttaccggaaaacggtaaaccaaaccgggtcccttaagggttaacttaccgttacggaacccgtaaaaagttggggaaacgtaacgggacccgtttacgggaaggtaaccccgttaccgggaaaccggtaaccgaaccccgggggtacccgtttacccgttaaacgttttaagtttagggtttaacggtttaaaaacggggccggtaaaacggtccgttaaggggtaaaacgggttaacccgggggggaacccccggggggccccggtaaaccgtttaccgggaaccccggttaaaccggttccggggggggacccccgtaagggggggaaccccgtcgggttcggggttacccccgg

SEQ ID NO: 53222 - DNA, 581 bp, Homo sapiens
  misc_feature: GYAE6OF01B5EIS.29.78.H01.1.454.CMB.1.raw
  modified_base (579)..(579): a, c, t, g, unknown or other
  misc_feature (579)..(579): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattatgtgttaaaggcgagctggaatacgggaccgggccgacttgaccacgtggggccagggggacgctgggtcaccggtctcctcagccctccaccaacgggcccacgtccggtccttccccctcgggcccaccctccctccaacgacgccaccctcgtcggggccacagccacgcccgtgggcctcgcccgtggtcgaacggtacctaccttccacgtacctcctactccgtgacggtccgggcgtcggacgaacggcgacatagncg

SEQ ID NO: 53223 - DNA, 620 bp, Homo sapiens
  misc_feature: GYAE6OF01BLXKY.29.78.H01.1.454.CMB.1.raw
  modified_base (608)..(608): a, c, t, g, unknown or other
  misc_feature (608)..(608): n is a, c, g, or t
tcagatagagtactcacgaccggtgctcgatttagtgtgagtagtttgggtttggggtctgagagaggagtccacccctgggatcttcaggtgttttcatttggtgatcaggacggaacagagagaactcaccatggagtttgggctgagcgtggtcttttcttgtggctattttaaaaggtgtccagtgtgacgtgcagttggtggagtctgggggcgccgtggggtacggccgggggggtcgctgagactctcctgtgccggcctctggattaagttttaggagtcatgccatgaactgggtccgccaggctccgagggaaggggctgggagtgggtcgtcggctattagtggcaggtggtggcgctatatattatgcagacgccctggaacgggccgttcacctatttccagacgacaattacgaagaaccacgctgtatctagactaaaagtgggagacgtcctaggacgtacctcggaaccgaacgacccggccgttacttaattacgtttgtagttaaaagggcgaacgcgtagggaacgtaccgggggaccccggggcccgacgttcggaacccacggtcgggggacccgaagggggaccncggtgggtaccc

SEQ ID NO: 53224 - DNA, 869 bp, Homo sapiens
  misc_feature: GYAE6OF01DCS56.29.78.H01.1.454.CMB.1.raw
  modified_base (248)..(248): a, c, t, g, unknown or other
  misc_feature (248)..(248): n is a, c, g, or t
tcagatagagtactcacgaccggtgctcgatttagtgtgagtagtttgggtttggggtctgagagaggagtccacccctgggatcttcaggtgttttcatttggtgatcaggacggaacagagagaactcaccatggagtttgggctgagctggtctttttcttgtggtcttaattttaaaaggtgtccagtgtgacgtgcagttggtggagtcgtggggcgccgtggggtaccgggccggggggtcnctgagactctcctgtgcggcctcgtggtatttaaggtttaggagtcatcgaccagtacgaacgttcgggtccgaccgaggccgtaccggaagggggaacgggggtcgttaggggtacggttcggggttccgttaccgggtacgtttaaggtttacgggttcgggacgtaaggggttcgggttcgggccgttactttaaagttaatttaagtttacgtacggaccgtaaccggtaccccggtacccggttaacggggtaacccgggggtccccgttacctaacccttacgtttacccgaacggtaacgtaacctaaacggttaaccggaaaacgtacctacggttacttagttaacttccgtaaggaacgtaaaggttcggggaacgtacggtaccggtaacggaacccgtaccggtaaccggaaaccggacccgggttacccggtttaccgttagttttaaacgtttacggttaacgggtttaaggtaaccgggcgtaacggtaccgggttaaacgggaaccccggggttaacccggggaccccgggtccggtaaaccggttacccggaccggtaaccggggtcggggaccgtaccggggtaccgtccgtccggtaccccg

SEQ ID NO: 53225 - DNA, 555 bp, Homo sapiens
  misc_feature: GYAE6OF01BY90J.29.78.H01.1.454.CMB.1.raw
  modified_base (554)..(554): a, c, t, g, unknown or other
  misc_feature (554)..(554): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccggggcccgacttgaccacgtggggccaggggacgctggtcaccgtctcctcagcctccaccaagggcccatcggtcttccccctggccaccctccctccaacgacgccaccctcctcgggggccacgagccacgccctgggcctgcctggtcaaggactacttccagtacctctactctgaggccgggcgtggcgaacggcgacatgng

SEQ ID NO: 53226 - DNA, 583 bp, Homo sapiens
  misc_feature: GYAE6OF01CYKL1.29.78.H01.1.454.CMB.1.raw
  modified_base (576)..(576): a, c, t, g, unknown or other
  misc_feature (576)..(576): n is a, c, g, or t
  modified_base (582)..(583): a, c, t, g, unknown or other
  misc_feature (582)..(583): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccattttccagagacaattcgaagaacacgctgtatctgcaaatggagagcctgagactcgacgacacggccgtctattattgtgttaaaggcgagctggaatacgggaccggggcccgacgttgaccacgtggggccagggggacgcgtggtccaccgtcctcctcacgcctccaccaagggcccatccggtccttccccccgtgggcccacccgtcctacccaagtacgccaccctcgtcggggccacgacgccgacgccccgtgggcctcggcccttgggtacaacggaccttacttccagtacctctactcgtgacggcgggctggcgaacggcncgatgnn

SEQ ID NO: 53227 - DNA, 582 bp, Homo sapiens
  misc_feature: GYAE6OF01CSYAK.29.78.H01.1.454.CMB.1.raw
  modified_base (580)..(582): a, c, t, g, unknown or other
  misc_feature (580)..(582): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagccggaatacgggaccgggcccgacttgaccactggggccagggggacgcgtggtcaccggtctcctcacgccctccacccaagggcccacgtccggtccttccccctcggccacccctccctcccaacgacgccacctccgtcgggggccacgacgccacgcccgtcgggcctcggccgtcgggtccaacgggacctaccttccacgtacctctatcgtgaggcgggcgcggcgaacggcgacatagnnn

SEQ ID NO: 53228 - DNA, 707 bp, Homo sapiens
  misc_feature: GYAE6OF01ACULF.29.78.H01.1.454.CMB.1.raw
  modified_base (221)..(221): a, c, t, g, unknown or other
  misc_feature (221)..(221): n is a, c, g, or t
tcagatagagtactcacgaccggtgctcgatttagtgtgagtagtttgggtttggggtccgagccatggtgcagactccccagagctctcctcctcctccactgcacagggtctctctcccagcctgtgctgactcaatcgccctctgcctctgcctccctgggaggctcggtcaaggtcacctgtactctgagcagtggacacagcagctacgccatcgnttggcatcagcagaggccagacacgggccctcgttacttgatgacagtcaacaatgatggcagtcacgaggacggaagggggacggactccccgtgacgtccgtcttctccgagtcctccgaggtcctcggtcgggcctggacgtccgacctacccgtcaacctaacgtccgtcccggacccttccgaggtccgtaggaacggtacttcgggacggtccgttacggtaactttagttaccgtgtaccgaacgggtacccggtcgggggtacctaaccgggttcggacctttaacggttaccgtacggggtttacccggtaccggggggaaccccggggtaacgtaaccggggttccccgtaccccgggtttaccgggtacccgggtaccgaaccgggtccccccgaaaccggggtacccccccaaaacccccgtacgttacccggtaaccctacccggtttcccgttcccccggttaacccccccg

SEQ ID NO: 53229 - DNA, 551 bp, Homo sapiens
  misc_feature: GYAE6OF01DGTVP.29.78.H01.1.454.CMB.1.raw
  modified_base (533)..(533): a, c, t, g, unknown or other
  misc_feature (533)..(533): n is a, c, g, or t
  modified_base (543)..(543): a, c, t, g, unknown or other
  misc_feature (543)..(543): n is a, c, g, or t
  modified_base (550)..(551): a, c, t, g, unknown or other
  misc_feature (550)..(551): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgccaggctccagggaagggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccggggcccgacttgaccacgtggggccaggggacgcgtggtcaccgtctcctcagcctccaccaacgggcccatccggtccttccccctcgaccaccctccctccaacgacgccaacccgtcgtgggggccacgacgccgcccgtgggctcgcctggcaggactactccagtactctatctgagcgggntggcgaggcncatacgnn

SEQ ID NO: 53230 - DNA, 473 bp, Homo sapiens
  misc_feature: GYAE6OF01BL9F7.29.78.H01.1.454.CMB.1.raw
  modified_base (297)..(297): a, c, t, g, unknown or other
  misc_feature (297)..(297): n is a, c, g, or t
  modified_base (319)..(319): a, c, t, g, unknown or other
  misc_feature (319)..(319): n is a, c, g, or t
  modified_base (334)..(334): a, c, t, g, unknown or other
  misc_feature (334)..(334): n is a, c, g, or t
  modified_base (408)..(408): a, c, t, g, unknown or other
  misc_feature (408)..(408): n is a, c, g, or t
  modified_base (470)..(473): a, c, t, g, unknown or other
  misc_feature (470)..(473): n is a, c, g, or t
tcagatagagtactcacgaccggtgctcgatttagtgtgagtagtttgggtttggtggtctctctcccagcctgtgctgactcaatcgccctctgcctctgcctccctgggaggctcggtcaaggtcacctgtactctgagcagtggacacagcagctacgccatcgcttggcatcagcagaggccagacacgggccctcgttacttgatgacagtcaacaatgatggcagtcacagcaagggggacggatccctgatcgcttctcagtctccagctctgggcctgagcgctacctnacatctccgcctcagtctgagntgagctgactatacngtcagacctggggcactgcattcaggtctcggaccgggacaggtcacgtcgtcgtcacgcccaagcccaacccncgtcgtcactctcgttcccaccctcctcacgtctctatcgtgagcgggctggcaggcacatnnnn

SEQ ID NO: 53231 - DNA, 621 bp, Homo sapiens
  misc_feature: GYAE6OF01DYS94.29.78.H01.1.454.CMB.1.raw
  modified_base (388)..(388): a, c, t, g, unknown or other
  misc_feature (388)..(388): n is a, c, g, or t
  modified_base (618)..(618): a, c, t, g, unknown or other
  misc_feature (618)..(618): n is a, c, g, or t
tcagatagagtactcacgaccggtgctcgatttagtgtgagtagtttgggtttgggggcgcctgggtacggccgggggggtcgctgagactctcctgtgcggccttctggattaagttttaggagtcatgccatgaactgggtccgccaggctccagggaaggggctggagtgggtcgtcggctattagtggcagtggtggcgctatatattatgcagacggccctgagggccgttcaccagtttccagagacaattcgaagacacgctgtatctgacaaatggagagcctgagacgtcgacgacacggccgtcgtagttattgtagttaaaggcgagctaggaacgtacgggaccgggccgacttgaccacgtggggccaggggacncgtggtccaccgtctcctcacgccctccaccgaaggcccactccggtacccttaccccgtcggcctaccctcctaccaacgacgccaaccctccgtcgggggccacgacgccacggcccgtcgggccttcggtccgttcggtaccgaaggtaccttaccgttccgaagtaccttacgtaacgtccgtaggacggtcggggacgttgggaccgaacgggcgacgactaggntcg

SEQ ID NO: 53232 - DNA, 592 bp, Homo sapiens
  misc_feature: GYAE6OF01A5BBZ.29.78.H01.1.454.CMB.1.raw
  modified_base (584)..(584): a, c, t, g, unknown or other
  misc_feature (584)..(584): n is a, c, g, or t
  modified_base (590)..(590): a, c, t, g, unknown or other
  misc_feature (590)..(590): n is a, c, g, or t
  modified_base (592)..(592): a, c, t, g, unknown or other
  misc_feature (592)..(592): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacggggaccggggcccgacgttgaccacgtgggggccagggggacgcgtcggtcaccgtctccctcacgccctccacccgaacgggcccactccggttccttccccccgtcggcccacccctccctacccaacgacgccacccgtccgtcgggggccacgacgccacgcccgtcgggctcgccgtggtccaaggactacttccacgtacctctacgtctgacggccgggcgtggacgaaggcganacgtgngn

SEQ ID NO: 53233 - DNA, 612 bp, Homo sapiens
  misc_feature: GYAE6OF01C2Y31.29.78.H01.1.454.CMB.1.raw
  modified_base (610)..(610): a, c, t, g, unknown or other
  misc_feature (610)..(610): n is a, c, g, or t
  modified_base (612)..(612): a, c, t, g, unknown or other
  misc_feature (612)..(612): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgccaggctccagggaagggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtagttaaaggcgagctggaatacgggaccgggccgacttgaccacgtggggccaggggacgcgtggtcaccgtctcctcagcctccaccaacgggcccatccggtccttcccccgtcggcccaccctcctaccaacgacgccacccgtcgtcggggccacgacgccacgccccgtgggcctcggccgtcggtaccaacgggtaccttaacccgttcccaacggttaccttcctaacgttccgtaggacggtccggggccgttacgggaccgtaaacggggccgacgacgtagngn

SEQ ID NO: 53234 - DNA, 648 bp, Homo sapiens
  misc_feature: GYAE6OF01A3HLA.29.78.H01.1.454.CMB.1.raw
  modified_base (131)..(131): a, c, t, g, unknown or other
  misc_feature (131)..(131): n is a, c, g, or t
  modified_base (363)..(363): a, c, t, g, unknown or other
  misc_feature (363)..(363): n is a, c, g, or t
  modified_base (642)..(642): a, c, t, g, unknown or other
  misc_feature (642)..(642): n is a, c, g, or t
  modified_base (645)..(645): a, c, t, g, unknown or other
  misc_feature (645)..(645): n is a, c, g, or t
  modified_base (647)..(648): a, c, t, g, unknown or other
  misc_feature (647)..(648): n is a, c, g, or t
tcagatagagtactcacgaccggtgctcgatttagtgtgagtagtttgggtttgggggcgcctgggtacggccgggggggtcgctgagactccctcgtgcggccgtcctgagtaagttttaaggtaggtcntgccactaaatacggtccggccacgacgtccacgggaaggggacggtcggaggtgggtcgtcgcgtattagtggcgagtggtggcgctatatattatgcagacgccctcgagggaccggttcctaccactttcctacgagacaattcgaagaaacacgctgtatactcgacgaaataggtaggaagccgtcgagactcgacgacacggccgtctatattgtgttaaaggcgngagtgaagtacgggccgggcccgctagaccaccgtggggccgacggacggctggtcgacccgtccgtcctcgagccctcccaccgaacgggcccgacctcggtccgttccccctccgggcgtaccccctcccgtcccgaacgacgtccacccttacggtcggggacgaccagccgacgccccgtcgggcgtcgcccgtcgggttaccgaaggaccttaccttcgacgtacttctctacgtacggcggccgggacgtcgggacgaacggcggccaggtancgngnn

SEQ ID NO: 53235 - DNA, 558 bp, Homo sapiens
  misc_feature: GYAE6OF01AHZH9.29.78.H01.1.454.CMB.1.raw
  modified_base (326)..(326): a, c, t, g, unknown or other
  misc_feature (326)..(326): n is a, c, g, or t
  modified_base (540)..(540): a, c, t, g, unknown or other
  misc_feature (540)..(540): n is a, c, g, or t
tcagatagagtactcacgaccggtgctcgatttagtgtgagtagtttgggtttggggtccgagccatggtgcagactccccagagctctcctcctcctccactgcacagggtctctctcccagcctgtgctgactcaatcgccctctgcctctgcctccctgggaggctcggtcaaggtcacctgtactctgagcagtggacacagcagctacgccatcgcttggcatcagcagaggccagacacgggccctgttactgatgacagtcaaacaatgatggcagtcacgaggacgaagggggacggactcccgtgactcgctttccncacgtcctccgagtcctcgtcgggcctggacgccgacttacctcaactaactccgtcccggcctccgagtctgaggatggagtctagacttattactgtcacgtaccgtgggactacgtggactacgttcgacggttccgtaccgggaccgggtaccacggtccgaccggtcggtccggtcacgcccgaacggccccaacccgtactcgtaccnccgttcgtccgtcccccg

SEQ ID NO: 53236 - DNA, 623 bp, Homo sapiens
  misc_feature: GYAE6OF01AD1ND.29.78.H01.1.454.CMB.1.raw
  modified_base (616)..(616): a, c, t, g, unknown or other
  misc_feature (616)..(616): n is a, c, g, or t
  modified_base (621)..(621): a, c, t, g, unknown or other
  misc_feature (621)..(621): n is a, c, g, or t
  modified_base (623)..(623): a, c, t, g, unknown or other
  misc_feature (623)..(623): n is a, c, g, or t
tcagatagagtactcacgaccggtgctcgatttagtgtgagtagtttgggtttggggcgcctgggtacggccggggggtcgctgagactctcctgtgcggcctctggattaagttttaggagtcatgccatgaactgggtccgccaggctccagggaagggctggagtgggtctcggctattagtggcagtggtggcgctatatattatgcagacgccctgaagggccggttcaccatttccagagacaattcgaagaacacgctgtatctgcaaaatggagagcctgagactcgacgacacggccgtctattattgtagttaaaggcgagctaggaagtaccggggacccggggcccgacttcggaccacgtcgggggccgaggggacgctggtccaccgttctccctcgacgccctacccaccgaacgggcccagtccggtccttccccctcggcccaccctccctacccaacgacgacctaccctccgtcggggaccacgacgccgacgccccgtacgggcctcgtcccgtcggttaccaacgggtaccttaaccttcccacgttaccttcgtacgtcgtggacggtcgggaccgtggaccgaacggtccganatagngn

SEQ ID NO: 53237 - DNA, 647 bp, Homo sapiens
  misc_feature: GYAE6OF01C9O5V.29.78.H01.1.454.CMB.1.raw
  modified_base (386)..(386): a, c, t, g, unknown or other
  misc_feature (386)..(386): n is a, c, g, or t
  modified_base (644)..(644): a, c, t, g, unknown or other
  misc_feature (644)..(644): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtagttaaaggcgagctaggaagtacggggaccggggcccgacttgaccacgtggggccagggggaccncgtggtccaccgtcctcctcacgccctccaccgaacgggcccacgtccggtcccttccccccgtcggcccctaccccgtcccttacccaacggtacgacctaccctccggtcgggggccacgacgccgacgcccgtcgggccgtcgcccgtggttaccgaacgggtacctaccgttacccgtacgtaccgttcctacttccgtacggacgggtccgggaccggttcgggaccgtaacggggccgacgtaacgtacggngcg

SEQ ID NO: 53238 - DNA, 510 bp, Homo sapiens
  misc_feature: GYAE6OF01CI6KL.29.78.H01.1.454.CMB.1.raw
  modified_base (236)..(236): a, c, t, g, unknown or other
  misc_feature (236)..(236): n is a, c, g, or t
  modified_base (311)..(311): a, c, t, g, unknown or other
  misc_feature (311)..(311): n is a, c, g, or t
  modified_base (324)..(324): a, c, t, g, unknown or other
  misc_feature (324)..(324): n is a, c, g, or t
  modified_base (342)..(342): a, c, t, g, unknown or other
  misc_feature (342)..(342): n is a, c, g, or t
  modified_base (507)..(508): a, c, t, g, unknown or other
  misc_feature (507)..(508): n is a, c, g, or t
  modified_base (510)..(510): a, c, t, g, unknown or other
  misc_feature (510)..(510): n is a, c, g, or t
tcagatagagtactcacgaccggtgctcgatttagtgtgagtagtttgggtttggtggtctctctcccagcctgtgctgactcaatcgccctctgcctctgcctccctgggaggctcggtcaaggtcacctgtactctgagcagtggacacagcagctacgccatcgcttggcatcagcagaggccagacacgggccctcgttacttgatgacagtcaaacaatgatggcagtcanagcgaagggggacggatccctgatcgcttctcagtcctccagcctcgtgggcctgacgcgctacctcacaatccnccggcctcagtcngagatgagctgactatcngtcagaccgtggggcacgtggctattcgaggtcttcgggaaccgggaacaacggtccacggtcgtcggtcacgacccaacggcccaacccgctcgtccacttctcttccccacctcctctacgtctctatccgtgaggcggctacgggacaacggtcgacatagnngn

SEQ ID NO: 53239 - DNA, 624 bp, Homo sapiens
  misc_feature: GYAE6OF01COS69.29.78.H01.1.454.CMB.1.raw
  modified_base (623)..(623): a, c, t, g, unknown or other
  misc_feature (623)..(623): n is a, c, g, or t
tcagatagagtactcacgaccggtgctcgatttagtgtgagtagtttgggtttgggggcgcctgggtacggccgggggggtcgctgagactctcctgtgcggcctctggattaagtttttaggagtcatgccatgaactgggtccgccaggctccgagggaaggggctggagtgggtctcggctattagtggcagtggtggcgctatatattatgcagacgccctgaagggccggttcaccatttccagagacaattcgaagaacacgctgtatctgcaaagtggagagcctgagactcgacgacacggccgtctattattgtagttaaagcgagctaggaagtacgggaccgggccgacttgaccacgtggggccaggggacgcgtggtcaccggtctcctcacgccctcccaccgaacgggccccaagttccggtccctttccccccgtcggcccctacccctcctacccaacgacgaccacccgtccgtgggggaccacgacgccacgccccgtgggcctcgcccgttcggtacgaacgggtaccttaccgttacccacgttacctacttacgtcctggaacggtccggggcgtcgggacgtaacgggcgaccgaatgcng

SEQ ID NO: 53240 - DNA, 564 bp, Homo sapiens
  misc_feature: GYAE6OF01B5H7Q.29.78.H01.1.454.CMB.1.raw
  modified_base (268)..(268): a, c, t, g, unknown or other
  misc_feature (268)..(268): n is a, c, g, or t
  modified_base (450)..(450): a, c, t, g, unknown or other
  misc_feature (450)..(450): n is a, c, g, or t
  modified_base (492)..(492): a, c, t, g, unknown or other
  misc_feature (492)..(492): n is a, c, g, or t
  modified_base (561)..(562): a, c, t, g, unknown or other
  misc_feature (561)..(562): n is a, c, g, or t
tcagatagagtactcacgaccggtgctcgatttagtgtgagtagtttgggtttggtggtctctctcccagcctgtgctgactcaatcgccctctgcctctgcctccctgggaggctcggtcaaggtcacctgtactctgagcagtggacacagcagctacgccatcgcttggcatcagcagaggccagacacgggccctcgttacttgatgacagtcaaacaatgatggcagtcacagcgaagggggacggatcccgtgatcgcttcncagtctccagctcgtgggcctgacgcgctacctcacactccgtccgcctcagtctgagatgaggtctgactattactgtcagtaccgtgggactacgtggctattcgagggttccgtaccgggaccgggactaagggtccaccggttcgtccggtcacggaccccgaacggccccaaacccncgttcgtacccacgttccctccggttacccccgcccttaccnctacgttaccctcgtaacgtccgtaggacgggccgggtctgggaacctaacggggccgactaagtcggnncg

SEQ ID NO: 53241 - DNA, 536 bp, Homo sapiens
  misc_feature: GYAE6OF01EU41J.29.78.H01.1.454.CMB.1.raw
  modified_base (531)..(531): a, c, t, g, unknown or other
  misc_feature (531)..(531): n is a, c, g, or t
  modified_base (535)..(536): a, c, t, g, unknown or other
  misc_feature (535)..(536): n is a, c, g, or t
tcagatagagtactcacgaccggtgctcgatttagtgtgagtagtttgggtttggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccggggcccgacttgaccactggggccaggggacgctggtcaccgtctcctcagcctccaccaaggcccatcgtcttccccctcggcaccctcctccaacgacgcacctctcgggggcacacgcagccctgggctgcctggtcaaggactacttccagtactctatctgagcgggctggcaaggcgcntagnn

SEQ ID NO: 53242 - DNA, 763 bp, Homo sapiens
  misc_feature: GYAE6OF01CL4OT.29.78.H01.1.454.CMB.1.raw
  modified_base (759)..(759): a, c, t, g, unknown or other
  misc_feature (759)..(759): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgccgaggctccgagggaaggggctggagtgggtctcggctattagtggcagtggtggcgctatatattatgcagacgccctgaacgggccgttcaccatttccagagacaattcgaagaacacgctgtatctgacaaatggagagcctgagactcgacgacacggccgtctattattgtagttaaaggcgtagcgtagggaacgtaccggggacccggggcccgtacgttcggacccaacggtcgggggacccgaaggggggaaccgtcgtacgggtccaacccggttcctccctcgaaccggcccttacccgaacccgaacggggcccctaagtcccgggttacccttcccccccgttcgggacccctaacccccttcccttaacccgaaacgaacggccctaacccgtccggtacgggggacccaaccgacggacccgaacggtccccgtacggggtcctccgggtacccgttacgggttaccgaaaccgggtaccgtttaaccccgttaccgtaaccggttaaacccttccgtttaaacgtcccgttaagggaccgggttccggggccggtttaccgggaccggtaaacgggccggttaaccgaagttacggngtcg

SEQ ID NO: 53243 - DNA, 611 bp, Homo sapiens
  misc_feature: GYAE6OF01C8ZUK.29.78.H01.1.454.CMB.1.raw
  modified_base (97)..(97): a, c, t, g, unknown or other
  misc_feature (97)..(97): n is a, c, g, or t
  modified_base (106)..(106): a, c, t, g, unknown or other
  misc_feature (106)..(106): n is a, c, g, or t
  modified_base (121)..(122): a, c, t, g, unknown or other
  misc_feature (121)..(122): n is a, c, g, or t
  modified_base (585)..(585): a, c, t, g, unknown or other
  misc_feature (585)..(585): n is a, c, g, or t
  modified_base (608)..(608): a, c, t, g, unknown or other
  misc_feature (608)..(608): n is a, c, g, or t
  modified_base (610)..(611): a, c, t, g, unknown or other
  misc_feature (610)..(611): n is a, c, g, or t
tcagatagagtactcacgaccggtgctcgatttagtgtgagtagtttgggtttgggggcgcctgggtacggccggggggtcgctgagactctcctgngcggcctgngaagtagttagatcnngcatgactggccgcagctccagggagggctggagtgggtctcggctattagtggcagtggtgcgctatatattatgcagacgccctgaagggccggttcaccatttccagagacaattcgaagaacacgctgtatctgactaaagtggagagcctgagactcgacgacacggccgtctattattgtagttaaaggcgagccggaatacggggaccgggcccgaacgttgaccgcgtaaagggcccgaaggggacgcgtgggttcacccggtcttccctacacggccctaccaacccgaacggggtcccccaacgttcccgggtccctttccccccgtcgggaccctaaccccctccccgttaccaaacgaacggcccaccgttccgcgggggcacgacggcacgcccgtcggcgtcgtccgtcggtacgacgacgtacctcctacgttactctactcgtacgngtcggcgtgacgacgcgcatagngnn

SEQ ID NO: 53244 - DNA, 536 bp, Homo sapiens
  misc_feature: GYAE6OF01AI1AQ.29.78.H01.1.454.CMB.1.raw
  modified_base (322)..(322): a, c, t, g, unknown or other
  misc_feature (322)..(322): n is a, c, g, or t
  modified_base (349)..(349): a, c, t, g, unknown or other
  misc_feature (349)..(349): n is a, c, g, or t
  modified_base (363)..(363): a, c, t, g, unknown or other
  misc_feature (363)..(363): n is a, c, g, or t
tcagatagagtactcacgaccggtgctcgatttagtgtgagtagtttgggtttggggtccgagccatggtgcagactccccagagctctcctcctcctccactgtcacagggtctctctcccagcctgtgctgactcaatcgccctctgcctctgcctccctgggaggctcggtcaaggtcacctgtactctgagcagtggacacagcagctacgccatcgcttggcatcagcagaggccagacacgggccctgttacttgatgacagtcaacaatgatggcagtcacagcgaagggggacggatcccgtgactcgctttcncagtcctcagctcgtgggcctgacgcnctacctcacatccnccgcctccagtctagaggatggacggtctagtacttattaccgtgtacgacggtccgtggggcacgtggactagttcgaggttccgtacgggaccgggtacacggtccaccggtcgtcgtccgacgccccgaacggccccaacccgtcttcgacctctccgttccgtaccccc

SEQ ID NO: 53245 - DNA, 566 bp, Homo sapiens
  misc_feature: GYAE6OF01DUW0U.29.78.H01.1.454.CMB.1.raw
  modified_base (561)..(561): a, c, t, g, unknown or other
  misc_feature (561)..(561): n is a, c, g, or t
  modified_base (565)..(566): a, c, t, g, unknown or other
  misc_feature (565)..(566): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccggggccgacttgaccacgtggggccagggggacgctggtcaccgtctcctcacgccctccaccgaacgggcccactcggtccttcccccgtcggcccaccctccctcccaacgacgcacctcgtcggggccacgagcacgcccgtgggcctcgccgtcggtcaacggactaccttccacgtactctatctgacggcgggctggcgtacggcganatgnn

SEQ ID NO: 53246 - DNA, 667 bp, Homo sapiens
  misc_feature: GYAE6OF01EJ50D.29.78.H01.1.454.CMB.1.raw
tcagatagagtactcacgaccggtgctcgatttagtgtgagtagtttgggtttggggtccgagccatggtgcagactccccagagctctcctcctcctccactgcacagggtctctctcccagcctgtgctgactcaatcgccctctgcctctgcctccctgggaggctcggtcaaggtcacctgtactctgagcagtggacacagcagctacgccatcgcttggcatcagcagaggccagacacgggccctgttacttgatgacagtcaacaatgatggcagtcacgaggcgaagggggacggatcccgtgatcgcttctcagtctccagctcgtgggcctgacgccgcctacctcaactaactccgtacccggccctaccgacgttccgtaggacggtaacgtggacggtcgttagtaaccgttagtttaccgtcgtaccgtaacggtacccggtgggggacctaacggttacggtacctagtttccggaacggggtttacccggtttaccgggggaaccccgggggtaaaccctaacggggttcccgtaacccgggttccggtacccgggttacccgaaccgggacccccgtaaaccggggaccccctaaacccccgtacgttaccggtaccctacccgttcccgttcccgtttaacccccccg

SEQ ID NO: 53247 - DNA, 572 bp, Homo sapiens
  misc_feature: GYAE6OF01BCP21.29.78.H01.1.454.CMB.1.raw
  modified_base (567)..(567): a, c, t, g, unknown or other
  misc_feature (567)..(567): n is a, c, g, or t
  modified_base (571)..(572): a, c, t, g, unknown or other
  misc_feature (571)..(572): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccgggcccgacttcgaccacgtggggccgaggggacgcgtggtcaccggtctcctcacgccctccaccgaacgggcccactccggtccttcccccgtcggccaccctcctccaacgacgccacctcgtcggggcacgacgcacgcccgtcgggctcgcctcggtacaacggtacctacgttccagtacctctagtctgacggcggcgtggacgaacggcganatgnn

SEQ ID NO: 53248 - DNA, 547 bp, Homo sapiens
  misc_feature: GYAE6OF01DBN0N.29.78.H01.1.454.CMB.1.raw
  modified_base (266)..(266): a, c, t, g, unknown or other
  misc_feature (266)..(266): n is a, c, g, or t
  modified_base (299)..(299): a, c, t, g, unknown or other
  misc_feature (299)..(299): n is a, c, g, or t
  modified_base (546)..(547): a, c, t, g, unknown or other
  misc_feature (546)..(547): n is a, c, g, or t
tcagatagagtactcacgaccggtgctcgatttagtgtgagtagtttgggtttggtggtctctctcccagcctgtgctgactcaatcgccctctgcctctgcctccctgggaggctcggtcaaggtcacctgtactctgagcagtggacacagcagctacgccatcgcttggcatcagcagaggccagacacgggccctgttacttgatgacagtcaacaatgatgacagtcacagcgaaagggggacggatccctgatcgcttcncagtctccagctcgtgggcctgagcgctacctnacaatcctccggcctcagtctgaggatgagctgactatactgtcagaccgtggggcacgtggcattcgacgggttcgttcgggaaccgggtacaacgggtccaccggttcgtccggtacacggaccccgaacggcccaaccccgacgttcgtacctaccttccgttcgttcccccgccccttcctacctacgttacctacctatccgtggacggtcgggcctcgggacgaaacgggcgacagtacgnn

SEQ ID NO: 53249 - DNA, 747 bp, Homo sapiens
  misc_feature: GYAE6OF01DBLDO.29.78.H01.1.454.CMB.1.raw
  modified_base (235)..(235): a, c, t, g, unknown or other
  misc_feature (235)..(235): n is a, c, g, or t
tcagatagagtactcacgaccggtgctcgatttagtgtgagtagtttgggtttggggtccgagccatggtgcagactccccagagctctcctcctcctccactgcacagggtctctctcccagcctgtgctgactcaatccgccctctcgcctctcgccctcccgtgggacggctcggtcaaggtccacctgtactctgagcaggtgacacagcagctacgccatcgcttggcancagcaggacgccagaccgacggtccctgttactgactgaacagtacaaacaagtgatggacagtcacgagacggtaaggggcgactccgtagactcgtcttcgacgtacgtccgccgagtcctcggtcgggactacggacgtccctaccttaccctacaaccgttactcccgttcccggtaccctaccgtaacgttccgtagggaacggttacgtcgggaacggttccgtaaggttaacctttaacgtttaccggttacggtaaccggtaacgggtacccgggtacgggggtaccccttaacggtcccgggttaacttaaccgggtttaccggttaaccggggtttcccgggtttaaacccggggggaaccccggggtaaacccgtaccggggttaccccggtacccggtttacccgggtaccgggtaacccggacccggtaacccccggaacccggtaacccccaaaccccgttcgtaccgtaccctccgttccccgtcggttaccccccg

SEQ ID NO: 53250 - DNA, 612 bp, Homo sapiens
  misc_feature: GYAE6OF01DYPKI.29.78.H01.1.454.CMB.1.raw
  modified_base (386)..(386): a, c, t, g, unknown or other
  misc_feature (386)..(386): n is a, c, g, or t
  modified_base (443)..(443): a, c, t, g, unknown or other
  misc_feature (443)..(443): n is a, c, g, or t
tcagatagagtactcacgaccggtgctcgatttagtgtgagtagtttgggttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgaagctaggaagtacggggacccgggcccgacttcgaccacgtggggccagggggacncgtggtcaccgtctcctcagcctccaccgaacgggcccagtccggtccttcccccgnggccctccctgcctaccgaggcgccaccctccgagacgcacgacggccggccctggggacctcggcccgttgggtacccaagggtaccttaaccgttcccgaacgttacctactacgtacgtcggacggccggggtcttcgggaaccgaacggggccgaccgtagtggc

SEQ ID NO: 53251 - DNA, 579 bp, Homo sapiens
  misc_feature: GYAE6OF01CCXB8.29.78.H01.1.454.CMB.1.raw
  modified_base (491)..(491): a, c, t, g, unknown or other
  misc_feature (491)..(491): n is a, c, g, or t
  modified_base (536)..(536): a, c, t, g, unknown or other
  misc_feature (536)..(536): n is a, c, g, or t
  modified_base (569)..(569): a, c, t, g, unknown or other
  misc_feature (569)..(569): n is a, c, g, or t
  modified_base (577)..(577): a, c, t, g, unknown or other
  misc_feature (577)..(577): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtagttaaaggcgagcgtaggaagtacgggaccggggacccgacgttgaccacgtggggccgaggggccgacgtggtcaccgtctcctcacgcctccaccgaacgggccccaagtccggtccttcccccctggcctacccctcctaccaagaccgccacctcgtcggggcacncgcacgcccgtggctcgcctggtcaacggcctactccagtacctntactctagaggccggccgtgggaccacgggacnccaatagntg

SEQ ID NO: 53252 - DNA, 616 bp, Homo sapiens
  misc_feature: GYAE6OF01BD9F8.29.78.H01.1.454.CMB.1.raw
  modified_base (214)..(214): a, c, t, g, unknown or other
  misc_feature (214)..(214): n is a, c, g, or t
  modified_base (240)..(240): a, c, t, g, unknown or other
  misc_feature (240)..(240): n is a, c, g, or t
tcagatagagtactcacgaccggtgctcgatttagtgtgagtagtttgggtttggggtctgagagaggagtccacccctgggatcttcaggtgttttcatttggtgatcaggacggaacagagagaactcaccatggagtttgggctgagcgtgtctttctagtggctatttaaaggtgtcagtgtgacgtgcagttggtggagtctgggggcnccgtggggtacgggccgggggggtcncgtgagactctcctgtgcggcctctggattaaggttttaggagtcatgccatgaactggccgccaggctccgagggaaggggctggagtgggtctcggctagtagtggcaggtggtggcgctatatattatgacagacgccctaggaacgggccggttacacctatttccagtagacaattcgaagaacacgctagtatctgactaatggagtagcctaggacgaccgtacgacgacgaccggtaccggttacttaattagttgtaggtttaaaggcgtagacgtaggaaggtaccggggacccgggtacccggtacgttaccggaccgtaaccgggttcggggaccgaggggggtaccgcgttgggtaccccggg

SEQ ID NO: 53253 - DNA, 594 bp, Homo sapiens
  misc_feature: GYAE6OF01E0R67.29.78.H01.1.454.CMB.1.raw
tcagatagagtactcacgaccggtgctcgatttagtgtgagtagtttgggtttggggtctgagagaggagtcccacccctgggatcttcaggtgttttcatttggtgatcaggacggaacagagagaactcaccatggagtttgggctgagctggctttttcttgtggctattttaaaaggtgtccagtgtgacgtgcagttggtggagtctggggggcgccgtggggtacggccgggggggtcgctgagactctcctgtgcggcctctggattaagttttaggagtcatgccatgaactgggtccgccaggctccgaggggaaggggctggaggtgggtctcggctagttagtggcaggtggtggcgctatatattatgcagacgccctggaacgggtccgttcacctatttccagagactaattcgaagaacacgtctagtatctgacaaagtggagacgctgacgactcgacgacgaccggtcctacttattattgtagttaaggcgtagcgtagggaacgtaccggggaccggggccctacgttaccggaccgacggtcggggaccgagggggaccgtcgtcgggtcccg

SEQ ID NO: 53254 - DNA, 547 bp, Homo sapiens
  misc_feature: GYAE6OF01C8XY3.29.78.H01.1.454.CMB.1.raw
  modified_base (542)..(542): a, c, t, g, unknown or other
  misc_feature (542)..(542): n is a, c, g, or t
  modified_base (544)..(544): a, c, t, g, unknown or other
  misc_feature (544)..(544): n is a, c, g, or t
  modified_base (546)..(547): a, c, t, g, unknown or other
  misc_feature (546)..(547): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtagttaaaggcgagctaggaatacgggaccgggcccgacttgaccacgtggggccagggggacgctggcaccgtctcctcagcctccaccaggcccatcggtccttccccgtggccaccctcctaccaagacgcacctcgtcggggcacgcgcacgcccgtgggctgccgtggtacgaaggacctacttccagtactctactcgtgaggcggctggcaggcgnangnn

SEQ ID NO: 53255 - DNA, 838 bp, Homo sapiens
  misc_feature: GYAE6OF01CUABT.29.78.H01.1.454.CMB.1.raw
  modified_base (186)..(186): a, c, t, g, unknown or other
  misc_feature (186)..(186): n is a, c, g, or t
  modified_base (222)..(222): a, c, t, g, unknown or other
  misc_feature (222)..(222): n is a, c, g, or t
  modified_base (245)..(245): a, c, t, g, unknown or other
  misc_feature (245)..(245): n is a, c, g, or t
tcagatagagtactcacgaccggtgctcgatttagtgtgagtagtttgggtttggggtctgagagaggagtccacccctgggatcttcaggtgttttcatttggtgatcaggacggaacagagagaactcaccatggagtttgggctgagcggtcgtggttctaaggtcggctaattttaaaaggngtcagtgtgacgtgcagttggtggagtctgggggcncctgggtacggccgggggggtcncgtgagctctcgtgtgcgcctcgtaggtatttaaggtttaggacgtcagtcgacctagtacgtaacgttcgggtcccgccgacggtccgtaccggaaggggtaacggggtcgtagggtacggttcgggtccgtacggtacgtttaagttagggtcggtacgtagggttcgggtcggtccgtaacgtttaattagttaacgttagtacggaccgtaacggtacccggtcccgtaagggtaacccggggttcccgtttaacgaacccgtttaacgtttaccgaacggtaacgtaacgttaacgttaccggaaacgtaaccgtacgtacgttagtactacgtacgaacgtaaaggtacgggaacgtaccgtccgtaacggtaacgtaccgtaccggacccgtaaccggtaccggtaccgttacgtttaagtttacggtttacggttaaggttaaacggtccgtaacggttaccggtaacgggtaaacccgggtaaccccgggggtaccccggggttaacccttacggttaccccggaacccggtacggggtaccggggaacccgggtacggggacccgttcggtacccggtacccg

SEQ ID NO: 53256 - DNA, 637 bp, Homo sapiens
  misc_feature: GYAE6OF01BL5FZ.29.78.H01.1.454.CMB.1.raw
tcagatagagtactcacgaccggtgctcgatttagtgtgagtagtttggggtttggggagagctctggggagtctgcaccatggctcggaccccactcctcttcctcaccctcctcctccactgcacagggtctctctcccagcctgtgctgactcaatccgccctctgcctctcgccctcccgtgggaggctcggtcaaggtcacctgtactctgagcagtggacacagcagctacgccatcgctggcatcagcagagcagacgacggcctcgttactgatgacagtacaacaatgatggcagtacaacgaggacggaaagggggacggactcccgtagacgtcgtcttactcgtacgtcctcgacgtcgtcgtcgggcctggacgccgtacctaccgtacaactaacgtcccgtcccggtcctaccgtacggttcgtaggaacggtagtacggacggtacttagtaacctttacgttacgtcgttaccgaacggtaccggtcggggtaccacggttcggactacgttcgtacgggttaccggttaccggggaacccgggtacgaacgggttcccgacccggttccgggtaccggtaccgaccggtaccccgaaaccggacccctaaccccgtacg

SEQ ID NO: 53257 - DNA, 603 bp, Homo sapiens
  misc_feature: GYAE6OF01EUREV.29.78.H01.1.454.CMB.1.raw
  modified_base (602)..(603): a, c, t, g, unknown or other
  misc_feature (602)..(603): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaagtacgggaccggggcccgacgttcgaccacgtggggccagggggacgctggtcaccgtctcctcacgccctccaaccgaacgggcccacgtccggttccttccccccgtcgggcccacccctccctacccaacgacgccgaccctccgtcgggggccacgacgccacgccccgtgggccgtcggcccgtgggtaccaacggaccttaccttccgacgttacctctacgtcgtgacggcgggcgtcggacgaacggcgacagtgnn

SEQ ID NO: 53258 - DNA, 619 bp, Homo sapiens
  misc_feature: GYAE6OF01EAKBU.29.78.H01.1.454.CMB.1.raw
  modified_base (615)..(615): a, c, t, g, unknown or other
  misc_feature (615)..(615): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacggggacccggggcccgacttgaccacgtggggccgaggggacgcgtcggtccaccgtctcctcacgccctccaccgaacgggcccatccggtccttccccctcggcccaccctcctccaacgacgccaccctcgtcggggccacgacgccacgcccgtgggcctcgcccgttcggtaccgaacgggtaccttaccgttcccgtaacgtaccttaccgttacttccgtaggacgggtccgggtccgtcgggaccgtaacggggccgacgaagtgntacg

SEQ ID NO: 53259 - DNA, 594 bp, Homo sapiens
  misc_feature: GYAE6OF01DMG20.29.78.H01.1.454.CMB.1.raw
  modified_base (382)..(382): a, c, t, g, unknown or other
  misc_feature (382)..(382): n is a, c, g, or t
  modified_base (592)..(592): a, c, t, g, unknown or other
  misc_feature (592)..(592): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtagttaaaggcgagctaggaatacgggaccggggcccgacttgaccacgtggggccaggggacncgtggtcaccgtctcctcacgccctccaccgaacggcccactcggtccttccccctggcccaccctcctaccaacgtacgcaccgtccgtcggggccacgacgcgacgcccgtgggcctcgtcccgtggtccgaacggtacctaaccgttccgtaacgttacctacctatccgtaggacggtccgggcgtcggcgaacggcgacagtagncg

SEQ ID NO: 53260 - DNA, 672 bp, Homo sapiens
  misc_feature: GYAE6OF01C2ZNR.29.78.H01.1.454.CMB.1.raw
  modified_base (180)..(180): a, c, t, g, unknown or other
  misc_feature (180)..(180): n is a, c, g, or t
  modified_base (195)..(195): a, c, t, g, unknown or other
  misc_feature (195)..(195): n is a, c, g, or t
  modified_base (212)..(212): a, c, t, g, unknown or other
  misc_feature (212)..(212): n is a, c, g, or t
  modified_base (235)..(235): a, c, t, g, unknown or other
  misc_feature (235)..(235): n is a, c, g, or t
tcagatagagtactcacgaccggtgctcgatttagtgtgagtagtttgggtttggggtctgagagaggagtccacccctgggatcttcaggtgttttcatttggtgatcaggacggaacagagagaactcaccatggagtttgggctgagcggtgtgttctaggtcggctatttaaaggngtcagtgtgagtgcngtggtgagcgtggggcnccgtgggtacggccggggggtcncgtgagtctctcgtgtcgcgtctagtaggtatttaggttagagtactatcgactagtacggtacgtcgggtaccgacgacggcgtacggaaggggacgggtcgtaggtaggtcggtcgtcggtacgttagttaggtcggtgtggtggtcggtcgtacgtatagttagttagtcgacgtacggtaccgtaccggtacggtacgggtaccggtaccgtaaccgttacgttaccgtaacgtaacgtaacgtaacgttaacgtaacgtaacgtaacgtacgtacgtacgtacgtaacgtaacgtaagtagagacgtacgtagacgacgacgaccgacgacgtacgtacgttattagttagtagtaacgtagtagtacgtaggacggtaccgggaccggaccggtcgtacgacgacggtcggacggacggcggtcgtcgtcg

SEQ ID NO: 53261 - DNA, 576 bp, Homo sapiens
  misc_feature: GYAE6OF01EEXPC.29.78.H01.1.454.CMB.1.raw
  modified_base (571)..(571): a, c, t, g, unknown or other
  misc_feature (571)..(571): n is a, c, g, or t
  modified_base (575)..(576): a, c, t, g, unknown or other
  misc_feature (575)..(576): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtagttaaaggcgagctggaatacggggaccggggccgacttcgaccacgtgggggccaggggacgcgtggtcaccgtctcctcacgccctccaccgaacgggcccagttccggtcctttccccccgtcggcccacccctccctacccgaacgacgccacctccgtcgggggccacacgcacgcccgtgggctcgccgtcggtcaacggtactaccttccacgtactctactctgacgcgggctggacgaggcnatgnn

SEQ ID NO: 53262 - DNA, 614 bp, Homo sapiens
  misc_feature: GYAE6OF01B0TB6.29.78.H01.1.454.CMB.1.raw
  modified_base (326)..(326): a, c, t, g, unknown or other
  misc_feature (326)..(326): n is a, c, g, or t
tcagatagagtactcacgaccggtgctcgatttagtgtgagtagtttgggtttggggtccgagccatggtgcagactccccagagctctcctcctcctccactgcacagggtctctctcccagcctgtgctgactcaatcgccctctgcctctgccctcccgtgggagctcggtcaaggtcacctgtactctgagcagtggacacagcagctacgcatcgcttggcatcagcagagccagacacgggcctgttacttgatgacagtacaacatgatggacagtcacgaggacggaagggggcggtactcccgtgactccgtcttcncgtagtcctcgagtctcgtcgggcctaggacgtccgtacctaccgtacaactacgtcccgtccggaccctcgacggtctaggaggtactggacggtctacgtaacttacgttacgtcgtacgacggtaccgtggggacctacggtcgtacttacgttcgacgggttccgttaccggggaacccggtacgtaacgggtcctaccgggttcggtccggtacacccggtacccgaacggacccctaaaccccgtgttaccgttacctaccgttccgttcccgttacccccg

SEQ ID NO: 53263 - DNA, 615 bp, Homo sapiens
  misc_feature: GYAE6OF01BVF1Y.29.78.H01.1.454.CMB.1.raw
  modified_base (246)..(246): a, c, t, g, unknown or other
  misc_feature (246)..(246): n is a, c, g, or t
  modified_base (314)..(314): a, c, t, g, unknown or other
  misc_feature (314)..(314): n is a, c, g, or t
  modified_base (382)..(382): a, c, t, g, unknown or other
  misc_feature (382)..(382): n is a, c, g, or t
  modified_base (421)..(421): a, c, t, g, unknown or other
  misc_feature (421)..(421): n is a, c, g, or t
  modified_base (451)..(451): a, c, t, g, unknown or other
  misc_feature (451)..(451): n is a, c, g, or t
  modified_base (466)..(466): a, c, t, g, unknown or other
  misc_feature (466)..(466): n is a, c, g, or t
tcagatagagtactcacgaccggtgctcgatttagtgtgagtagtttgggtttggggtctgagagaggagtccacccctgggatcttcaggtgttttcatttggtgatcaggacggaacagagagaactcaccatggagtttgggctgagcgtggtcttttcttgtggctaattttaaaaggtgtccagtgtgacgtgcagttggtggagtcgtgggggcgccgtggggtacgggccggggggtcncgtgagactctcctgtgcggcctcgtggtatttaaggttttaggagttcatgccatgaactgggtccnccgaggcctccgaggggaaggggctggaggtcgggtctcggcttagttaggtggcaggtggtggccgntagtatatatggcagcgcctggaacgggtccgttcactnttccagagacattcgaagaacacgctagtntctgacaaagtgganagctgacgactcggaacgacgcggtcctactattagttgtagtaaacgcgtagaccgttaggaaacggttccggggaaccgggtcccgtaacgttccggaaccgtacgggttacggggaccgacggggggacctccggtggtaccccgg

SEQ ID NO: 53264 - DNA, 559 bp, Homo sapiens
  misc_feature: GYAE6OF01AVKZ8.29.78.H01.1.454.CMB.1.raw
  modified_base (558)..(559): a, c, t, g, unknown or other
  misc_feature (558)..(559): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccggggcccgacttgaccacgtggggccaggggacgctggtcaccgtctcctcagcctccaccaagggcccatcggtccttccccctggccacccctcctccaacgacgccacctcgtcgggggcacagccacgccctcgggcctcgccgtggtcaacggacctacttccagtacctctactctgacggcgggctcgggcaacgggcgacatgnn

SEQ ID NO: 53265 - DNA, 576 bp, Homo sapiens
  misc_feature: GYAE6OF01C1P8M.29.78.H01.1.454.CMB.1.raw
  modified_base (574)..(575): a, c, t, g, unknown or other
  misc_feature (574)..(575): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaaatggagagcctgagactcgacgacacggccgtctattattgtgttaaaggcgagctaggaatacgggacccggggcccgacttgaccactgggggccagggggacgcgtggtcaccggtctccctcacgcctccaccgaacgggcccactccggtccttcccccgtcggcccacccctccctacccaacgacgccaaccctcgtcgggggccacgacgcacgcccgtgggctcgcctggtcaaggctacttccagtacctctatctgacggcgggcgtggcgaacggcgacatgnng

SEQ ID NO: 53266 - DNA, 624 bp, Homo sapiens
  misc_feature: GYAE6OF01CS50S.29.78.H01.1.454.CMB.1.raw
  modified_base (622)..(622): a, c, t, g, unknown or other
  misc_feature (622)..(622): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctggaagggccgttcaccatttccagagacaattcgaagaacacgctgtatctgacaaagtggagagcctagagactcgacgacaccggcgtctattattgtagttaaggcgagcgtaggtaagtaccggggacccggggcccgtacgttcgaccgtacggtggggaccgagggggaccgcgtcgggtccaccggtccttccgtcacgcctacccgaccgaacgggccctacgtcccggtccttcccccgcggccctaccccgtcctacccgaagaccgccgtacccgtcggtcggggccacgacgccgacgcccgtgggcctccgccgtcggactaacggccttactccgtacgtactctacgtcgtggacggtcgggcgtggacgaacggtcagcgtagncg

SEQ ID NO: 53267 - DNA, 622 bp, Homo sapiens
  misc_feature: GYAE6OF01C2DO4.29.78.H01.1.454.CMB.1.raw
  modified_base (619)..(619): a, c, t, g, unknown or other
  misc_feature (619)..(619): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgatctgcaaatggagagcctgagactcgacgacacggccgtctattattgtagttaaaggcgagctaggaagtacgggacccggggccacgttcgaccacgtcggggccgaggggacgcgtggtcaccgtcctcctcacgccctccgaaccgaacgggcccacgtccggtccttcccccgtcggcccaccctcctacccaacgacgccacctcgtcggggccacgacgccacgcccgtgggccgtacgcccgtagggtccgaacggaccttaaccgttcccaacggttacctccgttactccgttggaacggtccgggtaccgtcggaccgtaacggaccggacacgtaggnacg

SEQ ID NO: 53268 - DNA, 640 bp, Homo sapiens
  misc_feature: GYAE6OF01DDLZJ.29.78.H01.1.454.CMB.1.raw
  modified_base (638)..(638): a, c, t, g, unknown or other
  misc_feature (638)..(638): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtagttaaaggcgagcgtaggaatacggggacccgggccgacttgaccacgtggggccaggggacgcgtggtccaccgtctcctcgacgccctccaccgaacggggcccaacgtccggtccttccccccgtcgggccctaacccctccctacccgaaacgacgccaaccgtccggtcgggggcccaacgacgccgacggccccgtagggccgtcgtcccgttcgggtaccgaacggtaccttaaccgttacccgtaacgttacccttcttaacgttccgttaggacggtccgggcgtgggacgtaacgggccgacagtagncg

SEQ ID NO: 53269 - DNA, 601 bp, Homo sapiens
  misc_feature: GYAE6OF01CE5AM.29.78.H01.1.454.CMB.1.raw
  modified_base (593)..(593): a, c, t, g, unknown or other
  misc_feature (593)..(593): n is a, c, g, or t
  modified_base (599)..(599): a, c, t, g, unknown or other
  misc_feature (599)..(599): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccgggcccgacttgaccacgtggggccaggggacgcgtggtcaccgtctccctcgacgccctcccaccgaacgggcccacgtccggtccttccccccgtggcccaccctccctaccaacgacgccaccgtcgtcggggccacgacgccacgcccgtagggcctcgcccgttggaccgaacggtaccttaaccgttcctaacgttacctactacgttcgtagacggcgggcgtaggacgaacgggcganacgtgncg

SEQ ID NO: 53270 - DNA, 552 bp, Homo sapiens
  misc_feature: GYAE6OF01BGCBC.29.78.H01.1.454.CMB.1.raw
  modified_base (547)..(547): a, c, t, g, unknown or other
  misc_feature (547)..(547): n is a, c, g, or t
  modified_base (551)..(552): a, c, t, g, unknown or other
  misc_feature (551)..(552): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccggggccgacttgaccacgtggggccaggggacgcgtggtcaccgtctcctcacgcctccaccaagggcccatcggtccttccccctcggccaccctcctccaagacgcacctcgtcggggcacagcagccctcgggctcgccgtggtcaacggactacctcacgtactctacgtcgtgacgcgggctggcgtaacggcgantagnn

SEQ ID NO: 53271 - DNA, 639 bp, Homo sapiens
  misc_feature: GYAE6OF01C4JJM.29.78.H01.1.454.CMB.1.raw
  modified_base (637)..(637): a, c, t, g, unknown or other
  misc_feature (637)..(637): n is a, c, g, or t
  modified_base (639)..(639): a, c, t, g, unknown or other
  misc_feature (639)..(639): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccggggcccgacttgaccacgtggggccaggggacgctggtcaccgtctcctcacgcctccaccgaacgggcccacgtccggtccttcccccctcgggcccacccctccctacccaacgacgccaccccgttcgtcgggggccacgacgccgacgccccgtggggccttcggcccgttcgggtaccaaacgggtaccttaacccgtttcccgaacgttaccttaccttaacgttaccgttggtaacggccggggccgttcgggaccgaaacgggacccggacaacgttacggngn

SEQ ID NO: 53272 - DNA, 584 bp, Homo sapiens
  misc_feature: GYAE6OF01B1MS9.29.78.H01.1.454.CMB.1.raw
  modified_base (474)..(474): a, c, t, g, unknown or other
  misc_feature (474)..(474): n is a, c, g, or t
  modified_base (583)..(583): a, c, t, g, unknown or other
  misc_feature (583)..(583): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaagtacgggaccggggcccgacgttgaccacgtggggccagggggaccgcgtgggtccaccggtctccctcacgccctccaccaacggggccccagtccggtcctttccccccgtcggcccacccctccctccaacgcnccacctcgtcggggcacgcgcacgcccgtgggctcgcctggtcaacggtactacgtccgtagtacctctactcgtgacggccgggctgggaccaacgggcgacacgtgnc

SEQ ID NO: 53273 - DNA, 561 bp, Homo sapiens
  misc_feature: GYAE6OF01CU773.29.78.H01.1.454.CMB.1.raw
  modified_base (285)..(285): a, c, t, g, unknown or other
  misc_feature (285)..(285): n is a, c, g, or t
  modified_base (333)..(333): a, c, t, g, unknown or other
  misc_feature (333)..(333): n is a, c, g, or t
  modified_base (387)..(387): a, c, t, g, unknown or other
  misc_feature (387)..(387): n is a, c, g, or t
  modified_base (445)..(445): a, c, t, g, unknown or other
  misc_feature (445)..(445): n is a, c, g, or t
  modified_base (467)..(467): a, c, t, g, unknown or other
  misc_feature (467)..(467): n is a, c, g, or t
  modified_base (530)..(530): a, c, t, g, unknown or other
  misc_feature (530)..(530): n is a, c, g, or t
  modified_base (561)..(561): a, c, t, g, unknown or other
  misc_feature (561)..(561): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtggggtctcggctattagtggcagtggtggcgctatatattatgcagacgccctgaagggccggttcaccatttccagagacaattcgaagaacacgctgtatctgcaaatgganagcctgagactcgacgacacggccgtctattattgtgttaaaggcganctggaagtacggggaccggggcccgacttcgaccacgtcggggccagggggacncgtggtcaccgtctccctcacgcctaccaccgaacgggcccagtccgtccttcccccnggccgccctgcctccgaggacnccaccctcgacgacgcacagccgccctgggcctgcctgtacaggtctacctcagtctctactntggacgcggcctggtccaaggtcactgtcgn

SEQ ID NO: 53274 - DNA, 619 bp, Homo sapiens
  misc_feature: GYAE6OF01CBMW1.29.78.H01.1.454.CMB.1.raw
  modified_base (248)..(248): a, c, t, g, unknown or other
  misc_feature (248)..(248): n is a, c, g, or t
  modified_base (313)..(313): a, c, t, g, unknown or other
  misc_feature (313)..(313): n is a, c, g, or t
  modified_base (350)..(350): a, c, t, g, unknown or other
  misc_feature (350)..(350): n is a, c, g, or t
  modified_base (358)..(358): a, c, t, g, unknown or other
  misc_feature (358)..(358): n is a, c, g, or t
  modified_base (360)..(360): a, c, t, g, unknown or other
  misc_feature (360)..(360): n is a, c, g, or t
  modified_base (365)..(365): a, c, t, g, unknown or other
  misc_feature (365)..(365): n is a, c, g, or t
  modified_base (369)..(369): a, c, t, g, unknown or other
  misc_feature (369)..(369): n is a, c, g, or t
  modified_base (377)..(377): a, c, t, g, unknown or other
  misc_feature (377)..(377): n is a, c, g, or t
  modified_base (415)..(415): a, c, t, g, unknown or other
  misc_feature (415)..(415): n is a, c, g, or t
tcagatagagtactcacgaccggtgctcgatttagtgtgagtagtttgggtttggggggaagaggaagactgacggtccacccctgggatcttcaggtgttttcatttggtgatcaggacggaacagagagaactcaccatggagtttgggctgagcgtgtgtttctaggtggctaattttaaaaggtgtcagtgtgagtgcagttggtggagtcgtgggggcgcgtggggtacggccgggggggtcncgtgagctctcctgtgcggcctcgtggatttaaggttttaggagtcatgccatgaactgggtccnccaggctccgagggaagggctggagtgggtctcggtntagtgtgngngtggngctntatatatngcagacgccgtaggacgggccgtcactacttacgaganactaatacgaagaacacgtctagtactacgtagacaagtggagacgtcgtagacgtaacgtcgaacgacgaccggtccgttattaactttgttaggtaggttaaacggcgtaggtacggtacgggaacggtaccgggggacccgggtacccgtacgtacggaacccgcgggtacggggaccggaaggggccgtcgtcgggtccg

SEQ ID NO: 53275 - DNA, 558 bp, Homo sapiens
  misc_feature: GYAE6OF01ARMV0.29.78.H01.1.454.CMB.1.raw
  modified_base (556)..(558): a, c, t, g, unknown or other
  misc_feature (556)..(558): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattatgtgttaaaggcgagccggaatacgggaccgggcccgacttgaccacgtggggccaggggacgctggtcaccgtctcctcagcctccaccaacgggcccatccggtccttccccctcggcctacccctcctcccaacgacgccaccctcgtcgggggcaccgacgcacgcccgtgggcctcggccctggtccaaggactacttcagtactctatctgagcgggctggcacggcgcatacgnnn

SEQ ID NO: 53276 - DNA, 564 bp, Homo sapiens
  misc_feature: GYAE6OF01AP719.29.78.H01.1.454.CMB.1.raw
  modified_base (321)..(321): a, c, t, g, unknown or other
  misc_feature (321)..(321): n is a, c, g, or t
tcagatagagtactcacgaccggtgctcgatttagtgtgagtagtttgggtttggggtccgagccatggtgcagactccccagagctctcctcctcctccactgcacagggtctctctcccagcctgtgctgactcaatcgccctctgcctctgcctccctgggaggctcggtcaaggtcacctgtactctgagcagtggacacagcagctacgccatcgcttggcatcagcagaggccagacacgggccctcgttacttgatgacagtcaacaatgatggcagtcacagcgaaggggggacggatcccgtgatcgcttcncagtcctcagtctcgtgggcctgacgtcgcctacctcaacactccgtcccggcctaccgagtcctaggaggtatggaggtctagtacttattactgtcaggacccgtggggccacggttggccttagttcgacgggttccgttaccggggacccgggtacaacgggttccaaccgggtcggtacggtccgaggccccgaagggcccccaacccgtcgtcgtccacccttcgtcccgtaccccc

SEQ ID NO: 53277 - DNA, 634 bp, Homo sapiens
  misc_feature: GYAE6OF01CRN46.29.78.H01.1.454.CMB.1.raw
  modified_base (308)..(308): a, c, t, g, unknown or other
  misc_feature (308)..(308): n is a, c, g, or t
  modified_base (343)..(343): a, c, t, g, unknown or other
  misc_feature (343)..(343): n is a, c, g, or t
  modified_base (630)..(630): a, c, t, g, unknown or other
  misc_feature (630)..(630): n is a, c, g, or t
tcagatagagtactcacgaccggtgctcgatttagtgtgagtagtttgggtttggtggtctctctcccagcctgtgctgactcaatcgccctctgcctctgcctcccgtgggaggctcggtcaaggtcacctgtactctgagcagtggacacagcagctacgccatcgcttggcatcagcagacggccagacacgtcgcccttgttacttgatgacagtacaacaatgatggcagtcacgagacgaagggggcggatcccgtagatccgcttcgcagtctccagtctcgtggcctgacgcacttaccncaacacgtccgccggtcctccgagtctaggaaggntaggacgtcagtacttatacgtgtacgacgtaccggtgggacacggtggacctagttcggtacgggttccgttaacccgggggaacccggggtaacctaacgggtcccgtaaccgggttccgggtaccgtacccgaaccggacccccggaaaacggcccccttaaaaccccgtgtcccggttaccaaccgtttcccgttacccgttacccccacgttccctagtaccgttacctcgtacgtcccgtagggaccggtcggtccgtacggacgaacgggcaccgtaggntgcg

SEQ ID NO: 53278 - DNA, 563 bp, Homo sapiens
  misc_feature: GYAE6OF01EMR9S.29.78.H01.1.454.CMB.1.raw
tcagatagagtactcacgaccggtgctcgatttagtgtgagtagtttgggtttggagtctgcaccatggctcggaccccactcctcttcctcaccctcctcctccactgcacagggtctctctcccagcctgtgctgactcaatcgccctctgcctctgcctccctggggaggctcggtcaaggtcacctgtactctgagcagtggacacagcagctacgccatcgcttggcatcagcagaggccagacacgggccctcgttacttgatgacagtcaacaatgatggcagtcacaggacgaagggggacggatcccgtgactcgcttctcagtctccagctcgtgggcctgacgccgctacctcactaactcctcccggcctcagtctggagatgagctgacttattactgtacagtaccgtggggaccacgtggactagttcgacgggttccgttaccggggaaccgggtaaccgtacgggtcctaccggttcggtaccggtaccaccggacccgaaacggaccccaacccctagttccgtaccctcgttcccgttaccccg

SEQ ID NO: 53279 - DNA, 688 bp, Homo sapiens
  misc_feature: GYAE6OF01B29CF.29.78.H01.1.454.CMB.1.raw
  modified_base (253)..(253): a, c, t, g, unknown or other
  misc_feature (253)..(253): n is a, c, g, or t
  modified_base (385)..(385): a, c, t, g, unknown or other
  misc_feature (385)..(385): n is a, c, g, or t
tcagatagagtactcacgaccggtgctcgatttagtgtgagtagtttgggtttgggggaagaggaagactgacggtccacccctgggatcttcaggtgttttcatttggtgatcaggacggaacagagagaactcaccatggagtttgggctgagcgtggtcgttttcttaggtggctaattttaaaaggtgtccagtgtgacgtgcagttggtggagtcgtgggggcgccgtggggtacggccggggggtcncgtgagactcttctgtggcggtcctgtaggtatttaaggttttaggagttcatgccaatgaactgggtccgccaggctccgaggggaagggctggagtggtctcggcttagttagtggcaggtggtggcgtntagtatattatgacagacgccctggaaacggggtccgttacaaccgtatttccaaggacgtaacaagttcgaaagtaacacgtctagtatctaggacaaagttggacgacgcctaggacgtaaccgtcggaaccgacaccgggtcccttactaaagttttagttaggttaagttaaaacgggccgttaaggacccgttaaggggaaaccggttacccgggggacccgggggtacccctacggtttaccggaacccgacgggtacgggggacccgtaacgggggacctcggttcggtaaccccg

SEQ ID NO: 53280 - DNA, 634 bp, Homo sapiens
  misc_feature: GYAE6OF01CTC4K.29.78.H01.1.454.CMB.1.raw
  modified_base (633)..(633): a, c, t, g, unknown or other
  misc_feature (633)..(633): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgccaggctccgagggaaggggctggagtgggtctcggctattagtggcagtggtggcgctatatattatgcagacgccctgaagggccggttcaccatttccagagacaattcgaagaacacgctgatctgacaaatggagagcctgagactcgacgacacggccgtctattatgtgttaaaggcgagctaggaatacggggaccggggcccgacgttgaccagtggggccaggggacgcgtggtcaccggtctcctcacgccctccaccgagggcccctagtccggtccttcccccgtcggccaccccgtcctaccgaacgacgccaccgtcgtcggggccacgacgccgacggcccgtcggggccgtcgcccgttcgggtaccgaaacgggtaccctaccgtttacccgtaacgttaccttaccttacgttcctggaacgggtccggggccgttacgggacgtaaaccggggcgaccgtaagtagcgng

SEQ ID NO: 53281 - DNA, 593 bp, Homo sapiens
  misc_feature: GYAE6OF01A6CXE.29.78.H01.1.454.CMB.1.raw
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattatgtgttaaaggcgagctggaatacggggaccgggccgacttcgaccacgtggggccaggggacgctggtcaccgtctcctcacgcctccaccgaaggcccatccggtcttccccctgccaccctcctccaacgacgcacctcgtcggggcacgacgccgacgacccgtcgggcctcgcccgttacgggtccaacgggaccttaccgttacccgacgttaccttacgtacgtcgtaggacggccggggctacgggcgaaacggcggaccaagagtgacg

SEQ ID NO: 53282 - DNA, 544 bp, Homo sapiens
  misc_feature: GYAE6OF01C65TO.29.78.H01.1.454.CMB.1.raw
  modified_base (543)..(544): a, c, t, g, unknown or other
  misc_feature (543)..(544): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctaattattgtgttaaaggcgagctggaatacgggaccggggccgacttgaccacgtggggccaggggacgctggtcaccgtctcctcagcctccaccagggcccatcgtcttcccctcggcaccctcctccacgacgcacctcgtggggcacgagcacgccctgggctgcctggtcaaggactacttccagtacctctactctgacggcgggcgtggcgaacggcgacatgnn

SEQ ID NO: 53283 - DNA, 614 bp, Homo sapiens
  misc_feature: GYAE6OF01D060N.29.78.H01.1.454.CMB.1.raw
  modified_base (275)..(275): a, c, t, g, unknown or other
  misc_feature (275)..(275): n is a, c, g, or t
tcagatagagtactcacgaccggtgctcgatttagtgtgagtagtttgggtttgggtggtctctcctcccagccgtgtgctgactcgaatcgccctcgtcgcctctgcctcccgtggggagcctcggtcaaggtcacctgtactctgagcaagtggacacagcagctacgccatcgcttgcatcagcagagccagacacgggcctgttacttgatgacagtcaaacaatagatggcagtcacagcgaaggggacggatccgtagagtacgcttcncagtctcagtctacgtcgggtcctagtacgccgtacgttaccgtacaactaacgttccgtcccggcctccgaagttcgtaggaggtactgggaacgtctagtacttattctgtacgacgtacgtgggacacgtggctagtcgaggtcgttcggaccgggtacaggtctacgtcgtcgtacacgacccaacggaccctaacccgtcgtcgtaccgtaccgttccgttacggttacccccgaccgttctaacgtaaccgttaaccgttcttaacgttccggtacggtacggtccgggtcgtacgggtacgtaaacgggtccgtaactagttacgctcgacg

SEQ ID NO: 53284 - DNA, 592 bp, Homo sapiens
  misc_feature: GYAE6OF01AES7S.29.78.H01.1.454.CMB.1.raw
  modified_base (590)..(590): a, c, t, g, unknown or other
  misc_feature (590)..(590): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccggggcccgacttgaccacgtggggccaggggacgctggtcaccgtctcctcagccctccaccgaacgggcccacgtccggtccttcccccgtcggcccaccctcctccaacgacgccacctcgtggggccacgagccgacgcccgtcgggctcgtccgtcggtacgaacggtaccttaccgttccgacgttacctcttacgtctaggacggccgggtcgcgggacgacgggccgacgagtagncg

SEQ ID NO: 53285 - DNA, 570 bp, Homo sapiens
  misc_feature: GYAE6OF01EAE2I.29.78.H01.1.454.CMB.1.raw
  modified_base (545)..(545): a, c, t, g, unknown or other
  misc_feature (545)..(545): n is a, c, g, or t
  modified_base (565)..(565): a, c, t, g, unknown or other
  misc_feature (565)..(565): n is a, c, g, or t
  modified_base (567)..(567): a, c, t, g, unknown or other
  misc_feature (567)..(567): n is a, c, g, or t
  modified_base (569)..(570): a, c, t, g, unknown or other
  misc_feature (569)..(570): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaagggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccggggccgacttgaccacgtggggccaggggacgctggtcaccgtctcctcacgccctccaaccgaacgggcccacgtccggtccttcccccgtcggcccaccctccctccaacgacgccacctccgtcggggcacgacgccacgcccgtcggctcgccgtcggtcgaacggtactacttcctacgtactctactctagnggcgggcgtggcgaggcganangnn

SEQ ID NO: 53286 - DNA, 749 bp, Homo sapiens
  misc_feature: GYAE6OF01AZMB3.29.78.H01.1.454.CMB.1.raw
  modified_base (184)..(184): a, c, t, g, unknown or other
  misc_feature (184)..(184): n is a, c, g, or t
  modified_base (240)..(240): a, c, t, g, unknown or other
  misc_feature (240)..(240): n is a, c, g, or t
  modified_base (274)..(274): a, c, t, g, unknown or other
  misc_feature (274)..(274): n is a, c, g, or t
  modified_base (277)..(277): a, c, t, g, unknown or other
  misc_feature (277)..(277): n is a, c, g, or t
tcagatagagtactcacgaccggtgctcgatttagtgtgagtagtttgggtttggggtctgagagaggagtccacccctgggatcttcaggtgttttcatttggtgatcaggacggaacagagagaactcaccatggagtttgggctgagcggtcgtgtttctaggtcggctaattttaaaggngtcagtgtgacgtgcagttgtggagtctggggcgccgtgggacggccggggggtcngtgagctctctgtgcgctgtagtattaagttagngtnatcgcatagacgtcggtccgcgaggcctacggaggggacggtcgtagggtggtcgggtccgtcggtacttagttggtggcgtaggtggtcggcgtacgttaattattaagttagtcggaccgtacggtacccgtacccgtagggtaacccggggttcccgttacctaaccgtttacgtttacccgaaggtaacgtaacgttaacgtttaacgaaacgaaccgtacgtaccgttacgttactacgtacgtaacgtaagttacggaacgtacgtaccgtacgtaacgtaccgtaccgggaaccgaaccggtaccggtacccgttacgtttagtttaggttacggttaaggtaacggtacggtacgtacggtaagggtaaacccgggtacccggggtacccgggtacccgttaccgttaaccggacccggtaccgggtccggggaccggtaacgggacccgtcggtcggtccccg

SEQ ID NO: 53287 - DNA, 579 bp, Homo sapiens
  misc_feature: GYAE6OF01CWV81.29.78.H01.1.454.CMB.1.raw
  modified_base (395)..(395): a, c, t, g, unknown or other
  misc_feature (395)..(395): n is a, c, g, or t
  modified_base (579)..(579): a, c, t, g, unknown or other
  misc_feature (579)..(579): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccggggcccgacttgaccacgtggggccagggggacgctggtcaccgtcncctcacgcctccaccaagggcccatccggtccttccccctggcccaccctcctacccaacgacgccaccctcgtggggccacgacgccacgccccgtgggcctcggccctgggtccaaacgggtccttaaccgttccctagtacctctacgtccgtggacgcggggctggcaaggcgacatagn

SEQ ID NO: 53288 - DNA, 562 bp, Homo sapiens
  misc_feature: GYAE6OF01B1MMD.29.78.H01.1.454.CMB.1.raw
  modified_base (558)..(558): a, c, t, g, unknown or other
  misc_feature (558)..(558): n is a, c, g, or t
  modified_base (561)..(562): a, c, t, g, unknown or other
  misc_feature (561)..(562): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccgggcccgacttgaccactggggccagggggacgcgtggtcaccgtctcctcagccctccaccgaacgggcccagtccggtccttccccctcggccacccctcctccaacgacgccacctcgtcggggccacgagccgagccctgggcctcgcctcggtacaacgggacctacttccagtacctctactctgacgcgggctggcgaggcgantgnn

SEQ ID NO: 53289 - DNA, 572 bp, Homo sapiens
  misc_feature: GYAE6OF01DDLFO.29.78.H01.1.454.CMB.1.raw
tcagatagagtactcacgaccggtgctcgatttagtgtgagtagtttgggtttggggtccgagccatggtgcagactccccagagctctcctcctcctccactgcacagggtctctctcccagcctgtgctgactcaatcgccctctgcctctgcctccctgggaggctcggtcaaggtcacctgtactctgagcagtggacacagcagctacgccatcgcttggcatcagcagaggccagacacgggccctcgttacttgatgacagtcaacaatgatggcagtcacaggacgaagggggacggatcccgtgatcgcttctcgagtcctccagctcgtgggcctgacgcgctacctcacatcctccggcctcgagtctgaggatgaggtctagacttatacgtgtcagccgtggggccacgtcggctagtttcgacgggttccgttaccggggaaccggggtaacctaagggtcccgtacccggttccggtccggtaccgaaccggaccccgaaacgggcccccaaacccccgtacgttacgtacctaaccttcccgttccgttacccccc

SEQ ID NO: 53290 - DNA, 1051 bp, Homo sapiens
  misc_feature: GYAE6OF01C9KN9.29.78.H01.1.454.CMB.1.raw
tcagatagagtactcacgaccggtgctcgatttagtgtgagtagtttggggtttggggggcgccgtgggtaccggccgggggggtcgctggagactcgtccttgtgcgggcctctggattaagtttaggagtcatgccatgaactgggtccgcgtaggctccgagggagggctggtacgtgggtctcggacttaagttagtcggctaggtgggtggcgtcgttatagttagttagtggacgacggaccggtcccgttagggaacggggtcccggttacgaacccggtacttttaccgaaggacgtaacctaacttacggaaaggaaccaacggtcgttacggttaacgttccgtttaggacctaaaaggttaggggtaacgaacggtacccgttaggaacggtaaccggttaccggaacccgggtaaccggtaacccggggtaccccggttacctttaacgttttaacggtttacggggttaacgggtttaaaacggggtacgggaaacgggtaccggttagggggtaaaaccggttaaccccgggggggtaaccccgggggttaaccccgggttaacccggttttaccgggaaccccggtaaaccggggttaccggggggaaccccggttaacgggggggtaaaccccgtccgggtttaaccggggttaccccgtaaccccgggtttcccgtaccccgggttttacccgaaacccgggttaccccgttaacccccggaacccgggtaaacccgggggtacccccgtaacccgggtttacccgggtttacccccggtttacccccccggtaccggggtacccctaacccccgttacccgttaaccgtaaaccggtacgtacccgtaccgtcccgggtacggggaccctaacgaacgtaccgaaccggcccggtaccgggtaccgtaccggtacccgtaccgggttaaccgtaacggtaccttaaccgttccggtaacgtacctacgttacgtcggtaggtacgggaccgggtccgacggaccggtaccggacgtacgtacggtggcgtacg

SEQ ID NO: 53291 - DNA, 635 bp, Homo sapiens
  misc_feature: GYAE6OF01ELITI.29.78.H01.1.454.CMB.1.raw
  modified_base (217)..(217): a, c, t, g, unknown or other
  misc_feature (217)..(217): n is a, c, g, or t
  modified_base (240)..(240): a, c, t, g, unknown or other
  misc_feature (240)..(240): n is a, c, g, or t
tcagatagagtactcacgaccggtgctcgatttagtgtgagtagtttgggtttggggtctgagagaggagtccacccctgggatcttcaggtgttttcatttggtgatcaggacggaacagagagaactcaccatggagtttgggctgagctggcttttcttgtggctattttaaaaggtgtccagtgtgacgtgcagttggtggagtctgggggcncctgggtacggccgggggggtcnctgagactctcctgtgcggcctctggattaagtttggagtcatgccatgaacgtgggtccgccaggcctccgaggggaaggggctgggaggtgggtctcggctattaggtgcaggtggtggcgctatatattatgcagacgcccgtggaacggggtcccggttacaccgtatttcccgagaacgtaactaagttacgaagaactacgcgtagtactcgtagacaaagtggagacgacctgacgacgtcgaaccgtacgaccggtccgtattattagttaggtagttaaagggcgtagcgtagggaaacggtcccggggacccggggtaccccgtacgttaccggacccgtacgggtcgggggaccggaacgggggccgtcggtccgggtaccccg

SEQ ID NO: 53292 - DNA, 584 bp, Homo sapiens
  misc_feature: GYAE6OF01DP4H5.29.78.H01.1.454.CMB.1.raw
  modified_base (582)..(582): a, c, t, g, unknown or other
  misc_feature (582)..(582): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgacaaatggagagcctgagactcgacgacacggccgtctattattgtgttaaaggcgagctggaatacgggaccgggcccgacttgaccacgtcggggccaggggacgcgtggcaccgtctcctcagccctccaccgaacgggcccactccggtccttcccccgtcggcccaccctccctccaacgcgccaccctccgtcggggccacgagccgacgccctcgggcctcggcccgtggtaccaacggacctacttcccagttacctcctactccgtagacggccgggccgtggcgaacggcgacatgncg

SEQ ID NO: 53293 - DNA, 601 bp, Homo sapiens
  misc_feature: GYAE6OF01DFA0T.29.78.H01.1.454.CMB.1.raw
  modified_base (599)..(599): a, c, t, g, unknown or other
  misc_feature (599)..(599): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgccaggctccagggaaggggctgaagtgggtctcggctattagtggcagtggtggcgctatatattatgcagacgccctgaagggccggttcaccatttccagagacaattcgaagaacacgctgtatctgcaatggagagcctgagactcgacgacacggccgtctattattgtagttaaaggcgagctggaatacggggacccgggcccgacttgaccacgtggggccagggggacgcgtggtccaccgtctccctcgacgccctccaccgaacgggcccacgtccggtccttcccccgtcggcccaccctccctaccaacgacgccacctccgtggggccacgacgcacgcccgtgggcctcgccgtcggtacaacggtaccttaccgttacctacgtaccttctacgttcgtaggacggccgggcgtcggacgtaacgggccgacgagtagncg

SEQ ID NO: 53294 - DNA, 696 bp, Homo sapiens
  misc_feature: GYAE6OF01CL65R.29.78.H01.1.454.CMB.1.raw
tcagatagagtactcacgaccggtgctcgatttagtgtgagtagtttgggtttggggtccgagccatggtgcagactccccagagctctcctcctcctccactgcacagggtctctctcccagcctgtgctgactcaatcgccctctgccctctcgccctcccgtggggaggctcggtcaaggtcacctgtactctgagcagtggacacagcagctacgccatcgcttggcatcagcaggaggccagacaccgggtccctagttacttgatgacagtacaaagatgatggcagtcacaggacggaagggggccggactcccgtagactccgtacttccgtacgtacgtcctaccgagtccgttcggtcgggacctggaccgtccgtacccttacccgtaccaacctaacgttcccgtacccgggtacccttaccggtaacggttccgtaaggtacgggtaagtcgggtaacgggtccttaacggtaacctttacgtaccgttggtaacccgaaggtacccggtggggtaccctaacggttcggaccttacggtttaccggacgggttaccgggttacccggggaaccggggtacctaacggggtccctaccgggttcggtaccggtacgaacccgtcccggaaacggccccctaaacccggtcttcggtaccctacccgtcgttcccggtaccccc

SEQ ID NO: 53295 - DNA, 573 bp, Homo sapiens
  misc_feature: GYAE6OF01A7YMQ.29.78.H01.1.454.CMB.1.raw
  modified_base (573)..(573): a, c, t, g, unknown or other
  misc_feature (573)..(573): n is a, c, g, or t
tcagatagagtactcacgaccggtgctcgatttagtgtgagtagtttgggtttgggtgcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaagtacggggaccggggcccgacgttgaccacgtggggccaggggacgcgtggtcaccgtctcctcacgcctccaccgaacggcccacgtccggtccttcccccgtcggccaccctcctcccaacgacgccacctcgtcggggcacgacgcacgcccgtcgggctcggcctggtacgaacggtactaccgttccacgtacctctactctggcgcgggctcggcgaacggcgcagtgn

SEQ ID NO: 53296 - DNA, 550 bp, Homo sapiens
  misc_feature: GYAE6OF01BGN2U.29.78.H01.1.454.CMB.1.raw
  modified_base (546)..(546): a, c, t, g, unknown or other
  misc_feature (546)..(546): n is a, c, g, or t
  modified_base (550)..(550): a, c, t, g, unknown or other
  misc_feature (550)..(550): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccggggcccgacttgaccactggggccaggggacgctggtcaccgtctcctcagcctccaccaagggcccatccggtcttccccctggcccaccctccctccaacgacgccaccctcgtcgggggccacgacgcacgccctgggcctgcctggtcaaggactacttccacgtactctatctgagcgggctggcaaggcganatgn

SEQ ID NO: 53297 - DNA, 535 bp, Homo sapiens
  misc_feature: GYAE6OF01B2SLC.29.78.H01.1.454.CMB.1.raw
  modified_base (515)..(515): a, c, t, g, unknown or other
  misc_feature (515)..(515): n is a, c, g, or t
  modified_base (531)..(531): a, c, t, g, unknown or other
  misc_feature (531)..(531): n is a, c, g, or t
  modified_base (534)..(535): a, c, t, g, unknown or other
  misc_feature (534)..(535): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccggggccgacttgaccactggggccagggggacgctggtcaccgtctcctcagcctccaccaagggcccatccggtcttccccctgccaccctcctccaacgacgcacctctcggggcacgagcacgccctgggctgcctggtcaaggactacttccagtctctatctgngcggctggcaggcacntgnn

SEQ ID NO: 53298 - DNA, 538 bp, Homo sapiens
  misc_feature: GYAE6OF01E1SW4.29.78.H01.1.454.CMB.1.raw
  modified_base (321)..(321): a, c, t, g, unknown or other
  misc_feature (321)..(321): n is a, c, g, or t
tcagatagagtactcacgaccggtgctcgatttagtgtgagtagtttgggtttggagtctgcaccatggctcggaccccactcctcttcctcaccctcctcctccactgcacagggtctctctcccagcctgtgctgactcaatcgccctctgcctctgcctccctgggaggctcggtcaaggtcacctgtactctgagcagtggacacagcagctacgccatcgcttggcatcagcagaggccagacacgggccctgttactgatgacagtcaacatgatggcagtcacagcgaagggggacggatccctgatcgcttcncagtctccagctcgtgggcctggacgcgctacctcacatcctccggctcagtctaggacggtatggagtctagaacttattacgtgtacaggtaccgtggggaccacgtggactagttcgacggttcgtcgggaccgggactaacggtccaccggtcgtaccgggtcacggccccgaaaggccccaaaccccgtgtcgtccaccgtccgttacccgg

SEQ ID NO: 53299 - DNA, 619 bp, Homo sapiens
  misc_feature: GYAE6OF01BNQE1.29.78.H01.1.454.CMB.1.raw
  modified_base (231)..(231): a, c, t, g, unknown or other
  misc_feature (231)..(231): n is a, c, g, or t
tcagatagagtactcacgaccggtgctcgatttagtgtgagtagtttggggtttggggagagctctggggagtctgcaccatggctcggaccccactcctcttcctcaccctcctcctccactgcacagggtctcctctcccagcctgtgctgactcaatcgccctctcgcctctgccctcccgtggggacggctcggtcaaggtccacctgtactctgagcagtgacacngcagctacgcatcgctgcatcagcagacggccagaccgaccgggtcccttgttacttgatgacagtacaactatgatcggacagtcacgagacggaacgggggacgactccgagacgtcgtcttcactacgtcctaccgagtccttacggtccgggccttagggaccgtccgtacccttaccctacgaaccgtaacgtccccgtaccccggtctacccgtaggttcctagggaacggtacgtcggacggttctacgtacttaactcgtacgtacgtacgtccggttagggacctacgtcggacctagttccggtacggttccggtaccgggaaccggtacgacggtccgtaccggtcgcgtaccgacgaccgaccgccctacccgtcg

SEQ ID NO: 53300 - DNA, 574 bp, Homo sapiens
  misc_feature: GYAE6OF01C5R5Y.29.78.H01.1.454.CMB.1.raw
  modified_base (573)..(573): a, c, t, g, unknown or other
  misc_feature (573)..(573): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaaagaacacgctgtatcggtgcaaaatggagagcctgagactcgacgacacggccgtctattattgtagttaaaggcgagctaggaatacggggaccggggcccgacttgaccacgtggggccaggggacgctggtcaccgtctcctcacgcctccaccacgggcccactccgtccttcccccgtcggcccaccctccctaccaacgacgccaccctcgtcggggccacgacgcacgcccgtgggctcgtcctcggtcaacggactacttccagtacctctatcgtgacggcgggcgtggacaacggcgcactagnc

SEQ ID NO: 53301 - DNA, 669 bp, Homo sapiens
  misc_feature: GYAE6OF01EMN6I.29.78.H01.1.454.CMB.1.raw
  modified_base (210)..(210): a, c, t, g, unknown or other
  misc_feature (210)..(210): n is a, c, g, or t
  modified_base (279)..(279): a, c, t, g, unknown or other
  misc_feature (279)..(279): n is a, c, g, or t
tcagatagagtactcacgaccggtgctcgatttagtgtgagtagtttgggtttggggtccgagccatggtgcagactccccagagctctcctcctcctccactgcacagggtctctctcccagcctgtgctgactcaatccgccctctgcctctcgccctccgtggggaggctcggtcaaggtcacctgtactctgagcaggtggacacngcagctacgccatcgcttggcatcagcagacggcagaccgacgggccctgttactgatgacagtacaanatgagtggacagtcacgaggacggaagggggacgactcccgtgactcgtccttctacgacgtcctcgcgcgtcggtcgggctggacgcgtacctacctcaactactccgtcccggtcctcgacgtcgtggaacggtagtggacggtctacgtaacttacttacgtcggtaccgacggaccgggtcggggacctacggtcggaccgttacgtttaccgggtacgggttacccggttacccgggggaacccggggtaaccgtaacgggttcccggaccgggtttccgggtcccgggtaacccgaacccggtaaccccggaaacccgggtcccccaaaccccggttcgttacccggttaccctaacccgtttcccgttccccgttccccccgg

SEQ ID NO: 53302 - DNA, 632 bp, Homo sapiens
  misc_feature: GYAE6OF01DPI0R.29.78.H01.1.454.CMB.1.raw
  modified_base (631)..(632): a, c, t, g, unknown or other
  misc_feature (631)..(632): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccagactccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctaggaatacggggacccgggcccgacttgacccacgtcgggggccgaagggggaccgcgtgggtcccacccggttctccctcgacgccctcccgaacccgaagggccccacgttcccggttccgtttccccccgtcggcccacccctccctaccaacgacgccacccgtcgtcgggggccacgacgccgacgcccgtcgggcgtcgcccgtgggtaccaacgggtacctaccgttacccgacgttaccttccttacgtcgtggacgggtcgggcgtcggaccgtaacggcgacactgnn

SEQ ID NO: 53303 - DNA, 566 bp, Homo sapiens
  misc_feature: GYAE6OF01D6VTB.29.78.H01.1.454.CMB.1.raw
  modified_base (411)..(411): a, c, t, g, unknown or other
  misc_feature (411)..(411): n is a, c, g, or t
  modified_base (417)..(417): a, c, t, g, unknown or other
  misc_feature (417)..(417): n is a, c, g, or t
tcagatagagtactcacgaccggtgctcgatttagtgtgagtagtttgggggtttggggagagctctggggagtctgcaccatggctcggaccccactcctcttcctcaccctcctcctccactgcacagggtctctctcccagcctgtgctgactcaatcgccctctgcctctgcctccctgggaggctcggtcaaggtcacctgtactctgagcagtggacacagcagctacgccatcgcttggcatcagcagagccagacacggccctgttactgatgacagtacaacaatgatggcagtcaacgaggacgaaagggggacggactcccgtgactcgcttctcgagtcctccagtccttcgtcgggcctggacgcgcctacctcactaactcctccggcctccagtcnggaggntggagctagacttattactgtacgacgtaccgtggggctacgtggactacgttcgacgggttccgttaccggggaacccggggtaccaacgggtccgtacccggtcgtaccgggtacaccggaccccgaacggtccccaaccccgtacg

SEQ ID NO: 53304 - DNA, 610 bp, Homo sapiens
  misc_feature: GYAE6OF01BMDVO.29.78.H01.1.454.CMB.1.raw
  modified_base (606)..(607): a, c, t, g, unknown or other
  misc_feature (606)..(607): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattatgtgttaaaggcgagctggaatacggggaccggggcccgacttggaccacgtggggaccagggggacgcgtggtccaccgtctccctcacgcctccaccaagggcccacgtccggtccttccccccgtcggcccacccctccctcccaacgacgccaccctcgtcgggggccacgacgccacgccccgtgggctcggcccgtgggtaccgaacgggacctaccgttacccgtacgtaccctacgttccgtggtacggccggggtctcggggaccaacgggcgacaagtagnngtc

SEQ ID NO: 53305 - DNA, 635 bp, Homo sapiens
  misc_feature: GYAE6OF01CULBY.29.78.H01.1.454.CMB.1.raw
  modified_base (327)..(327): a, c, t, g, unknown or other
  misc_feature (327)..(327): n is a, c, g, or t
  modified_base (630)..(630): a, c, t, g, unknown or other
  misc_feature (630)..(630): n is a, c, g, or t
tcagatagagtactcacgaccggtgctcgatttagtgtgagtagtttgggtttggtggtctctctcccagcctgtgctgactcaatcgccctctgcctctgcctccctgggaggctcggtcaaggtcacctgtactctgagcagtggacacagcagctacgccatcgcttggcatcagcagaggccagacacgggccctcgttacttgatgacagtcaaacaatgatggcagtcacagcgaagggggacggatccctgatcgcttctcacgtctccagctcgtggcctgacgcgctacctcacatctccggcctcagtctgagatgngctgacttatactgtacgacgtaccgtgggcacgtcggactagttcgagggttcccgttacggggaaccgggtaaccgtaacgggttccgaaccgggttccggttccggaccgaaccgggtacccccgaaacgggtaccccctaaccccgtacgttaccggtaccctaacccgtttccgttaccgttacccccctaacccctttccgtaacctacggttacccttcgttaacgtccggttacggaccgggtcggggtcccgttcggggaaacccgtaacggggcccgttacgacgttaagcgngtacg

SEQ ID NO: 53306 - DNA, 749 bp, Homo sapiens
  misc_feature: GYAE6OF01A5TFZ.29.78.H01.1.454.CMB.1.raw
  modified_base (162)..(162): a, c, t, g, unknown or other
  misc_feature (162)..(162): n is a, c, g, or t
  modified_base (190)..(190): a, c, t, g, unknown or other
  misc_feature (190)..(190): n is a, c, g, or t
  modified_base (228)..(228): a, c, t, g, unknown or other
  misc_feature (228)..(228): n is a, c, g, or t
  modified_base (253)..(253): a, c, t, g, unknown or other
  misc_feature (253)..(253): n is a, c, g, or t
  modified_base (618)..(618): a, c, t, g, unknown or other
  misc_feature (618)..(618): n is a, c, g, or t
tcagatagagtactcacgaccggtgctcgatttagtgtgagtagtttgggtttggggtcggtgagagaggagtccacccctgggatcgttcaggtgttttcatttggtgatcaggacggaacagagagaactcaccatggaggtttgggctggagcggtcgngttttctaggtcggctaattttaaaggngtccagtgtgacgtgcagttggtggagtcgtgggggcnccgtagggtacggccgggggggtcncgtgagacgtctcctggtgcggtccttacgtaggtatttaaggttttaggagtcatcgccatagaacgtcgggtccgacgacggcctccgaggggaagggctaggaggtgggtctcggtcttagttacggtcggcgtaggttggtggcgtcttatagttagttagtgacgagacccgacccgtaggaacggggtcccgtttacgaccgtaagtttcccgagtacggaacctaacgttaccggaaagtaacacggtcgtagtacgtactaggactaaacgtgggacgtacgcccgtagaacgtacgtacggaaccgaacgaccggtccgttaccttagtttacggttacggtacggttaaaacggnggtaacgtaccggttaagggtaaacggtacccggggacccggggtaccccggtaccggttaccggtaacccggacccgggtaccgggggtacccggaacgggggacccgttcgggtcccggttacccccgg

SEQ ID NO: 53307 - DNA, 749 bp, Homo sapiens
  misc_feature: GYAE6OF01CU3AE.29.78.H01.1.454.CMB.1.raw
  modified_base (278)..(278): a, c, t, g, unknown or other
  misc_feature (278)..(278): n is a, c, g, or t
  modified_base (314)..(314): a, c, t, g, unknown or other
  misc_feature (314)..(314): n is a, c, g, or t
  modified_base (325)..(325): a, c, t, g, unknown or other
  misc_feature (325)..(325): n is a, c, g, or t
  modified_base (343)..(343): a, c, t, g, unknown or other
  misc_feature (343)..(343): n is a, c, g, or t
tcagatagagtactcacgaccggtgctcgatttagtgtgagtagtttgggtttggggtccgagccatggtgcagactccccagagctctcctcctcctccactgcacagggtctctctcccagcctgtgctgactcaatccgccctctcgcctctcgccctcccgtgggacggtctcggtcaaggtcacctgtactcgtgagcagtggacacagcagctacgcctatcgcttggcatcagcagacgcagacgacggcctgttactgatgacagtcaanatgatggcagtcagaggcgaagggggacgactccgngactcgcttcnctagtcctcgagtctcgngggtcctaggacgtccgtacctacccgtacaactaaccgttccgtacccggtccttaccgtaacgttccggtaggtaaaccgggtagtaccgggtacggtaccgttaacgggttaacctttaaacgtttacccgtacggtaacccggtaacggggtaccccgggtacggggggtaccctaaccgggttcgggtactttaaccggttaccgggttaacccggggtttacccgggttaacccggggggaaacccggggtaacccgtaaaccggggtacccgttaacccgggttacccgggtccgggtaacccggaacccggaccccggtaaaccccgggtaaccccctaaacccggtcccggttacgtacccctacccggtttacccgtccccggtttaacccccccg

SEQ ID NO: 53308 - DNA, 665 bp, Homo sapiens
  misc_feature: GYAE6OF01CMK9S.29.78.H01.1.454.CMB.1.raw
  modified_base (332)..(332): a, c, t, g, unknown or other
  misc_feature (332)..(332): n is a, c, g, or t
  modified_base (662)..(662): a, c, t, g, unknown or other
  misc_feature (662)..(662): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccgttcaccatttccagagacaattcgaaagaacacgctgtatctgacaaatggagagcctgagactcgacgacacggccgtctatattgtagttaaagcganctaggaagtacgggaccgggcccgtacgttagaccacgtcggggaccgagggggacgcgtaggtccaccgtcgtcctcgacgccctaccgaaccaacggggaccccacgttccggtccctttccccccgtcggacccaccccgtcccttaccaacggacgcccgaccctccggtcgggggaccacgacggccacggccccgtgggcctcggtccccgtgggtaccaaacgggtacctaaccgttcccaacggttaccctccttaacgttccgtacgggacggtcccggggtacgttcgggaccgtaaacgggacccgacgtaacgtaggngac

SEQ ID NO: 53309 - DNA, 726 bp, Homo sapiens
  misc_feature: GYAE6OF01C3RQ7.29.78.H01.1.454.CMB.1.raw
  modified_base (339)..(339): a, c, t, g, unknown or other
  misc_feature (339)..(339): n is a, c, g, or t
  modified_base (723)..(723): a, c, t, g, unknown or other
  misc_feature (723)..(723): n is a, c, g, or t
  modified_base (725)..(725): a, c, t, g, unknown or other
  misc_feature (725)..(725): n is a, c, g, or t
tcagatagagtactcacgaccggtgctcgatttagtgtgagtagtttgggtttggggcgcctgggtacggccggggggtcgctgagactctcctgtgcggcctctggatttaagttttaggagtcatcgccatgaacgtgggtccgccgaggcctccgagggaagggcgtggaggtgggtcgtcggcttagttagtggcgaggtggtggcgctatatattagtgcgagaccgcccgtggaacgggtccggttcacctagtttccgagagactaagttcgaagaacacgctgtatcgtgacaaagtggagacgcctgagacgtcgacgacgacggccgtntagtttagttggtagttaaaggcgagtcgtagggaacgtaccggggacccgggcccgtacgttcggaccgtacggtcgggggaccgagggggaccgtcgttcgggtcctacccggttcctcccgtcgacggtccccgtacccgaacccggtaaacgggtccccgtaacggttcccggttcccgtttccccccgtcggtacccctaccccgttacccgtaccgaaacggaccgacccgtacccgtcggtacggggaccacgacgccgacgtcccgtcgggtccgtcggtcccgtacggtaccgaacggtaccgttaccgttaccgtacgttaccgtcgttacgtcgtaggacggtcgggcgtacgggacgacggccgagacgtgngng

SEQ ID NO: 53310 - DNA, 630 bp, Homo sapiens
  misc_feature: GYAE6OF01ESQPD.29.78.H01.1.454.CMB.1.raw
  modified_base (261)..(261): a, c, t, g, unknown or other
  misc_feature (261)..(261): n is a, c, g, or t
  modified_base (617)..(617): a, c, t, g, unknown or other
  misc_feature (617)..(617): n is a, c, g, or t
tcagatagagtactcacgaccggtgctcgatttagtgtgagtagtttgggtttggggtctgagagaggagtccacccctgggatcttcaggtgttttcatttggtgatcaggacggaacagagagaactcaccatggagtttgggctgagcgtgtcgtttctaggtggctatttaaaaggtgtcagtgtgacgtgcagttggtggagtctgggggcgccgtggggtacggccggggggtgctgagctctcctgtgcgcctntggattaagtttagagtcatgccatgaactggtccgccaggctccgagggagggctggagtgggtctcggctagttagtggctagtggtggcgtctagtatagttatgcagaccgcccgtggaacgggtccggtacaccgtatttccgaagtacgactaactttaccggaaagaaccacgcttagtatctagaccaaaagtggacgagcctggacgtacctcggaacgtaccaaccgggtcccttagttagtttagttggtaggttaaacggcgtaagtcgtagggaacggtacccgggggacccgggcccgtagttaccggaccctacgggtcggggacccgagggggtacccgngttcgggaccccg

SEQ ID NO: 53311 - DNA, 583 bp, Homo sapiens
  misc_feature: GYAE6OF01AHPNN.29.78.H01.1.454.CMB.1.raw
  modified_base (487)..(487): a, c, t, g, unknown or other
  misc_feature (487)..(487): n is a, c, g, or t
  modified_base (574)..(574): a, c, t, g, unknown or other
  misc_feature (574)..(574): n is a, c, g, or t
  modified_base (581)..(581): a, c, t, g, unknown or other
  misc_feature (581)..(581): n is a, c, g, or t
  modified_base (583)..(583): a, c, t, g, unknown or other
  misc_feature (583)..(583): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccgggccgacttgaccacgtggggccaggggacgcgtggtccaccgtctcctcacgccctccaccaagccacctcgtccgtccccttcccgcgccctaccctccacgagcaccctcgtcgggcggcacgcgcgaccgtccggnggtccgtccgtcggtcggtaacgacgtaccttacctccgtacgttacttctacgttcgaggcgggtccggtacgcgggaacgacggnactaagngn

SEQ ID NO: 53312 - DNA, 538 bp, Homo sapiens
  misc_feature: GYAE6OF01EV7WM.29.78.H01.1.454.CMB.1.raw
  modified_base (514)..(514): a, c, t, g, unknown or other
  misc_feature (514)..(514): n is a, c, g, or t
  modified_base (537)..(538): a, c, t, g, unknown or other
  misc_feature (537)..(538): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacggggaccgggccgacttgaccactggggccagggggacgctggtcaccgtctcctcagcctccaccaagggcccactcgtcttccccctgccaccctcctccaagacgcacctctcggggcacagcagcccgtggctcgcctggtcaacggactacttccagtactctatctnagcgggctggcgaaggcgcatgnn

SEQ ID NO: 53313 - DNA, 623 bp, Homo sapiens
  misc_feature: GYAE6OF01B0H8H.29.78.H01.1.454.CMB.1.raw
  modified_base (396)..(396): a, c, t, g, unknown or other
  misc_feature (396)..(396): n is a, c, g, or t
  modified_base (623)..(623): a, c, t, g, unknown or other
  misc_feature (623)..(623): n is a, c, g, or t
tcagatagagtactcacgaccggtgctcgatttagtgtgagtagtttgggtttgggggtcggccgtgggtacgggccgggggggtcggcgtgagactctcctgtgcggcctctggattaagttttaggtagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccggggccccgacgttcgaccactggggggcccaggggggaccnctgggtccaccggtcctccctcacggccctcccaaccgaacgggcccacgtccggtccttcccccgtcggcccaccctccctcccaacgacgccaccctcgtcgggggccacgacgaccacggccccgtcggggccgtcggtccgtccgggtcgaacgggtaccttacgttaccctacggtacctccttacgtctgacggcgggcgtggcgaaggcgacgatacggn

SEQ ID NO: 53314 - DNA, 578 bp, Homo sapiens
  misc_feature: GYAE6OF01A4RQL.29.78.H01.1.454.CMB.1.raw
  modified_base (382)..(382): a, c, t, g, unknown or other
  misc_feature (382)..(382): n is a, c, g, or t
  modified_base (399)..(399): a, c, t, g, unknown or other
  misc_feature (399)..(399): n is a, c, g, or t
  modified_base (576)..(577): a, c, t, g, unknown or other
  misc_feature (576)..(577): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattatgtgttaaaggcgagctggaatacggggaccggggcccgacttgaccacgtggggccagggggacncgtggtcaccgtctccncgacgcctccaccaacgggcccatccggtccttcccccgtggccctacccctcctaccaacgacgccacctccgtcggggcacacgcacgccctcgggctcgccctggtccaacggtacctaccgttccacgtacctctactcgtgacgccgggctcgggacgaacggcgacagtgnng

SEQ ID NO: 53315 - DNA, 623 bp, Homo sapiens
  misc_feature: GYAE6OF01BA4OP.29.78.H01.1.454.CMB.1.raw
  modified_base (620)..(620): a, c, t, g, unknown or other
  misc_feature (620)..(620): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgacaaaatggagagcctgacgactccgacgacaccggccgtctattattgtagttaaggcgagctaggaatacggggacccggggcccgacttcggaccacgtggggccgagggggacgcgtcggtcacccgtctcctcacgccctccaacccgaacgggcccacgttccggtcccttcccccgtcggcccaccccttccctaccaacgacgcctaacccgtcgtcggggccacgcgcacgcccgtgggcctcggcccgtcggacgaacggtacctaccgttccacgttacctcctacgtccgtaggacggccgggcgttcgggaccgtaacgggccgacagtcgnacg

SEQ ID NO: 53316 - DNA, 584 bp, Homo sapiens
  misc_feature: GYAE6OF01EEYGL.29.78.H01.1.454.CMB.1.raw
  modified_base (244)..(244): a, c, t, g, unknown or other
  misc_feature (244)..(244): n is a, c, g, or t
  modified_base (380)..(380): a, c, t, g, unknown or other
  misc_feature (380)..(380): n is a, c, g, or t
  modified_base (430)..(430): a, c, t, g, unknown or other
  misc_feature (430)..(430): n is a, c, g, or t
  modified_base (569)..(569): a, c, t, g, unknown or other
  misc_feature (569)..(569): n is a, c, g, or t
tcagatagagtactcacgaccggtgctcgatttagtgtgagtagtttgggtttggggggagagaggagtccacccctgggatcttcaggtgttttcatttggtgatcaggacggaacagagagaactcaccatggagtttgggctgagctggctttttcttgtggcttattttaaaaggtgtccagtgtgacgtgcagttggtggagtcgtgggggcgccgtggggtacgggccgggggggtcnctgagactctcctgtgcggcctctggatttaagtttaggagtcatgccatgaactgggtccgccaggctccgaggggaaggggcgtgggagtggggtctcggctagttagtggcaggtggtggcgctatatattangcagacgccctggaacgggccggttcaccatttccagagacaattcgaanaacacgctgtatctgacaaagtggagagcctgacgactcgacgacgaccggccgtactattattgtagttaaaggcgagcgtggtaataggtgggacccggggtccgacgttcgaccgacgtcggggccgaggggaccncgtcggtcgtacccg

SEQ ID NO: 53317 - DNA, 644 bp, Homo sapiens
  misc_feature: GYAE6OF01A1APH.29.78.H01.1.454.CMB.1.raw
  modified_base (288)..(288): a, c, t, g, unknown or other
  misc_feature (288)..(288): n is a, c, g, or t
tcagatagagtactcacgaccggtgctcgatttagtgtgagtagtttgggtttggggtccgagccatggtgcagactccccagagctctcctcctcctccactgcacagggtctctctcccagcctgtgctgactcaatcgccctctgcctctgcctccctgggaggctcggtcaaggtcacctgtactctgagcagtggacacagcagctacgccatcgcttggcatcagcagaggccagacacgggccctgttacttgatgacagtcaaacaatgatggcagtcanaggcgaaggggggacggatcccgtgactcgcttctcagtctccagtctcgtcgggcctggacgcgcctacctcaactactccgtcccggcctccgaggtcctaggaggtatggaacggtcttaggtaacttaacgtttaccgtggttaccgaaggtacccggttcgggggacctacggtcggtacctacgtttccggacgggtttccgttacccgggggaacccggggtaacccgaacgggttcccgaacccgggtttccgggtccgggtacccaaccgggtacccccgaaaccgggcccccctaaacccccgtcgttacccggttacccaccttcccgttcccgttacccccccg

SEQ ID NO: 53318 - DNA, 599 bp, Homo sapiens
  misc_feature: GYAE6OF01BXN93.29.78.H01.1.454.CMB.1.raw
  modified_base (597)..(597): a, c, t, g, unknown or other
  misc_feature (597)..(597): n is a, c, g, or t
  modified_base (599)..(599): a, c, t, g, unknown or other
  misc_feature (599)..(599): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccggggcccgacttcgaccacgtcggggccagggggacgctggtcaccgtctcctcagcctccaccgaacgggcccatccggtccttccccctggccaccctcctaccaacgacgccacctccgtcgggggccacgacgaccacgccccgtgggcctcggtccgtcgggtacaacgggaccttacgttcccgagttacctctacgtcgtaggacggtccggggcgtacggacgaaacgggtcgaccacgtagngn

SEQ ID NO: 53319 - DNA, 587 bp, Homo sapiens
  misc_feature: GYAE6OF01DAVRB.29.78.H01.1.454.CMB.1.raw
  modified_base (582)..(582): a, c, t, g, unknown or other
  misc_feature (582)..(582): n is a, c, g, or t
  modified_base (586)..(587): a, c, t, g, unknown or other
  misc_feature (586)..(587): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgccaggctccagggaagggctggagtgggtctcggctattagtggcagtggtggcgctatatatatgcagacgccctgaagggccggttcaccatttccagagacaattcgaagaacacgctgtatctgcaaatggagagcctgagactcgacgacacggccgtctattattgtgttaaaggcgaggctggaatacgggaccggggcccgacttcggaccacgtggggccgagggggaccgcgtggtcacccgtctcctcagcctccaccacgggcccatccggtccttccccctggcccaccctcctccgaacgcgccaccgtccgtggggccacgacgcacggcccctggggctcggccgttggtccaacgggaccttaaccgttcccgaacgttacctcttaacgtcgttaggacggcggcggtgcgaaggccganatgnn

SEQ ID NO: 53320 - DNA, 613 bp, Homo sapiens
  misc_feature: GYAE6OF01CX92A.29.78.H01.1.454.CMB.1.raw
  modified_base (382)..(382): a, c, t, g, unknown or other
  misc_feature (382)..(382): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacggggaccgggcccgacttgaccacgtggggccagggggacncgtggtcaccgtctcctcacgcctccaccgagggcccacgtccggtccttcccccgtggcccaccctcctcccaacgacgccaccctccgtcgggggccaacgacgccgacgcccgtagggccgtcgtcccgtggtcctaacgggaccttaaccttcccgtacgttacctcctacgtccgtaggacggtccggggcgttcgggacgtaacgggacgacctagtaggctacg

SEQ ID NO: 53321 - DNA, 586 bp, Homo sapiens
  misc_feature: GYAE6OF01CPHJL.29.78.H01.1.454.CMB.1.raw
  modified_base (219)..(219): a, c, t, g, unknown or other
  misc_feature (219)..(219): n is a, c, g, or t
  modified_base (233)..(233): a, c, t, g, unknown or other
  misc_feature (233)..(233): n is a, c, g, or t
  modified_base (251)..(251): a, c, t, g, unknown or other
  misc_feature (251)..(251): n is a, c, g, or t
  modified_base (254)..(254): a, c, t, g, unknown or other
  misc_feature (254)..(254): n is a, c, g, or t
  modified_base (260)..(260): a, c, t, g, unknown or other
  misc_feature (260)..(260): n is a, c, g, or t
  modified_base (275)..(275): a, c, t, g, unknown or other
  misc_feature (275)..(275): n is a, c, g, or t
  modified_base (288)..(288): a, c, t, g, unknown or other
  misc_feature (288)..(288): n is a, c, g, or t
  modified_base (328)..(328): a, c, t, g, unknown or other
  misc_feature (328)..(328): n is a, c, g, or t
  modified_base (359)..(359): a, c, t, g, unknown or other
  misc_feature (359)..(359): n is a, c, g, or t
  modified_base (581)..(581): a, c, t, g, unknown or other
  misc_feature (581)..(581): n is a, c, g, or t
tcagatagagtactcacgaccggtgctcgatttagtgtgagtagtttgggtttggtggtctctctcccagcctgtgctgactcaatcgccctctgcctctgccctccctgggaggctcggtcaaggtcacctgtactctgagcagtggacacagcagctacgccatcgcttggcatcagcagacggccagacacgggcctgttactgatgacagtcaanatgatggcagtcanagcgaaggggcgatccgngancgctcncgagtctcagctcgngggcctgacgccnctacctcactactccgtccgcctcgtagtcgtaggaggtntacggaggtcctagtaacttacgtttaccgngttacgacggtacccgtggggcctaacggtggacttacgttcggacgggttccgtaccggggaaccgggtaactacggtccgtaccggtcgacgtacgacgacccgaaggaccccaaccgtgtacgtaccaccgttccgttaccttccccaccttccacgttacttaccttcgtacttaccggtggaccggtccgggtctcggaaccgtaggtcccgatagngctgc

SEQ ID NO: 53322 - DNA, 998 bp, Homo sapiens
  misc_feature: GYAE6OF01B2T56.29.78.H01.1.454.CMB.1.raw
tcagatagagtactcacgaccggtgctcgatttagtgtgagtagtttggggtttgggggcgcctgggtacggccggggggtcgctgagactctcctgtgcggcctctggattaagttttaggagtcagtgccatgaactgggtccgcgaggctccgagggaagggctggagtgggtctcggctagttagtggcagtggtggcgctatatattagtgcgagtaccgcccctaggaacgggcccggttacaaccgtacttttacccgaaggaaacgaacctaaactttaccggaaaggtaaccaacggtaccttaggtaacttcgttacggacctaaaaagttgggaacgaaggtaccctaggaacgtacttaccggaaccgtaacggaacccgggtccggttacttaacgttttaacgtttgggttaacgggtttaaaaacggggcccggtaagggtacccggttaagggggtaaaacggttaacccggggggtaaccccggggtaccccgttaacgtttacgggaaacccctacgggttaccggggggacccgaaacgggggggtaccgtaccggttaccgggttacccgaacccggtttccgtaccccgttaccggaaccggtacccccgttacccggaaacccggtaaccggggtaccccctaacggttaccccggttccccgtttacccccccgtacgggtaccccgtaccccgttacccgttaacccgaaaccggtaccgacccgtaaccccgtaccgggtaccgggggtaccctaacccgtaaccggtaacccgtaaccgggtccccggttaccggggtacccgttaccgggtaccccggttacggggttaacccgaaaccgggttaaccgttaaccccgttacccggtaaacggttacccgttaaccgttacggttacccgttacgggaccggggtccggggtaccgttagggaccggtaaacggggtaccgaaccgtaagttaggcgtagg

SEQ ID NO: 53323 - DNA, 615 bp, Homo sapiens
  misc_feature: GYAE6OF01E078N.29.78.H01.1.454.CMB.1.raw
  modified_base (181)..(181): a, c, t, g, unknown or other
  misc_feature (181)..(181): n is a, c, g, or t
  modified_base (217)..(217): a, c, t, g, unknown or other
  misc_feature (217)..(217): n is a, c, g, or t
  modified_base (239)..(239): a, c, t, g, unknown or other
  misc_feature (239)..(239): n is a, c, g, or t
tcagatagagtactcacgaccggtgctcgatttagtgtgagtagtttgggtttgggggagagaggagtccacccctgggatcttcaggtgttttcatttggtgatcaggacggaacagagagaactcaccatggagtttgggctgagcgtggtcgttttctaggtggctattttaaaaggngtcagtgtgacgtgcagttggtggagtctgggggcnccgtgggtacggcggggggtcncgtgagctctcctgtgcggcctcgtggatttaagttttaggagttcagtgccatagacgtggtccgcaggctccgagggaagggcgtggaggtgggtcgtcggctagttgtggcaggtggtggcgctatatattatgcagccgcctggaacgggccggttcaccactttccagagtacaattacgaacgtaacacgacgtgttatcgtgactaaagtggaagacgtcctagacggtacacgaccgaaccgccggaccggtacttagttacgttgttagttaaacggcgtagtcgtagggtaacgacgggggtaccccgggccgtacgttcggcgtacggtcgggccgaggggtaccgcgtcggtccgccgtacccg

SEQ ID NO: 53324 - DNA, 651 bp, Homo sapiens
  misc_feature: GYAE6OF01AQIBS.29.78.H01.1.454.CMB.1.raw
  modified_base (243)..(243): a, c, t, g, unknown or other
  misc_feature (243)..(243): n is a, c, g, or t
tcagatagagtactcacgaccggtgctcgatttagtgtgagtagtttgggtttgggggagagaggagtccacccctgggatcttcaggtgttttcatttggtgatcaggacggaacagagagaactcaccatggagtttgggctgagcgtggtcgttttcttaggtggctattttaaaaggtgtccagtgtgacgtgcagttggtggagtctgggggcgcctggggtacggccgggggggtcnctgagactctcctgttcggcctctggtattaagttttaggagtcatgccatgaactgggtccgccaggctccgaggggagggctgggaggtgggtctcggctagttagtggcaggtggtggcgctatatattatggcagacgccctagaacggggccgttcacctactttccaagagacaattcgaagaacacgtctagtatcgtagacaaatggagacgcctagacgacgtcgacgacgacggtcctatatttacgtagttaaggtaacggcgtaacggtcgtaacgggtaacggtaccgggggtaccccggggacccgttacggttaccggaaccggtaccggggtcgggggtacccggaggggggtaccctcggttaccgggtacccgacccgttcccgtacccg

SEQ ID NO: 53325 - DNA, 518 bp, Homo sapiens
  misc_feature: GYAE6OF01DRM0T.29.78.H01.1.454.CMB.1.raw
  modified_base (492)..(492): a, c, t, g, unknown or other
  misc_feature (492)..(492): n is a, c, g, or t
  modified_base (516)..(517): a, c, t, g, unknown or other
  misc_feature (516)..(517): n is a, c, g, or t
tcagatagagtactcacgaccggtgctcgatttagtgtgagtagtttgggtttggtggtctctctcccagcctgtgctgactcaatcgccctctgcctctgcctccctgggaggctcggtcaaggtcacctgtactctgagcagtggacacagcagctacgccatcgcttggcatcagcagaggccagacacgggccctgttacttgatgacagtcaacaatgatggcagtcacagcgaaagggggacggatccctgatcgcttctcagtctccagctcgtgggcctggacgcgctacctcacaatcctccggcctcagtctgagatgagctgactatactgtcagaccgtggggcacgtggcagttcgaggtccgttacgggaaccgggtacctaacggtccaccggtcgtcggtccacgcccgaacggcccaacccgactcgtacctacctcttccgttccccacccttcctcgtacgtcctcgtatcgngacgcgggctggcacggcacatgnnc

SEQ ID NO: 53326 - DNA, 547 bp, Homo sapiens
  misc_feature: GYAE6OF01D3TOK.29.78.H01.1.454.CMB.1.raw
  modified_base (520)..(520): a, c, t, g, unknown or other
  misc_feature (520)..(520): n is a, c, g, or t
  modified_base (543)..(543): a, c, t, g, unknown or other
  misc_feature (543)..(543): n is a, c, g, or t
  modified_base (547)..(547): a, c, t, g, unknown or other
  misc_feature (547)..(547): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacggggaccggggcccgattgaccacgtggggccaggggacgctggtcaccgtctcctcacgccctccaaccgaacgggcccatccggtccttccccctcgggccaccctcctccaacgacgccacctcgtggggccacacgcacgccctgggctgcctgtcaaggactactccagtacctntatctgagcgggctggcgaggcnatgn

SEQ ID NO: 53327 - DNA, 542 bp, Homo sapiens
  misc_feature: GYAE6OF01AGQKT.29.78.H01.1.454.CMB.1.raw
  modified_base (223)..(223): a, c, t, g, unknown or other
  misc_feature (223)..(223): n is a, c, g, or t
  modified_base (275)..(275): a, c, t, g, unknown or other
  misc_feature (275)..(275): n is a, c, g, or t
  modified_base (326)..(326): a, c, t, g, unknown or other
  misc_feature (326)..(326): n is a, c, g, or t
tcagatagagtactcacgaccggtgctcgatttagtgtgagtagtttgggtttggggtccgagccatggtgcagactccccagagctctcctcctcctccactgcacagggtctctctcccagcctgtgctgactcaatcgccctctgcctctgcctccctgggaggctcggtcaaggtcacctgtactctgagcgagtggacacgagcagctacgccatcgnttggcatcagcagaggccagacacgggccctcgttacttgatgacagtcaanaatgatggcagtcacaggcgaaagggggacggatcccgtgactcgctttcncagtcctaccagctcgtgggcctggacgcgtacctaccgtcaactactccgtaccggcctccgagttctgagatgagctagactattactgtcagtccgtgggcacgtggctgttcgagtcgtacgggaccggtaccacggtccgacggtcggtccggtacacggtcccgaaccggccccaaccccgtcgtcgtacctacttccgtcgtccccccg

SEQ ID NO: 53328 - DNA, 557 bp, Homo sapiens
  misc_feature: GYAE6OF01C4GXV.29.78.H01.1.454.CMB.1.raw
  modified_base (553)..(553): a, c, t, g, unknown or other
  misc_feature (553)..(553): n is a, c, g, or t
  modified_base (557)..(557): a, c, t, g, unknown or other
  misc_feature (557)..(557): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacggggaccggggccgacttgaccacgtgggggccagggggacgcgtggtcaccgtctcctcagccctccaccgagggcccatccggtccttccccctcggccaccctcctccaacgacgcaccctcgtcggggcacgacgcacgcccgtgggctgcgagtggtacgacggactacttccacgtactctactcgtgcgcgggctggcaggcgcngtgn

SEQ ID NO: 53329 - DNA, 648 bp, Homo sapiens
  misc_feature: GYAE6OF01CWT9Y.29.78.H01.1.454.CMB.1.raw
  modified_base (647)..(648): a, c, t, g, unknown or other
  misc_feature (647)..(648): n is a, c, g, or t
tcagatagagtactcacgaccggtgctcgatttagtgtgagtagtttgggtttgggggcgcctgggtacggccggggggtcgctgagactctcctgtgcggcctctggatttaagttttaggagtcatgccatgaactgggtccgccaggctccagggaaggggctggagtgggtctcggctattagtggcagtggtggcgctatatattatgcagacgccctgaagggccggttcaccatttccagagacaattcgaaagaacacgctgtatctgacaaagtggagagcctgagactcgacgacgacggccgtctattattgtagttaaaggcgagcgtagaagtaccggggacccgggcccgacttcgaccacggtcggggaccgagggggaccgcgtcggccaccggtcctccgtcaacgccctaccgaacccgaacgggcccacgttccggtcccttccccccgtcgggccctaccccgtaccctaccgaacgacgccctacccgtcggtcgggggccaaccgacgccgaccggtcccgtggggcctcggtccgttcgggtaccgaacggtacctaaccgttcccgaacggtaccttcttacgttcgtgacggcgggcgtggaccgaacgggcacgactaggnn

SEQ ID NO: 53330 - DNA, 508 bp, Homo sapiens
  misc_feature: GYAE6OF01A43G1.29.78.H01.1.454.CMB.1.raw
  modified_base (319)..(319): a, c, t, g, unknown or other
  misc_feature (319)..(319): n is a, c, g, or t
tcagatagagtactcacgaccggtgctcgatttagtgtgagtagtttgggtttggggtccgagccatggtgcagactccccagagctctcctcctcctccactgcacagggtctctctcccagcctgtgctgactcaatcgccctctgcctctgcctccctgggaggctcggtcaaggtcacctgtactctgagcagtggacacagcagctacgccatcgcttggcatcagcagaggccagacacgggccctgttacttgatgacagtcaacaatgatggcagtcacagcaaggggggacggatcccctgatcgcttcncagtctccagcctctgggcctggacgcgcttacctcacaactctcccggcctccagtctgaggatgaggctgactattactgtcagacctggggcacgtggctagttcgaggtcttcgggaccggggacaaggtcaccgtcgtcggtcacggcccaaggcccaaccccacgtcgcacttctcgttcccc

SEQ ID NO: 53331 - DNA, 645 bp, Homo sapiens
  misc_feature: GYAE6OF01AUOVH.29.78.H01.1.454.CMB.1.raw
  modified_base (642)..(642): a, c, t, g, unknown or other
  misc_feature (642)..(642): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgacaaatggagagcctagagactcgacgacacggccgtctattagttgtagttaaaggcgaagcgtaggaacgtaccggggacccggggcccgtacgttacgaccgaacgtcgggggacccgagggggaccgcgtcggtccaccgtcctcctcgacgccctaccgaaccgaacgggcccgtacgtccggttccgttcccccgtcggaccctaccctccctaccgaacgacgcctaccgtcgtacggggcacgacgccgacgtcccgtacggccgtcgtccgtcggtaccgaacggtaccttacgttcccgtacgtacctacctacgtcgtacggacggccgggcgtcggaccgacgggcgacgacgtgngcg

SEQ ID NO: 53332 - DNA, 628 bp, Homo sapiens
  misc_feature: GYAE6OF01CTKPK.29.78.H01.1.454.CMB.1.raw
  modified_base (625)..(625): a, c, t, g, unknown or other
  misc_feature (625)..(625): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgacaaatggagagcctgagactcgacgacacggccgtctattattgtagtaaaggcgagctaggaatacggggacccggggcccgacgttgaccacgtggggaccgaggggacgcgtggtccaccgttctcctacacgcctaccaccgaacgggcccactccggtccttcccccgtcggcccaccctccctaccgaacgacgaccacccgtccgtcggggccacgacgccacggtccccgtacgggcctcgtccgtacggtacaacggtaccttaaccgttcccgaacgttacccttactacgttccgtaggacggtccgggccgtacggacgaacgggccgacaacgtgntcg

SEQ ID NO: 53333 - DNA, 575 bp, Homo sapiens
  misc_feature: GYAE6OF01DOSWN.29.78.H01.1.454.CMB.1.raw
  modified_base (569)..(569): a, c, t, g, unknown or other
  misc_feature (569)..(569): n is a, c, g, or t
  modified_base (572)..(572): a, c, t, g, unknown or other
  misc_feature (572)..(572): n is a, c, g, or t
  modified_base (574)..(575): a, c, t, g, unknown or other
  misc_feature (574)..(575): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccggggcccgacttgaccacgtgggggccagggggacgcgtggtcaccgtctcctcagccctccaccgaacgggcccacgtccggttccttccccccgtcggcccacccctccctcccaacgacgccaaccctccgtcgggggccacacgcacgcccgtgggctcgccgtcggtcaacggactaccttccacgtactctactctagcgcgggctggacacggcnacngnn

SEQ ID NO: 53334 - DNA, 591 bp, Homo sapiens
  misc_feature: GYAE6OF01C2H5X.29.78.H01.1.454.CMB.1.raw
  modified_base (462)..(462): a, c, t, g, unknown or other
  misc_feature (462)..(462): n is a, c, g, or t
  modified_base (590)..(591): a, c, t, g, unknown or other
  misc_feature (590)..(591): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctaggaatacgggaccgggccgactgaccacgtggggccaggggacgctggtcaccggtctcctcacgcctccaccgaacgggcccacgtccggtccttccccctcggcccaccctcctacccaacgacnccacctcgtcgggggccacgacgcacgcccgtcgggcctcgtcccgtggtacgaacggtaccttaaccttcccaacgtacctcttactcgttaggaggtccgggcgtcggacgtaacgggcgacatgnn

SEQ ID NO: 53335 - DNA, 563 bp, Homo sapiens
  misc_feature: GYAE6OF01CDTOS.29.78.H01.1.454.CMB.1.raw
  modified_base (556)..(556): a, c, t, g, unknown or other
  misc_feature (556)..(556): n is a, c, g, or t
  modified_base (561)..(561): a, c, t, g, unknown or other
  misc_feature (561)..(561): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccggggccgacttgaccacgtggggccagggggacgcgtggtcaccgtctcctcagcctccaccaacgggcccacgtccggtccttccccctcggccctaccctcctccaacgacgcaaccctcgtcgggggccacgacgcgacgccctcgggctcgcctggtcaacggactacgtccagtactctactctgagcggctggcgaaggcganactgncg

SEQ ID NO: 53336 - DNA, 962 bp, Homo sapiens
  misc_feature: GYAE6OF01DBGVN.29.78.H01.1.454.CMB.1.raw
tcagatagagtactcacgaccggtgctcgatttagtgtgagtagtttgggtttggtggtctctctcccagcctgtgctgactcaatccgccctctgcctctgcctccctgggagctcggtcaaggtcacctgtactctgagcagtggacacagcagctacgccatcgcttggcatcagcagacggccagacacgggccctgttactgatgacagtcaacaatgatggacagtcaacaggcggaaacggggggaccgggacttccccgtaggactccgctttactcaggtcctccagcctacgtcgggcctgacgccgtctaccgtcacaatccgtacccgggccttaccgaaggttccgtaggaagggtaacttcgggaacgggtacctttacggaaacccttttacgtttaaccgttacggtaccgtaaacggtaccccgggttcggggggacccttaaaccggtccggggtacctttaaacggtttttcccgggtaaaacggggggttttacccccggtttttaacccggggggggaaaaccccccggggggtttaaaacccgtaaacccgggggttttaccccggtaaacccccggggttttccccggggttttaaaccccggggggttcccctaaaccccgggggaaacccccccccggttaaaaacccggggggaccccccccccttaaaaaaccccccgttccggtttttacccccggggtttaaccccttaaaccccgggttttcccccgtttaccccggggttttaaaccccccccccttaaaccccccgggttttccccttaaacccggtaaacccggttttttaacccccaacccgttttacggttacccggttaccgggggtaaaccgggtcccccggggggttacttaacccggggacccggttaaaaccggggttcccgtaacgttaaccggtaaggtcctacggtacg

SEQ ID NO: 53337 - DNA, 728 bp, Homo sapiens
  misc_feature: GYAE6OF01D61YO.29.78.H01.1.454.CMB.1.raw
  modified_base (307)..(307): a, c, t, g, unknown or other
  misc_feature (307)..(307): n is a, c, g, or t
tcagatagagtactcacgaccggtgctcgatttagtgtgagtagtttgggtttggggtctgagagaggagtccacccctgggatcttcaggtgttttcatttggtgatcaggacggaacagagagaactcaccatggagtttgggctgagctggctttttcttgtggctattttaaaaggtgtccagtgtgacgtgcagttggtggagtcgtgggggcgccgtggggtacgggccgggggggtcgctgagactctcctgtgcggcctctggattaagttttaggagtcatgccatgaactgggtccncaggctccgaggggaggggctgggaggtgggtctcggctagttaggtggcaggtggtggcgctatatattatgcagccgccctaggaacgggtccgttacacctatttccagacgactaagttcgaaagaacacgtctagtactctagacaaagtgggagacgccgtaggacgtaccgtacggaaccggaaccgtaccgggcccgttactttaaagtttacgtttagggttaacggtttaaaaacgggccggtaaacggtaccggttaaggggtaaaaccgggttaaccccgggggggaacccccgggggggtacccccgttaacggtttacccggggaaacccccgtaacccgggggttccgggggggaacccccggtaaggggggggtaccccgtccgggttccggggttaccccccgg

SEQ ID NO: 53338 - DNA, 600 bp, Homo sapiens
  misc_feature: GYAE6OF01EVY0E.29.78.H01.1.454.CMB.1.raw
  modified_base (212)..(212): a, c, t, g, unknown or other
  misc_feature (212)..(212): n is a, c, g, or t
  modified_base (593)..(593): a, c, t, g, unknown or other
  misc_feature (593)..(593): n is a, c, g, or t
  modified_base (598)..(599): a, c, t, g, unknown or other
  misc_feature (598)..(599): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattangcagacgccctgaagggccgttcaccatttccagagacaattcgaagaacacgctgtatctgacaaatggagagcctgagactcgacgacacggccgtctattatgtgttaaaggcagcgtaggaagtacgggaccggggcccacgttacgaccgacgtcggggaccagggggacgctggtccaccggtctcctcacgcctccacgaacggcccagtccggtccttccccgtcggccaccctcctaccaacgacgccacctcgtcggggaccacgacgccacgcccgtcgggctcggtccgtgggtaccaacggtaccttacgttacccacggttacctacttacgtccgtggacggtccggcgtggaccgaaggcgacgngtagnng

SEQ ID NO: 53339 - DNA, 583 bp, Homo sapiens
  misc_feature: GYAE6OF01C6F8I.29.78.H01.1.454.CMB.1.raw
  modified_base (576)..(576): a, c, t, g, unknown or other
  misc_feature (576)..(576): n is a, c, g, or t
  modified_base (583)..(583): a, c, t, g, unknown or other
  misc_feature (583)..(583): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctaggaatacggggaccggggcccgacttgaccacgtcggggccagggggacgcgtggtcaccgtctcctcacgcctccaccgacgggcccacgtccggtccttcccccgtggcccaccctccctaccaacgacgccacctcgtcgggggccacacgcacgcccgtgggctcgccgtggtccgaaggtacctaccttcctacgtaccttactactctggacggcgggcgtggacgaacggcganacgtagn

SEQ ID NO: 53340 - DNA, 580 bp, Homo sapiens
  misc_feature: GYAE6OF01CU17X.29.78.H01.1.454.CMB.1.raw
  modified_base (575)..(575): a, c, t, g, unknown or other
  misc_feature (575)..(575): n is a, c, g, or t
  modified_base (579)..(580): a, c, t, g, unknown or other
  misc_feature (579)..(580): n is a, c, g, or t
tcagatagagtactcacgaccggtgctcgatttagtgtgagtagtttgggtttgggggcgcctgggtacggccgggggggtcgctgagactctcctgtgcggcctctggattaaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtagttaaaggcgagctaggaagtaccggggaccggggcccgacttcgaccacgtgggggccagggggacgcgtggtccaccgtctcctcacgccctccaaccgaggcccactccggtccttccccctcggcccaccctcctaccaacgacgccacctcgtcggggcacgacgcacgcccgtcgggctcgccgtggtacaacggacctaccttccacgtacctctactcgtgacggcgggctgggacaacggcganatgnn

SEQ ID NO: 53341 - DNA, 563 bp, Homo sapiens
  misc_feature: GYAE6OF01DRFFN.29.78.H01.1.454.CMB.1.raw
  modified_base (561)..(562): a, c, t, g, unknown or other
  misc_feature (561)..(562): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggtcgtctattattgtgttaaaggcgagctggaatacgggaccgggccgacttgaccacgtcggggccaggggacgcgtggtcaccgtctcctcacgcctccaccaagggcccagtccggtccttccccctcgggcccaccctcctccaagacgccacctccgtggggccacacgcacgcccgtgggctcgccgtggtcaaggacctacgttcccagtacctctactcgtgaggcgggctggacgaaggcgacatgnng

SEQ ID NO: 53342 - DNA, 620 bp, Homo sapiens
  misc_feature: GYAE6OF01BH90P.29.78.H01.1.454.CMB.1.raw
  modified_base (346)..(346): a, c, t, g, unknown or other
  misc_feature (346)..(346): n is a, c, g, or t
  modified_base (371)..(371): a, c, t, g, unknown or other
  misc_feature (371)..(371): n is a, c, g, or t
  modified_base (613)..(613): a, c, t, g, unknown or other
  misc_feature (613)..(613): n is a, c, g, or t
  modified_base (617)..(617): a, c, t, g, unknown or other
  misc_feature (617)..(617): n is a, c, g, or t
tcagatagagtactcacgaccggtgctcgatttagtgtgagtagtttgggtttggtggtctctctcccagcctgtgctgactacaatcgccctctgcctctcgcctccctgggaggctcggtcaaggtcacctgtactctgagcagtggacacagcagctacgccatcgcttggcatcagcagaggccagacgacgggcctgttactgatgacagtacaacatgatggcagtcacaggacgaagggggacgatcctagatcggtcttctcagtcctccgagtctcggtcggcctggacgcgactaccgtcacaacgtccgtccggtcctaccgagtcgagaaggtntcggacgcttacgactttacgtcgngtacgacggtaccggtgggacctacgtggtactagttacggacggttccgtacgggaacccgggaactacgggtccaaccggttcggtccgggtacaccggacccgaacggaccccaacccgtcgtaccgtaccgtacctccgttaacccttccccggtacccttaccgaccgtacgtttacccgtccttaaccgttcgtaccgggacggccgggtcgtacgggacgaacggtccgacgtancgtngcg

SEQ ID NO: 53343 - DNA, 560 bp, Homo sapiens
  misc_feature: GYAE6OF01C989C.29.78.H01.1.454.CMB.1.raw
  modified_base (413)..(413): a, c, t, g, unknown or other
  misc_feature (413)..(413): n is a, c, g, or t
tcagatagagtactcacgaccggtgctcgatttagtgtgagtagtttggggtttggggagagctctggggagtctgcaccatggctcggaccccactcctcttcctcaccctcctcctccactgcacagggtctctctcccagcctgtgctgactcaatcgccctctgcctctgcctcccgtgggagctcggtcaaggtcacctgtactctgagcagtggacacagcagctacgccatcgcttggcatcagcagaggccagacacgggccctgtacttgatgacagtcaacaatgatggcagtcacagcgaagggggacggactcccgtgatcgctttctcagtcctccagtcctcgtgggccctggacgccgcctaccctcaacactccctcccggcctccagtctggaggntgacggtctgtacttattacgtgtacgaggtaccgtggggactacgtggacctagttccgacgggttcgttaccggggaacccggggtactaacgggtccacccggttcggtccggtacacggcccaaacggccccaaccccgtacg

SEQ ID NO: 53344 - DNA, 577 bp, Homo sapiens
  misc_feature: GYAE6OF01DJJDR.29.78.H01.1.454.CMB.1.raw
tcagatagagtactcacgaccggtgctcgatttagtgtgagtagtttgggtttggggtccgagccatggtgcagactccccagagctctcctcctcctccactgcacagggtctctctcccagcctgtgctgactcaatcgccctctgcctctgcctccctgggaggctcggtcaaggtcacctgtactctgagcagtggacacagcagctacgccatcgcttggcatcagcagaggccagacaccgggccctcgttacttgatgacagtacaacaatgatggcagtcacaggacggaaggggggacggactccctgactccggtcttctcagtcctcgagtcctcgtcggcctggacgcgtctaccgcaactactcctccggcctccgagtcagagagtgacggtctagtaacttattacgtgtacgacgtaccgtggggctacgtcggctacgttcgacggttcgttaccgggaacccgggacgtaaggtcccgtaccggtcggtaccgggacacggacccgaaccggaccccaaccccgtacgtcgtacctaccgtcccttaccggttaccccc

SEQ ID NO: 53345 - DNA, 571 bp, Homo sapiens
  misc_feature: GYAE6OF01BJIC6.29.78.H01.1.454.CMB.1.raw
  modified_base (567)..(567): a, c, t, g, unknown or other
  misc_feature (567)..(567): n is a, c, g, or t
  modified_base (571)..(571): a, c, t, g, unknown or other
  misc_feature (571)..(571): n is a, c, g, or t
tcagatagagtactcacgaccggtgctcgatttagtgtgagtagtttgggtttggtggtctctctcccagcctgtgctgactcaatcgccctctgcctctgcctccctgggaggctcggtcaaggtcacctgtactctgagcagtggacacagcagctacgccatcgcttggcatcagcagaggccagacacgggccctcgttacttgatgacagtcaacaatgatggcagtcacaggacgaagggggacggatcccgtgatcgcttctcagtcctccagtctcgtcgggcctgacgccgctacctcacatccgtccgcctcagtctgagtatgacgctgacttagttactgtacaggaccgtggggacctagtcggactagttcgacgggttcgtaccgggaaccgggacctaaggtccaccggtcgtcgtacacgtcccgaaggaccccaacccgcgtcgtaccaccgttccttacccggttaccccacccttctacgtacgttctttccgacgtcgtacggtacggccgggtctacggtaccgaacggtccacgtagtacggcncgtn

SEQ ID NO: 53346 - DNA, 637 bp, Homo sapiens
  misc_feature: GYAE6OF01CTOFL.29.78.H01.1.454.CMB.1.raw
  modified_base (484)..(484): a, c, t, g, unknown or other
  misc_feature (484)..(484): n is a, c, g, or t
  modified_base (634)..(634): a, c, t, g, unknown or other
  misc_feature (634)..(634): n is a, c, g, or t
tcagatagagtactcacgaccggtgctcgatttagtgtgagtagtttgggtttggtggtctctctcccagcctgtgctgactcaatcgccctctgccctctgccctccctgggaggctcggtcaaggtcacctgtactctgagcagtggacacagcagctacgccatcgcttggcatcagcagaggccagacacgggccctgttactgatgacaatcaaacaatgatggcagtcacagcgaaagggggcggatccctgatcgcttctcagtctccagctcgtggcctgagccgctacctcacaatcctccggcctaccagtctgaaggatgaggctagacttattactgtacaggacccgtggggacacgtcggctagtttcgagggttccttaaccggggaacccgggggtaacctaaagggtcccgtaacccggttcggtccggtaccaacggacccccgaaagggcccccctaaaaccccngttacgtccctaaccgttcccgttacccgtttaccccccaacccccgttcctaccggtaactttaccctaccgttaacttcccggtagggaaccgggtcccggggcgttacgggggaccccgaaaaggggcccgtaaccaaagttacggntgc

SEQ ID NO: 53347 - DNA, 558 bp, Homo sapiens
  misc_feature: GYAE6OF01DAORP.29.78.H01.1.454.CMB.1.raw
  modified_base (553)..(553): a, c, t, g, unknown or other
  misc_feature (553)..(553): n is a, c, g, or t
  modified_base (557)..(558): a, c, t, g, unknown or other
  misc_feature (557)..(558): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccggggcccgacttgaccacgtggggccagggggacgcgtggtcaccgtctcctcagcctccaccaacgggcccactccggtccttcccccgtggcccacccctcctcccaacgacgccaccctcgtcgggggcacgacgcacgcccgtgggcctcgcctggtcaaggactacttccagtactctatctgagcgggctggcaaggcgnatgnn

SEQ ID NO: 53348 - DNA, 804 bp, Homo sapiens
  misc_feature: GYAE6OF01BI60J.29.78.H01.1.454.CMB.1.raw
  modified_base (119)..(119): a, c, t, g, unknown or other
  misc_feature (119)..(119): n is a, c, g, or t
  modified_base (121)..(121): a, c, t, g, unknown or other
  misc_feature (121)..(121): n is a, c, g, or t
  modified_base (123)..(123): a, c, t, g, unknown or other
  misc_feature (123)..(123): n is a, c, g, or t
  modified_base (128)..(128): a, c, t, g, unknown or other
  misc_feature (128)..(128): n is a, c, g, or t
  modified_base (132)..(132): a, c, t, g, unknown or other
  misc_feature (132)..(132): n is a, c, g, or t
  modified_base (135)..(135): a, c, t, g, unknown or other
  misc_feature (135)..(135): n is a, c, g, or t
  modified_base (138)..(138): a, c, t, g, unknown or other
  misc_feature (138)..(138): n is a, c, g, or t
  modified_base (141)..(141): a, c, t, g, unknown or other
  misc_feature (141)..(141): n is a, c, g, or t
tcagatagagtactcacgaccggtgctcgatttagtgtgagtagtttgggtttgggtccgagccatggtgcagactccccagagctctcctcctcctccactgcacagggtcctctccncncnctgcncgancanacnccncctgctcctcgctccctcggtgggcgtcgtcgacgacgtcctcgttacgtctcgagacgacgtagggacgaccaacgacgacgacgtaccgtacccgactacgtccgttcggtcgactacacgacgacgaaggaccgaccgaacggaacccgggaccccggttcccgtttaacgtttacgtagtacgtacgaacgtacgtaaaccaaattagagtggtcgacgtacgaccgaacggacggaacgggggaacgggggactacccttcggagtcgtccgttccttccgacgtacgttcccgaacggtcgttccgtcggggtccgtcgacggacccgtcccgtaaccttacccgaacaacgttacccgttccccggtacccgtccctacggttacgttcggaggaacgttcggaacgggaccgtttactaacgtttaactttacgtttcggtccgtaacggtaacccgggttcggggtacggaaccttacggggaccttacgtttacggttacgggttacccggtttaccggggaaccgggggaacgttacgtaaccgggttaccgtccccgggttacgggttcggttaccgaaccggtacccggaacccgggaacccaccccctaaccgtcgttacccaccgtttcccgtccgtttaaccccccg

SEQ ID NO: 53349 - DNA, 565 bp, Homo sapiens
  misc_feature: GYAE6OF01CGUT4.29.78.H01.1.454.CMB.1.raw
  modified_base (283)..(283): a, c, t, g, unknown or other
  misc_feature (283)..(283): n is a, c, g, or t
  modified_base (564)..(565): a, c, t, g, unknown or other
  misc_feature (564)..(565): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatgganagcctgagactcgacgacacggccgtctattattgtgttaaaggcgagctggaatacgggaccgggcccgacttgaccacgtggggcccaggggacgcgtgggtcaccgtctcctcacgcctccaccaacgggcccatccggtcttcccccgtcggccaccctccctccaacgacgcaccctcgtcggggcacgagcacgccctcgggctcgccgtcggtcaacgggacctacttcctacgtactctacgtctgagcgggctaggcgtaacggcgacatgnn

SEQ ID NO: 53350 - DNA, 600 bp, Homo sapiens
  misc_feature: GYAE6OF01AL696.29.78.H01.1.454.CMB.1.raw
  modified_base (599)..(600): a, c, t, g, unknown or other
  misc_feature (599)..(600): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtagttaaaggcgagctggaatacgggaccgggccgacttgaccactggggcaggggacgctggtcacgtctcctcacgccctccaccgaacgggcccactccggtccttccccctcggcccaccctccctcccaacgacgccacccgtccgtcgggggccacgacgccgacgccccgtagggccgtacgtccgtcggtcgtaacgggaccttaaccttcccacgttacctcttactcgttaggaaggccgggactgggggaccaacggggcgacgataggnn

SEQ ID NO: 53351 - DNA, 467 bp, Homo sapiens
  misc_feature: GYAE6OF01BGJ0H.29.78.H01.1.454.CMB.1.raw
  modified_base (391)..(391): a, c, t, g, unknown or other
  misc_feature (391)..(391): n is a, c, g, or t
  modified_base (448)..(448): a, c, t, g, unknown or other
  misc_feature (448)..(448): n is a, c, g, or t
  modified_base (451)..(451): a, c, t, g, unknown or other
  misc_feature (451)..(451): n is a, c, g, or t
  modified_base (453)..(467): a, c, t, g, unknown or other
  misc_feature (453)..(467): n is a, c, g, or t
tcagatagagtactcacgaccggtgctcgatttagtgtgagtagtttgggtttgggaggctcggtcaaggtcacctgtactctgagcagtggacacagcagctacgccatcgcttggcatcagcagaggccagacacgggccctcgttacttgatgacagtcaacaatgatggcagtcacagcgaagggggcggatccctgatcgcttctcagtcctccagcctcgtgggcctggacgccgctacctcaacaactcctcccggcctccagtctggaggatgacggctgaacttattactgtcacgaccgtggggcacgtggctagttcgtacggtccgtacgggaccgggtacaaggtccacggtcgtcgcacgacccaacgcccaacccntcgtccactctcctcccaccctctcacgtactctactcgtgcgcggctggacgagcncangnnnnnnnnnnnnnnn

SEQ ID NO: 53352 - DNA, 643 bp, Homo sapiens
  misc_feature: GYAE6OF01C5E9Q.29.78.H01.1.454.CMB.1.raw
  modified_base (245)..(245): a, c, t, g, unknown or other
  misc_feature (245)..(245): n is a, c, g, or t
tcagatagagtactcacgaccggtgctcgatttagtgtgagtagtttgggtttggggtctgagagaggagtccacccctgggatcttcaggtgttttcatttggtgatcaggacggaacagagagaactcaccatggagtttgggctgagcgtggctttttcttgtggctaattttaaaaggtgtccagtgtgacgtgcagttggtggagtctgggggcgccgtggggtacggccgggggggtcnctgagactctcctgtgcggcctctggattaagtttaggagtcatgccatgaactgggtccgccaggctccgaggggaaggggctgggagtgggtctcgggctagttagtggcagtggtggcgctatatattatgcagacgccctggaacgggcccggtttacacctatttccagacgaacaattcgaaagaacacgctgtatcgtgacaaagtggaagcgacctgaacgacctacggaaccgaccgaccggtccgttacttaatttagtttaggttaggttaaagggccgaaggtccgtagggaaacggtacccgggggacccgggggtaccccgtaccgtttacggaacccgtacggtcgggggacccgaaggggggaccgcggttcgggtaccccg

SEQ ID NO: 53353 - DNA, 623 bp, Homo sapiens
  misc_feature: GYAE6OF01BULD8.29.78.H01.1.454.CMB.1.raw
  modified_base (620)..(620): a, c, t, g, unknown or other
  misc_feature (620)..(620): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtagttaaaggcgagctaggaagtacgggaccggggccacgttcgaccacgtggggccgaggggacgcgtggtcaccggtctcctcacgcctccaccgaacgggcccacgtccggtaccttcccccgtcggcccacccctccctaccaacgacgcctacctccgtcggggaccacgacgccgacgtccccgtgggtccgtcgtccgtcggtaccaacggtacccttaccttacccgaagttacccttacttacgtccgtagacggcgggtcgtacgggaccgtaagggaccgacgacgttgntcg

SEQ ID NO: 53354 - DNA, 632 bp, Homo sapiens
  misc_feature: GYAE6OF01AYDH9.29.78.H01.1.454.CMB.1.raw
  modified_base (630)..(630): a, c, t, g, unknown or other
  misc_feature (630)..(630): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctatttattgtgttaaaggcgagctggaatacggggacccggggcccgacttcgaccacgtgggggcccagggggacgcgtcggtcaccgtctccctcgacgccctccacccgaacgggcccacgtaccggttccttccccccgtcgggcccctacccctccctcccgaaacgacgccaaccctccgtcgggggccacgacgccgacgcccgtcgggccgtcgcccgttgggtaccaacgggaccttaccgttccgacgttaccttctacgtccgtaggacggccgggtaccgtcgggacgaacgggcgaccgaagtaggncg

SEQ ID NO: 53355 - DNA, 632 bp, Homo sapiens
  misc_feature: GYAE6OF01B3270.29.78.H01.1.454.CMB.1.raw
  modified_base (631)..(631): a, c, t, g, unknown or other
  misc_feature (631)..(631): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctaggaatacggggacccggggcccacgttcgaccacgtggggaccgaggggacgcgtgggtccaccggtctccctcgacgccctcccaaccgaacgggcccagtccggttccttccccccgtcggccctacccctccctcccgaacgacgcctaacccgtccgtcgggggcaccgagccacgccccgtcgggccgtcgcccgtggtacgaacgggtacctaccgtcccgtagtacctcctacgtccgtggacgggtccgggccgttcgggaccggaacgggaccgtacaacgtacggnc

SEQ ID NO: 53356 - DNA, 640 bp, Homo sapiens
  misc_feature: GYAE6OF01DJ19D.29.78.H01.1.454.CMB.1.raw
  modified_base (284)..(284): a, c, t, g, unknown or other
  misc_feature (284)..(284): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatgganagcctgagactcgacgacacggccgtctattattgtgttaaaggcgagctaggaataccggggaccgggcccgacttgaccacgtgggggaccagggggacgcgttgggtccaccgtctcctcacgccctccaccgacgggcccactccggtcctttccccccgtgggccctaccccgtccctacccaacgacgcctaccctcgtcgggggccaacgacgccgacggccccgtaggggcctcggcccgtgggtaccgaacgggtaccctaccgtttcccgtaacgtaccttcttaccgttcgtggtacggccggggtccgttgggacccgtaaacgggccgaccgtagtacgctag

SEQ ID NO: 53357 - DNA, 594 bp, Homo sapiens
  misc_feature: GYAE6OF01BMTZY.29.78.H01.1.454.CMB.1.raw
  modified_base (470)..(470): a, c, t, g, unknown or other
  misc_feature (470)..(470): n is a, c, g, or t
tcagatagagtactcacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcgaggctgagatctgacgacacggccgtgtattactgtgcgagaggcaggtaattacgatttttggagttggttattcggacggtatggacgtcgtgggccaagggcccacggtccaccgtctcctcacgccctcccgaccaacgggcccagtcccggtccttcccccgtggcccacccctcctaccacgacnccaccgtcgtcggggccacgacgccggcccgtgggcctcggaccgtggtaccgtaacggtaccttaccgttcccgtaccggtacttcccggtacgttcgtacgggacggtccgggtcgtacggg

SEQ ID NO: 53358 - DNA, 691 bp, Homo sapiens
  misc_feature: GYAE6OF01BHWF8.29.78.H01.1.454.CMB.1.raw
tcagatagagtactcacgaccggtgctcgatttagtgtgagtagtttgggtttggggtccgagccatggtgcagactccccagagctctcctcctcctccactgcacagggtctctctcccagcctgtgctgactcaatcgccctctgcctctgcctccctgggaggctcggtcaaggtcacctgtactctgagcagtggacacagcagctacgccatcgcttggcatcagcagaggccagacaccgggccctgttacttgatgacagtcaaacatgagtggcagtcacaggcgaagggggcgatccctgactcgcttctcagtctccgagtctcgtcgggcctggacgccgtacctaccctcgaacaacttcccgtcccgggtccctccgaggttccgtaggaagggacttggagggtccttagtaaccttagttaccgtggtacgacggtacccgtgggggaccctacggtcggtaccttaacgtttccggtaacggggttcccggtttaacccgggggaacccgggggtaacccgtaaacggggttcccgtaaccccgggtttccgggtacccgggttacccgaacccgggtacccccggaaaacccgggtccccccaaaaccccccgttacgttacccggttaaacccgtttccccggttacccggttttcccccccggtacccccg

SEQ ID NO: 53359 - DNA, 632 bp, Homo sapiens
  misc_feature: GYAE6OF01DN6PQ.29.78.H01.1.454.CMB.1.raw
  modified_base (394)..(394): a, c, t, g, unknown or other
  misc_feature (394)..(394): n is a, c, g, or t
  modified_base (629)..(629): a, c, t, g, unknown or other
  misc_feature (629)..(629): n is a, c, g, or t
  modified_base (631)..(631): a, c, t, g, unknown or other
  misc_feature (631)..(631): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacggggaccgggcccgacgttgaccacgtggggccaggggacgctggcaccgtcncctcacgcctccaccgaacgggcccacgtccggtccttcccccgtcggccctacccgtccctcccaacgacgccacccgtccgtcgggggccacgacgccacgcccgtcgggccgtcgtcccgtcggtaccgaacgggtaccttaccttcccgtacgtaccgttccttacgtccgttaggacgggccggggtccgttcggggacccgtaaacgggacccggtaccgaagtacggngng

SEQ ID NO: 53360 - DNA, 630 bp, Homo sapiens
  misc_feature: GYAE6OF01EVN02.29.78.H01.1.454.CMB.1.raw
  modified_base (244)..(244): a, c, t, g, unknown or other
  misc_feature (244)..(244): n is a, c, g, or t
  modified_base (431)..(431): a, c, t, g, unknown or other
  misc_feature (431)..(431): n is a, c, g, or t
tcagatagagtactcacgaccggtgctcgatttagtgtgagtagtttgggtttggggtctgagagaggagtcccacccctgggatcttcaggtgttttcatttggtgatcaggacggaacagagagaactcaccatggagtttgggctgagcgtggctttttcttgtggctattttaaaaggtgtccagtgtgacgtgcagttggtggagtctgggggcgcctggggtacggccgggggggtcnctgagactctcctgtgcggcctctggattaagttttaggagtcatgccatgaactggggtccgccaggctccgaggggaaggggctgggaggtggggtctcggctattagtggcagtggtggcgctatatattatgcagacgccctgaacgggcccggttcacctatttccagagacaattacgaanaacacgctagtatctgacaaagtggagagcctgacgaccgtacgaacgacgaccggtccgtacgttaatttagttaggttaggttaaaggcggtaggaccgtaagggtaaacggtacccgggggaaccccggggtccccggtacgttacggacccgtacggtacgggggcccgaagggggaccgtcgtcgggtaccccg

SEQ ID NO: 53361 - DNA, 598 bp, Homo sapiens
  misc_feature: GYAE6OF01B49LK.29.78.H01.1.454.CMB.1.raw
  modified_base (596)..(596): a, c, t, g, unknown or other
  misc_feature (596)..(596): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattatgtagttaaaggcgagctggaagtacgggaccggggcccgacttcgaccacgtggggccgaggggacgcgtggtcaccgtctcctcacgccctcccaccgaacgggcccagtccggtccttcccccgtcggcccacccctccctaccgaacgacgccacccgtcgtcggggccacgacgccacgcccgtgggcctcgccgtggtacgaaggacctaccgttccaacgttcctactactcgttggacggtccgggcgtcgggacgaacgggccgacagtgncg

SEQ ID NO: 53362 - DNA, 685 bp, Homo sapiens
  misc_feature: GYAE6OF01DSMXV.29.78.H01.1.454.CMB.1.raw
  modified_base (246)..(246): a, c, t, g, unknown or other
  misc_feature (246)..(246): n is a, c, g, or t
  modified_base (317)..(317): a, c, t, g, unknown or other
  misc_feature (317)..(317): n is a, c, g, or t
tcagatagagtactcacgaccggtgctcgatttagtgtgagtagtttgggtttggggtctgagagaggagtccacccctgggatcttcaggtgttttcatttggtgatcaggacggaacagagagaactcaccatggagtttgggctgagcgtggtctttttcttgtggcttaattttaaaaggtgtccagtgtgacgtgcaggttggtggagtcgtgggggcgcgtgggacgggccggggggtcnctggagactctcctgtcgcggcctgtggtaatttaaggttttaggagtcatgccagtgaacgtcgggtccncacggctccgaggggaagggcgtgggagtcgggtctcggcttagttaggtggctagggttgggtcggcgtacttaagttattaatttagtcggacgacggacccgtacccgttagggaaccgggggtcccgttaccgaaccttacgtttacccgaaggtaacgaacctaagttaccggaaagaacgtacgcgttaagtactacgtcgaacaaaggtcggaagtacgcctaggactacgtacgaacgacgaccggtcctcttaagttgttagtagtaaagcgtagcggtaagacggtaccgggacccggtacctacgtccggaacccgcgggtacggggacccgtaaggggccgttcggtcggtacccg

SEQ ID NO: 53363 - DNA, 521 bp, Homo sapiens
  misc_feature: GYAE6OF01ENXOV.29.78.H01.1.454.CMB.1.raw
  modified_base (448)..(448): a, c, t, g, unknown or other
  misc_feature (448)..(448): n is a, c, g, or t
  modified_base (480)..(480): a, c, t, g, unknown or other
  misc_feature (480)..(480): n is a, c, g, or t
  modified_base (501)..(501): a, c, t, g, unknown or other
  misc_feature (501)..(501): n is a, c, g, or t
  modified_base (519)..(521): a, c, t, g, unknown or other
  misc_feature (519)..(521): n is a, c, g, or t
tcagatagagtactcacgaccggtgctcgatttagtgtgagtagtttgggtttggtggtctctctcccagcctgtgctgactcaatcgccctctgcctctgcctccctgggaggctcggtcaaggtcacctgtactctgagcagtggacacagcagctacgccatcgcttggcatcagcagaggccagacacgggccctcgttacttgatgacagtcaacaatgatggcagtcacaggcgaagggggacggatcccgtgatcgcttctcagtcctccagctcgtggggcctggacgccgcctacctcacaactcctccggcctccagtctgaggatggacggctgaacttattactgtcaggaccgtggggcacgtggcattcgaggttcgtccgggaccggggacaacggtccaccggtcgtcggtcacgcccaacggcccaacccnctcgtccactcctcgttccccaccctcctacncgtcctctatcgtgagcggcncggcaacggtcacagtgnnn

SEQ ID NO: 53364 - DNA, 570 bp, Homo sapiens
  misc_feature: GYAE6OF01CSUXM.29.78.H01.1.454.CMB.1.raw
  modified_base (248)..(248): a, c, t, g, unknown or other
  misc_feature (248)..(248): n is a, c, g, or t
  modified_base (476)..(476): a, c, t, g, unknown or other
  misc_feature (476)..(476): n is a, c, g, or t
tcagatagagtactcacgaccggtgctcgatttagtgtgagtagtttgggtttggggggaagaggaagactgacggtccacccctgggatcttcaggtgttttcatttggtgatcaggacggaacagagagaactcaccatggagtttgggctgagctggctttttcttgtggctattttaaaaggtgtccagtgtgacgtgcagttggtggagtctgggggcgcctggggtacggccgggggggtcnctgagactctcctgtgcggcctctggattaagtttaggagtcatgccatgaactgggtccgccaggctccaggggaagggggctggagtgggtctcggctattagtggcagtggtggcgctatatattatgcagacgccctgaacgggccgttcaccatttccagagacaattcgaagaacacgctgtatctgcaaatggagagcctgagactcgacgacacggcctntattattgtgttaaaggcgagctggaagtaccggggaccggggcccgacgttcggacccacgtcggggaccgagggggaccgcggtggtacccg

SEQ ID NO: 53365 - DNA, 698 bp, Homo sapiens
  misc_feature: GYAE6OF01D0B4S.29.78.H01.1.454.CMB.1.raw
  modified_base (668)..(668): a, c, t, g, unknown or other
  misc_feature (668)..(668): n is a, c, g, or t
tcagatagagtactcacgaccggtgctcgatttagtgtgagtagtttgggtttggggtccgagccatggtgcagactccccagagctctcctcctcctccactgcacagggtctctctcccagcctgtgctgactcaatccgccctctgcctctcgcctccgtgggagctcggtcaaggtcacctgtactctgagcaaggtggacacagcagctaccgcctagtcgcttggcatcgagacaggacggccgaagaccgaccgggtccctacgttacgttgagtagacagtaccaaataagtgacgtcggacacgtacaacgaggacgggaacggggggtacgtactcccgtagtaccgtctccgttctacgtacgtcctaccgtagtccgttcggcggtaccgtaggacgtcccgtacccttacgtaccaacgttaccgtcccgtacccggtccctaacggtcgttagagggtaacgtggtagaccgttacgttagtaacctttaaccgttcgtacggtacggacggtacccggggttagggaaccttcggttacgtacgtaacggttccggtacgttaccgggtaccgggaaccggtaacgtaacggtcctaacccggggtcgtaccggtaccgaccgtacccggaaaccggtaccccaaaccccgtntacgtcctaacttccgttaccccgtacccc

SEQ ID NO: 53366 - DNA, 726 bp, Homo sapiens
  misc_feature: GYAE6OF01CU0K9.29.78.H01.1.454.CMB.1.raw
  modified_base (222)..(222): a, c, t, g, unknown or other
  misc_feature (222)..(222): n is a, c, g, or t
  modified_base (247)..(247): a, c, t, g, unknown or other
  misc_feature (247)..(247): n is a, c, g, or t
  modified_base (262)..(262): a, c, t, g, unknown or other
  misc_feature (262)..(262): n is a, c, g, or t
  modified_base (380)..(380): a, c, t, g, unknown or other
  misc_feature (380)..(380): n is a, c, g, or t
tcagatagagtactcacgaccggtgctcgatttagtgtgagtagtttgggtttggggtctgagagaggagtcccacccctgggatcttcaggtgttttcatttggtgatcaggacggaacagagagaactcaccatggagtttgggctgagcgtgtcgttttctgtggctaattttaaaaggtgtccagtgtgacgtgcaggttggtggagtcgtgggggcnccgtggggtacgggccgggggggtncgtgagctctcctgngcggcctgtggatttaagtttaggagtcatgaccatagaacgtcggggtcccgccgaggtcctccggaggggaacgggggctagggaggttgggtcctcggtacttagttaggtcggntaggtggtcggctatatattattatgacgagaccgcccgtgaacggggtccgttacacctatttccagacgacaattacgaaacgaacacgtctagtactctagtaacaaagtgggacgaacgtcctaggaacgtaccgtacggaaccgacgtacccggtacgtacgtttaatttagtttagggttagttaaaacgggagtaggtaccgttaagggggaaacccggtttaacccgggggggaaccccggggtaccccggtaaaccggtttacgggaaacccccggtacgggttaccgggggaacccgggaacggggggttaaccgcccggttaggggtacccccgg

SEQ ID NO: 53367 - DNA, 698 bp, Homo sapiens
  misc_feature: GYAE6OF01DVEL2.29.78.H01.1.454.CMB.1.raw
  modified_base (177)..(177): a, c, t, g, unknown or other
  misc_feature (177)..(177): n is a, c, g, or t
  modified_base (182)..(182): a, c, t, g, unknown or other
  misc_feature (182)..(182): n is a, c, g, or t
  modified_base (189)..(189): a, c, t, g, unknown or other
  misc_feature (189)..(189): n is a, c, g, or t
  modified_base (197)..(197): a, c, t, g, unknown or other
  misc_feature (197)..(197): n is a, c, g, or t
  modified_base (203)..(203): a, c, t, g, unknown or other
  misc_feature (203)..(203): n is a, c, g, or t
  modified_base (267)..(267): a, c, t, g, unknown or other
  misc_feature (267)..(267): n is a, c, g, or t
tcagatagagtactcacgaccggtgctcgatttagtgtgagtagtttgggtttgggggagagaggagtccacccctgggatcttcaggtgttttcatttggtgatcaggacggaacagagagaactcaccatggagtttgggctgagcggtgtgttctaggtcggctatttaaaggntcatntgatgcngtgtgatntgggcncgtggacggcgggggcgctgagctctcctgtgcggcctgtggatttaaagttttagggcgttanagtcgcgtagtacgtacgtcggtccgccgacggcgtaccggaggggacgggtacggtagggtaggtcgggttcgtcggtcgttagttaggtggtcgtaggtgggtcggtcgtacgtagttaattaattagtacgacgtacgaccgtccggtacggtacgggtaccggttaccgtaccgttacgttacgtaacgtacgtaacgtaacgtaacgtaaacgtaacgtacgtacgtacgtacgtacgtacgtaacgtaagtagtagtacgtacgtacgacgtacgtacgaccgacgtacgtacgttacgttacgttacgttacgttagttaacgtacgtacgtacgtacggtacggtaccgggtaccgggtaccggtacgtacggtaccgtacggtacgggacgggtacgggacggtcgtcggtccgtccgtccg

SEQ ID NO: 53368 - DNA, 601 bp, Homo sapiens
  misc_feature: GYAE6OF01BG6M7.29.78.H01.1.454.CMB.1.raw
  modified_base (600)..(600): a, c, t, g, unknown or other
  misc_feature (600)..(600): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccgggcccgacttcgaccacgtggggccagggggacgctgggtcaccgtctcctcacgcctccaccaagggcccatccggtccttcccccgtcggcccaccctccctccaacgacgccaccctcgtcggggccacgacgccacgcccgtcgggcctcgcccgttcggtcgaacggaccttaccgttccacgttacctaccttagtccgttaggacggccggggcgtcgggccgaaacgggccggacacgtaggcgng

SEQ ID NO: 53369 - DNA, 667 bp, Homo sapiens
  misc_feature: GYAE6OF01AFBUM.29.78.H01.1.454.CMB.1.raw
  modified_base (327)..(327): a, c, t, g, unknown or other
  misc_feature (327)..(327): n is a, c, g, or t
tcagatagagtactcacgaccggtgctcgatttagtgtgagtagtttgggtttggggtccgagccatggtgcagactccccagagctctcctcctcctccactgcacagggtctctctcccagcctgtgctgactcaatcgccctctgcctctgcctcccgtgggaggctcggtcaaggtcacctgtactctgagcagtggacacagcagctacgcatcgcttggcatcagcagaggccagacacgggcccttgttacttgatgacagtcaaacatgatggcagtcacgaggacggaagggggacggactccgtgactccgtcttcncgacgtctcagtcctcgtcggggcctgggacgcctaccgtaccctacactaaccgtcccgtacccggtccctccgtacggttccgtaggacggtacgtaggtacggtacttacggtacttagtttaccgtcggtacgacggtacccgggtacgggcgtaccgtcggtacgttacgtttacggtacggggttaccggttacccgggggtaacccgggtaaccggtacgggttacccgtacccgggttacggtcccgggtaccgacccggaccccgaaccgggaccccctaaacccccgtacgttccgtacccgtcccgttcccgttcccggttaccccccg

SEQ ID NO: 53370 - DNA, 581 bp, Homo sapiens
  misc_feature: GYAE6OF01BL37U.29.78.H01.1.454.CMB.1.raw
  modified_base (577)..(577): a, c, t, g, unknown or other
  misc_feature (577)..(577): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccgggccgacttgaccacgtgggggccagggggacgcgtggtcaccgtctcctcagcctccaccacgggcccatccggtcttccccctggccaccctcctccaagacgcacctcgtcggggcacgacgccacgcccgtgggcctcgtcccgtggtacaacgggtactaaccgttccgtaacgttacctactacgtcgtggacggcgggcgtggacgtaacggcgacagtagngtcg

SEQ ID NO: 53371 - DNA, 813 bp, Homo sapiens
  misc_feature: GYAE6OF01DQZI0.29.78.H01.1.454.CMB.1.raw
tcagatagagtactcacgaccggtgctcgatttagtgtgagtagtttgggtttggggtccgagccatggtgcagactccccagagctctcctcctcctccactgcacagggtctctctcccagcctgtgctgactcaatccgccctctgcctctgccctcccgtgggaggctcggtcaaggtcacctgtactctgagcagtggacacagcagctacgccatcgcttggcatcagcaggaggccagaccgacgggcccttcgttacttgatgacagtacaaacaatgagtggcagtcacgaggacgggaaaggggggaccggtacttcccgtagacgtccgtctttccgtcgtaacggttcctaccgaggtccgtttccggtacggggtcccttagggaccgtccgtacccttaacccctaacaaccgtaaaccgttcccgttccccggtcccttaccccgtaggtttaccgttacgggtaacgggtaacgtcgggacggtaccgttacggtaacctttaacgtttaaccgttacggtaccgtaacgggtacccgggtacggggtaccctaaccgggttcgggtaccgttacgtttaccgggttaaccgggtttaccggggttaccccggggggaaaccccgggggtaacccggtaaacggggttaccccgttaacccggggttcccgggttccggggtaacccgtaacccgggaccccccggtaaacccgggaaccccccgtaaaccccccggttaccgttacccgggttaaccccgttccccgtttcccggtttccccggttaccccccccg

SEQ ID NO: 53372 - DNA, 567 bp, Homo sapiens
  misc_feature: GYAE6OF01D407P.29.78.H01.1.454.CMB.1.raw
  modified_base (565)..(566): a, c, t, g, unknown or other
  misc_feature (565)..(566): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccggggcccgacttgaccacgtggggccagggggacgcgtggtcacccgtctccctcagcctccaccaacgggcccactccggtccttccccctggccacccctcctcccaagacgccacctcgtcggggcacgacgccagccccgtgggcctcgccgtggtccaacggactacttccacgtactctactctgaggcgggcgtggacgacggcacgatgnng

SEQ ID NO: 53373 - DNA, 513 bp, Homo sapiens
  misc_feature: GYAE6OF01D6TF8.29.78.H01.1.454.CMB.1.raw
  modified_base (502)..(502): a, c, t, g, unknown or other
  misc_feature (502)..(502): n is a, c, g, or t
tcagatagagtactcacgaccggtgctcgatttagtgtgagtagtttgggtttggggtccgagccatggtgcagactccccagagctctcctcctcctccactgcacagggtctctctcccagcctgtgctgactcaatcgccctctgcctctgcctccctgggaggctcggtcaaggtcacctgtactctgagcagtggacacagcagctacgccatcgcttggcatcagcagaggccagacacgggccctgttactgatgacagtcaacaatgatggcagtcacgagcgaagggggacggatcccgtgactcgcttctcagtctccagctcgtgggcctgacgcgctacctcaactactccgtcccggcctccgagtctggaggatggacggctagacttattactgtacagaccgtggggcacgtggctattcgaggtcgtcgggaccggacaggtccaccggtcgtcgtcacgcccaaggcccaacccgtctacgtcnctctcgtcccc

SEQ ID NO: 53374 - DNA, 595 bp, Homo sapiens
  misc_feature: GYAE6OF01D77QZ.29.78.H01.1.454.CMB.1.raw
  modified_base (388)..(388): a, c, t, g, unknown or other
  misc_feature (388)..(388): n is a, c, g, or t
  modified_base (594)..(595): a, c, t, g, unknown or other
  misc_feature (594)..(595): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaagggctggagtgggtctcggctattagtggcagtggtggcgctatatattatgcagacgccctgaagggccggttcaccatttccagagacaattcgaagaacacgctgtatctgacaaatggagagcctgagactcgacgacacggccgtctattattgtagttaaaggcgagctaggaactacggggaccggggcccgacgttcgaccacgtgggggccaggggacncgtggtcaccgtctcctcacgccctccgaaccgaacgggcccacgttccggtcccttcccccgtcggcccaccctccctaccaacgacgccacccgtcgtacggggccacgacgccacgcccgtcgggcgtcgtccgtggtaccaacggactaccgtcctacgtacctctactcgtgacggtcggcgtggacgaacggcagactgnn

SEQ ID NO: 53375 - DNA, 560 bp, Homo sapiens
  misc_feature: GYAE6OF01EL6ER.29.78.H01.1.454.CMB.1.raw
  modified_base (555)..(555): a, c, t, g, unknown or other
  misc_feature (555)..(555): n is a, c, g, or t
  modified_base (559)..(560): a, c, t, g, unknown or other
  misc_feature (559)..(560): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtgacagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccggggcccgacttcgaccacgtggggccagggggacgcgtggtcaccgtctcctcacgcctccaccaacgggcccactccggtcttcccccgtcggccaccctcctaccaacgacgccacctcgtcggggcacgacgcacgcccgtgggcctcgccgtggtcaacggacctacttccagtactctatctgaggcggcgtggcgaggcgnatgnn

SEQ ID NO: 53376 - DNA, 590 bp, Homo sapiens
  misc_feature: GYAE6OF01B065G.29.78.H01.1.454.CMB.1.raw
  modified_base (589)..(590): a, c, t, g, unknown or other
  misc_feature (589)..(590): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacggggaccggggcccgacttgaccacgtggggccagggggacgctggtcaccgtctcctcacgccctccaccgaacgggcccagtccggtccttccccccgtggcccacccctcctaccaacgacgccacctcgtcggggccacgacgccacggccccgtcggggcctcggtcccgtgggtaccaaggtacctaccttccacgttacctcctatccgtggacggcgggcgtggccgaagggcgacatgnn

SEQ ID NO: 53377 - DNA, 652 bp, Homo sapiens
  misc_feature: GYAE6OF01DWHYV.29.78.H01.1.454.CMB.1.raw
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcacctatttccagagacaattcgaaagaacacgctgtatctgacaaatggagagcctgacgactcgacgacacggccgtctattattgtagttaaaggcgagcgtaggaacgtaccggggaccggggcccgtacgttgaccacgtcggggccgaggggacgcgtggtctaccgtctcctcgacgccctacccaacgaaccgggcccacgtccggtcccttccccgtcggccctacccctccctaccgaacgacacctacccgtccggtcggggccacgacgccgacgcccgtgggcctcggtccgtacggtacgaacggtaccttacccgttaccgtaacgttacctaccgttacgtcgttacgggacgggtccgggtacgttcgggaccgtaaacgggcccgaacgtacgtgctag

SEQ ID NO: 53378 - DNA, 632 bp, Homo sapiens
  misc_feature: GYAE6OF01CIEKZ.29.78.H01.1.454.CMB.1.raw
  modified_base (629)..(629): a, c, t, g, unknown or other
  misc_feature (629)..(629): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattatgtgttaaaggcgagcgtggaatacgggaccgggcccgacttgaccacgtggggccagggggacgcgtcggtcaccgtctcctcacgccctcccaccgaacgggccccgacgtccggtccttccccccgtcggcccacccctccctaccaacgacgccaccgtcgtcgggggccacgacgccgacgcccgtgggccgtcgcccgtcggtcgaacgggtacctaaccgttccctacgttacctaccttacgtccgtggacggtccggggccgttcgggaccgtaaacgggcccgggaccgtaacgttaacgggnacg

SEQ ID NO: 53379 - DNA, 585 bp, Homo sapiens
  misc_feature: GYAE6OF01D5XCK.29.78.H01.1.454.CMB.1.raw
  modified_base (353)..(353): a, c, t, g, unknown or other
  misc_feature (353)..(353): n is a, c, g, or t
  modified_base (582)..(583): a, c, t, g, unknown or other
  misc_feature (582)..(583): n is a, c, g, or t
tcagatagagtactcacgaccggtgctcgatttagtgtgagtagtttgggtttggtggtctctctcccagcctgtgctgactcaatcgccctctgcctctgcctccctgggaggctcggtcaaggtcacctgtactctgagcagtggacacagcagctacgccatcgcttggcatcagcagaggccagacacgggccctgttacttgatgacagtcaacaatgatggcagtcacaggacgaaaggggggacggatcccgtgactcgcttctcagtcctccgagctcgtgggcctggacgcgctacctcacaatcctccggcctcagtctgaggatggagctagacttattacngtacagtccgtgggccacgtggactagttcgacgggttccgttacggggaaccgggtaacaacgggtccgaaccggttcggtccggtacaccggaccccgaacggaccccaaccccgtagtcggtaccctaccgttccgttaccgttcccccacccgttcctacgaacgttacctacgtacttccgtaggacggccgggtctcgggaccgaacgggtcgactagtacgnngc

SEQ ID NO: 53380 - DNA, 574 bp, Homo sapiens
  misc_feature: GYAE6OF01BNBG8.29.78.H01.1.454.CMB.1.raw
  modified_base (466)..(466): a, c, t, g, unknown or other
  misc_feature (466)..(466): n is a, c, g, or t
  modified_base (495)..(495): a, c, t, g, unknown or other
  misc_feature (495)..(495): n is a, c, g, or t
  modified_base (567)..(567): a, c, t, g, unknown or other
  misc_feature (567)..(567): n is a, c, g, or t
  modified_base (572)..(572): a, c, t, g, unknown or other
  misc_feature (572)..(572): n is a, c, g, or t
  modified_base (574)..(574): a, c, t, g, unknown or other
  misc_feature (574)..(574): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaaatggagagcctgagactcgacgacacggccgtctattatgtgttaaaggcgagctggaatacgggaccggggcccgacgttcgaccgacgtggggccgaggggacgctgggtccaccgtctcctcgacgccctccaaccaacgggcccactccggtccttccccctggcccaccctcctccaagacnccacctcgtggggccacgacgcacgcccngggcctcgtcctcggtacaaggcctacttccgatactctactcgtggaggtcgggcgtcggacgacggcganatagngn

SEQ ID NO: 53381 - DNA, 584 bp, Homo sapiens
  misc_feature: GYAE6OF01B7RIF.29.78.H01.1.454.CMB.1.raw
  modified_base (384)..(384): a, c, t, g, unknown or other
  misc_feature (384)..(384): n is a, c, g, or t
  modified_base (402)..(402): a, c, t, g, unknown or other
  misc_feature (402)..(402): n is a, c, g, or t
  modified_base (582)..(582): a, c, t, g, unknown or other
  misc_feature (582)..(582): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccgagggaaggggctggagtgggtctcggctattagtggcagtggtggcgctatatattatgcagacgccctgaagggccggttcaccatttccagagacaattcgaaagaacacgctgtatctgcaaatggagagcctagagactcgacgacacggccgtctattatgtagtaaaggcgagctggaagtacggggaccgggccgacgttgaccacgtggggccaggggacncgtggtccaccgtctccncgacgccctccgaccgaacgggcccacgtccggtccttcccccgtggaccctaccctcctaccaagacgccacctcgtcggggccacgacgcacgcccgtggctcgccgtgtacgaacggtactacgttcctagtacctactactcgtgacggcggcgtggacgtaacggcgacagtagngc

SEQ ID NO: 53382 - DNA, 578 bp, Homo sapiens
  misc_feature: GYAE6OF01AFVME.29.78.H01.1.454.CMB.1.raw
  modified_base (245)..(245): a, c, t, g, unknown or other
  misc_feature (245)..(245): n is a, c, g, or t
tcagatagagtactcacgaccggtgctcgatttagtgtgagtagtttgggtttggggtctgagagaggagtccacccctgggatcttcaggtgttttcatttggtgatcaggacggaacagagagaactcaccatggagtttgggctgagcgtgcgttttctaggtggctaattttaaaaggtgtccagtgtgacgtgcagttggtggagtcgtgggggcgccgtggggtacggccggggggtcncgtgagactctcctgtgcggcctctggattaagttttaggagtcatgccatgactggtccgcaggctcagggaaggggctggagtgggtctcgggctattagtggcaggtggtggcgactatatattatgcagacgccctggaacgggccgttcaccgtattccagagacaatcgaagaacacggctagtatcgtagcaaagtgagagcctgagactcgacgacacggccgtactattattgtagttaaagccgagtcgtaggaacgtccggggacccgggccgtacgttcggaacccgcgtacgggggcctaaggggacctcgtggtacccg

SEQ ID NO: 53383 - DNA, 677 bp, Homo sapiens
  misc_feature: GYAE6OF01CFDN0.29.78.H01.1.454.CMB.1.raw
  modified_base (676)..(676): a, c, t, g, unknown or other
  misc_feature (676)..(676): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgccaggctccgagggaaggggctggagtgggtctcggctattagtggcagtggtggcgctatatattatgcagacgccctgaagggccgttcacctatttccagagacaattcgaagaacacgctgtatctgacaaagtggagagcctgagactcgacgacacggccgtcttattattgtagttaaaggcgagtcgtaggaacgtaccggggacccggggacccgtacgttcggaacccgacggtcgggggaccgagggggaccgtcgttcgggtaccaccggttcctccctacgaccggtcccctacccgaacccgtaacgggcccctacgtcccggttcccttccccccgtggcccctacccctcccgtacccaacgaccgcccaaccgtccggtcggggaccacgacgaccgacgccccgtgggacctcggccgtcggtaccgaacggtaccttaccgttaccgtacgttaccttactacgttccgtaggacggtcgggtccgtacggacgacgggccgacgtacgtggnc

SEQ ID NO: 53384 - DNA, 606 bp, Homo sapiens
  misc_feature: GYAE6OF01EG9WD.29.78.H01.1.454.CMB.1.raw
  modified_base (598)..(598): a, c, t, g, unknown or other
  misc_feature (598)..(598): n is a, c, g, or t
  modified_base (604)..(604): a, c, t, g, unknown or other
  misc_feature (604)..(604): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgacaaatggagagcctgagactcgacgacacggccgtctatttattgtgttaaaggcgagctggaagtacggggaccggggcccgacttcgaccacgtggggccgagggggacgcgtggtcacccgtctccctcgacgccctccaccgaacgggcccacgtccggtccttccccccgtcggcccaccccttccctacccgaacgacgccacccgtcgtcgggggtaccacacgcacgcccgtcgggcctcggtccgtcggtacaacggtaccttacgtccagttacctacttagtcgtgacggcggcgtcggacgaacggcganactagngc

SEQ ID NO: 53385 - DNA, 170 bp, Homo sapiens
  misc_feature: GYAE6OF01E1SMJ.29.78.H01.1.454.CMB.1.raw
  modified_base (168)..(170): a, c, t, g, unknown or other
  misc_feature (168)..(170): n is a, c, g, or t
tcagatagagtactcacgaccggtgctcgatttagtgtgagtagtttgggtttgggggtctccactcccgccttgacggggctgccatcagcccaaggccaaccccactgtcactctgttcccgccctcctcagtactctatctgagcgggctggcaaggcgcatagnnn

SEQ ID NO: 53386 - DNA, 590 bp, Homo sapiens
  misc_feature: GYAE6OF01A1N2O.29.78.H01.1.454.CMB.1.raw
  modified_base (590)..(590): a, c, t, g, unknown or other
  misc_feature (590)..(590): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtagttaaaggcgagctggaatacggggaccggggcccgacgttcgaccacgtggggccaggggacgctggtcaccgtctcctcacgcctccaccacgggcccagtccggtccttcccccgtcgccaccctccctccaagacgcaccctcgtcggggcacgacgccacgcccgtgggcctcgtccgtacggtcgaacgggtacctaccgttacctacgttacctcgttacgtccgtggacggcgggccgtggacgaacggcgacgagtgctn

SEQ ID NO: 53387 - DNA, 638 bp, Homo sapiens
  misc_feature: GYAE6OF01DBMV0.29.78.H01.1.454.CMB.1.raw
  modified_base (636)..(636): a, c, t, g, unknown or other
  misc_feature (636)..(636): n is a, c, g, or t
tcagatagagtactcacgaccggtgctcgatttagtgtgagtagtttggggtttgggggcgcctgggtacggccggggggtcgctgagactctcctgtcgcggcctctggatttaagttttaggagtcatgccatgaactgggtccgccaggctccgagggaagggctggagtgggtctcggctattagtggcagtggtggcgtctatagtattatgcagacgccctgaagggccggttcaccatttccagagacaattcgaagaacacgctgtatctgacaaatggagacgcctgagactcgacgacacggccgtctattattgtagttaaaggcgagcgtagggaacgtaccggggacccggggacccgacgttcggaaccgacggtcggggggcccgaaggggggacgtcgtggtccacccggtcctcctcacgccctacccaccgaacggcccacgtccggtccttcccccgtcggtccctaccctcctacctaacgacgtcctaccgtcgtcggggccacgacgccacgcccgtcgggccgtcggtccgtcggtacgaacggtacctaccgttaccgtacgtaccttactacgtcgtggacggtcggcgtcggacgtacggacgatactgntc

SEQ ID NO: 53388 - DNA, 626 bp, Homo sapiens
  misc_feature: GYAE6OF01AZDGM.29.78.H01.1.454.CMB.1.raw
  modified_base (622)..(622): a, c, t, g, unknown or other
  misc_feature (622)..(622): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattatgtgttaaaggcgagctggaatacgggaccgggcccgacttcgaccacgtggggccaggggacgctggtcaccgtctcctcacgccctccaccgaaggcccacgtccggtcctcccccgtcggcccaccctccctcccaacgacgccaccctccgtcgggggccaccgacgccgacgcccgtcggggccgtcggcccgtcgggtaccgaaacgggtaccttaaccgttccctacgttaccttaccttacgttccgtacggacgggtccggggtccgttcgggaccgaacgggccgacaacgttagngtag

SEQ ID NO: 53389 - DNA, 705 bp, Homo sapiens
  misc_feature: GYAE6OF01BVS0H.29.78.H01.1.454.CMB.1.raw
  modified_base (702)..(702): a, c, t, g, unknown or other
  misc_feature (702)..(702): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacgacggccgtctattattgtagttaaaggcgagctggaatacgggaccgggcccgacttgaccacgtgggccgaggggacgcgtggtcaccgtctcctcgacgtccctccacccgaacgggccccaagtcccggtccctttacccccccgtcgggcccctaacccccgttcccctaccccgtaaaggtaccgacccgtaaccccgttcggttacggggggacccaaccgacggcccgaaccggcccccgttgggggaccccgttcggaccccgttacgggttaccaaaccgggtacccttaacccgttaccgaacggtttaacccttcgttaactccgtaggtaacggtccgggggaccgtttacggggaacccgtaacggggacccgacctaacgtaacgngcg

SEQ ID NO: 53390 - DNA, 660 bp, Homo sapiens
  misc_feature: GYAE6OF01CLE66.29.78.H01.1.454.CMB.1.raw
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaggcgagctggaagtacgggaccgggcccgattcgaccacgtggggaccaggggacgcgtggtcaccgtctccgtcacgccctaccaccgaacgggcccacgtccggttcccttacccccgtggccctacccctcccgtccaaacggacgtcccgaacccgttccggtacggggccaccgacgccgacggtccccgtaggggtccctacgcccgttaggtaccgaaacgggtaccttaacccgtttcccgacgttaacccgttcgttaacgttccgttagggaacggtcccggggtacgttacgggaccgtaaacggggccgactaacgtcggatcg

SEQ ID NO: 53391 - DNA, 562 bp, Homo sapiens
  misc_feature: GYAE6OF01CBFRT.29.78.H01.1.454.CMB.1.raw
  modified_base (561)..(562): a, c, t, g, unknown or other
  misc_feature (561)..(562): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaaatggagagcctgagactcgacgacacggccgtctattattgtagttaaagcgagctggaatacgggaccggggccgaacttgaccacgtggggccagggggacgcgtggtcaccggtctccctcacgccctccaccgaacggcccatccggtccttccccctgggcctacccctcctccaacgacgcaccctcgtcgggcacagccacgcccgtgggcctcggcctggtcaacggctaccgtccagtacctctatctgacggcggctggcgtaacgcgcatgnn

SEQ ID NO: 53392 - DNA, 918 bp, Homo sapiens
  misc_feature: GYAE6OF01D44RE.29.78.H01.1.454.CMB.1.raw
  modified_base (917)..(917): a, c, t, g, unknown or other
  misc_feature (917)..(917): n is a, c, g, or t
tcagatagagtactcacgaccggtgctcgatttagtgtgagtagtttgggtttgggggcgcctggggtacggccggggggggtcgctggagactctctgtgcggcctctggtatttaagtttaggagtcatcgccatagaacgtcggggtcccgaccgaggtcctccggagggggaacggggcgtgggaggtcgggttcgtcggtcttagttaggtcggcgtaggtgggtgggcgtctaattattattagtgcgagaccgtcccgtagggaacggggtcccggttaccaaccttacttttaccgaaggaacgaacctaaacgtttacggaaacgaaaccgaccgtcttaggttacttctacggaactaaaggtgggaaggacgtccgtaggaacgtaccgtaccggaaccgaaccggacccgggtccgttacttaagtttacgtttaggttaagggttaaacgggcggtaggtcggtaagggtaaaccggtacccggggggaccccggggtacccgtacgttaccggaacccgtacggggtccgggggaccgggaacggggggaccgtcgggttcgggtacccgtacccggttcctcccctacgaccggtccccgtacccgaacccgggaaccgggcccctaacggtttccccggttcccccgtttcccccggtcggtaccccctaccccgttaccctacccggaaacggtccgacccgtacccgttcggggtaccgggggacccaacggtacgaccgaccggtccccgggttcggggtccgttccggtcccggttacgggtaaccgtaaccggttacccttacccgttaccgaacggtttacccttacgttacgttcggtacgggacgggtccgggtaccgtcgggaaccggtacgggaccgacgtaaggtacggnc

SEQ ID NO: 53393 - DNA, 550 bp, Homo sapiens
  misc_feature: GYAE6OF01CPYOH.29.78.H01.1.454.CMB.1.raw
  modified_base (385)..(385): a, c, t, g, unknown or other
  misc_feature (385)..(385): n is a, c, g, or t
  modified_base (544)..(544): a, c, t, g, unknown or other
  misc_feature (544)..(544): n is a, c, g, or t
  modified_base (549)..(550): a, c, t, g, unknown or other
  misc_feature (549)..(550): n is a, c, g, or t
tcagatagagtactcacgaccggtgctcgatttagtgtgagtagtttgggtttgggggcgcctgggtacggccgggggggtcggctgagactctcctgtgcggcctctggattaagttttaggagtcatgccatgaactgggtccgctaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaaatacggggaccggggcccgacttgaccactgggggccagggggacnctggtcaccgtctcctcagcctccacagggcccatcgtccttccccctggccaccctcctcccaagacgcacctcgtcggggcacacgcacgccctcgggctcgcctggtcaaggactacttccagtactctatctgaggcgggctggcgaacggcganatagnn

SEQ ID NO: 53394 - DNA, 658 bp, Homo sapiens
  misc_feature: GYAE6OF01EF6AP.29.78.H01.1.454.CMB.1.raw
  modified_base (459)..(459): a, c, t, g, unknown or other
  misc_feature (459)..(459): n is a, c, g, or t
tcagatagagtactcacgaccggtgctcgatttagtgtgagtagtttgggtttggggtctgagagaggagtccacccctgggatcttcaggttgttttcatttggtgatcaggacggaacagagagaactcaccatggaggtttgggctgagctggtctttttcttgtggcttaattttaaaaggtgtccagtgtgacgtgcagttggtggagtcgtggggggcgccgtggggtaccgggccgggggggtcgctgagactctcctgtgcggcctcgtggtatttaagttttaggagtcatgccatgaacgtggttccgccaggcctccgaggggaaggggcgtgggaggtcggggtctcgggcttagttaggtggctaggtgggtggcgtctattatattatgacagccgcccgtaggaacggggtccgttcacctatttccgagagacaattcgaaanaacacgtctgtatctagactaaagtggagacgcctagacgactaccggacgaccgaccggtccgttattaactttagttggttaggttaaacggccgagtccggtaggtaacggtacccgggggacccggggaccctacggttaccgaacccgtacgggttacgggggacccgtaagggggccgtcgtcgggtaccccg

SEQ ID NO: 53395 - DNA, 613 bp, Homo sapiens
  misc_feature: GYAE6OF01BI9UM.29.78.H01.1.454.CMB.1.raw
  modified_base (609)..(609): a, c, t, g, unknown or other
  misc_feature (609)..(609): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtagttaaaggcgagcgtggaagtacgggaccggggcccgacttcgaccacgtggggccgagggggacgcgtggtcaccgtctcctcacgcctccaccgacgggcccacgtcggtccttccccccgtggcccaccctccctccaacgacgccaccctcgtcggggcacgacgcacggcccgtcgggcctcggcccgttcgggtacgaacgggaccttaaccgttcccgtaacgttacctcgttacgtcggtgacggtcgggcgtcgggaccgtaacggcggacctagtagngtac

SEQ ID NO: 53396 - DNA, 519 bp, Homo sapiens
  misc_feature: GYAE6OF01CUXV1.29.78.H01.1.454.CMB.1.raw
  modified_base (344)..(344): a, c, t, g, unknown or other
  misc_feature (344)..(344): n is a, c, g, or t
  modified_base (510)..(510): a, c, t, g, unknown or other
  misc_feature (510)..(510): n is a, c, g, or t
  modified_base (516)..(516): a, c, t, g, unknown or other
  misc_feature (516)..(516): n is a, c, g, or t
tcagatagagtactcacgaccggtgctcgatttagtgtgagtagtttgggtttggtggtctctctcccagcctgtgctgactcaatcgccctctgcctctgcctccctgggagctcggtcaaggtcacctgtactctgagcagtggacacagcagctacgccatcgcttggcatcagcagaggccagacacgggcctcgttactgatgacagtcaacaatgatggcagtcacagcgaagggggccggatccctgatcgcttctcagtctccagctcgtgggcctggacgccgtctacctcaactaatcctccggcctcagtctgagatgaggctgactattacngcacgacgtgggcacgtggctagttcgaggttcccttacgggaccggaacctagggtccacggtcgtaccggcaccgacccgaaggccccaaccgactgtactaccgtctccgtccccgcctctcacgtctctagtcgtagcgcgggtctgggccaaaggcccganaagtgnatg

SEQ ID NO: 53397 - DNA, 591 bp, Homo sapiens
  misc_feature: GYAE6OF01CD85V.29.78.H01.1.454.CMB.1.raw
  modified_base (345)..(345): a, c, t, g, unknown or other
  misc_feature (345)..(345): n is a, c, g, or t
  modified_base (382)..(382): a, c, t, g, unknown or other
  misc_feature (382)..(382): n is a, c, g, or t
tcagatagagtactcacgaccggtgctcgatttagtgtgagtagtttggggtttggggagagctctggggagtctgcaccatggctcggaccccactcctcttcctcaccctcctcctccactgcacagggtctctctcccagcctgtgctgactcaatcgccctctgcctctgcctccctgggagctcggtcaaggtcacctgtactctgagcagtggacacagcagctacgccatcgcttggcatcagcaggaggccagaccgacgggcctcgttacttgatgacagtcaacaatgatggcagtcaacgaggacgaagggggcgactcccgtgactcgcttcncacgtctcagtctcgtcgggcctgacgccgcttaccncacaactccgtccggcctaccaggttctaggacggtatcggaggtcgttacgaacttacgttctacggtacacggtaccggtggggacctacggtggacgttacttacggaggttccgttaccggggacccgggtaacctaacgggtcccaacccgggttccggtaccggtacaaccggtaccccgaaaccggcccctaaccccgtacg

SEQ ID NO: 53398 - DNA, 606 bp, Homo sapiens
  misc_feature: GYAE6OF01DSTAW.29.78.H01.1.454.CMB.1.raw
  modified_base (601)..(601): a, c, t, g, unknown or other
  misc_feature (601)..(601): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctatttattgtagttaaaggcgagctaggaatacgggaccgggccgtacttgaccacgtggggccgaggggcgcgtggtcaccgtctcctcacgcctaccaaccgaacggcccacgtccggtcccttcccccgtggcccctacccgtccctccaacgacgccaccgtcgtcggggccaacgcgcacggcccgtcggctcgccgtcgtacaacggtacctaccgttcctagttaccttctaacgttcgtaggacggtccgggacttcgggaccgtaacgggcgacacgtagngtacg

SEQ ID NO: 53399 - DNA, 659 bp, Homo sapiens
  misc_feature: GYAE6OF01C94SL.29.78.H01.1.454.CMB.1.raw
  modified_base (657)..(657): a, c, t, g, unknown or other
  misc_feature (657)..(657): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgacaaatggagagcctgagactcgacgacacggccgtctattattgtagttaaaggcgagctagggaatacggggacccggggcccgacgttcgaccacgtcgggggccagggggacgcgtggtcacccgtctcctcacgccctccaccgaacgggccctactccgggtcccttcccccgtcgggccctacccctccctaccgaacgacgccaacccgttccggcgggggtccacgacgccacggtccccgtggggcctcggtcccgtgggtaccgaaacgggtaccttaaccgttcccgtaacgttaccttacctacgttccgtaggtacgggtcccgggggtaccttaggggaccgtaacggggaccgactaacgtacggncg

SEQ ID NO: 53400 - DNA, 689 bp, Homo sapiens
  misc_feature: GYAE6OF01BPXEI.29.78.H01.1.454.CMB.1.raw
  modified_base (215)..(215): a, c, t, g, unknown or other
  misc_feature (215)..(215): n is a, c, g, or t
  modified_base (239)..(239): a, c, t, g, unknown or other
  misc_feature (239)..(239): n is a, c, g, or t
tcagatagagtactcacgaccggtgctcgatttagtgtgagtagtttgggtttgggggagagaggagtccacccctgggatcttcaggtgttttcatttggtgatcaggacggaacagagagaactcaccatggagtttgggctgagctggctttttcttgtggctattttaaaaggtgtccagtgtgacgtgcagttggtggagtctgggggcnccgtgggtacggccgggggggtcnctgagactctcctgtgcggcctctggatttaagtttaggagtcatgccatgaactgggtccgccaggctccgagggaaggggctggaggtgggtcgtcggcgttagttaggtggctaggtgggtggcgctatattattatgcacgaccgcccgtaggaacgggtccgttaccacctatttaccgagacgaactaacgttacggaaacgaaccgacgtactagtactctcggtaactaaagttgggaagacgccgtagagacgtacggaacgaccgacggcccgttacgttaagtttagtttggttaagttaaacggacggtaacggtacgtagggaaacggtaaccggggggaacccgggtaccccggtaacggttaccggaccgaaccgggttcggggaacccggtaacgggggaccgtaccgggttacggtcccgaacccggttcccg

SEQ ID NO: 53401 - DNA, 645 bp, Homo sapiens
  misc_feature: GYAE6OF01DBMPT.29.78.H01.1.454.CMB.1.raw
  modified_base (638)..(638): a, c, t, g, unknown or other
  misc_feature (638)..(638): n is a, c, g, or t
tcagatagagtactcacgaccggtgctcgatttagtgtgagtagtttgggtttgggtggtctctctcccagcctgtgctgactcaatcgccctctgccctctgcctccctgggaggctcggtcaaggtcacctgtactctgagcagtggacacagcagctacgccatcgcttggcatcagcagagccagacacgggccctgtactgactgacagtcaaacgaatgatggacagtcaacagcgaaagggggacggatccctgatcgcttctcagtcctccaagctcgtggcctgagcgctacctcacaatctaccggcctcagtctagaggactggaggctagtactagttactagttagaccgttgggactacgtggactagtttcgaggtccttacgggaccggggaactaacgggttccaacccggttcggttacggtaccaacggtaccccgtaaaggtccccctaaaccccgtcgtacgtcctaaccgttccgttccggttaccccccgcccctttacccgttaccgtaacgttaacccgttccgtaaacgttcccggtaggtaaacccgggtccggggtacccgttacggggaacccgtaaacggggtcccggaacctaaacgttaggaaccncgtgtac

SEQ ID NO: 53402 - DNA, 613 bp, Homo sapiens
  misc_feature: GYAE6OF01BL628.29.78.H01.1.454.CMB.1.raw
  modified_base (612)..(612): a, c, t, g, unknown or other
  misc_feature (612)..(612): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctaggaagtaccggggaccggggcccgacgttcgaccacgtggggccagggggacgcgtggtccaccgtctcctcacgccctccgaaccgacgggcccacgtccggtccttcccccgtggcccaccctccctccaacgacgccacccgtcgtcggggccacgacgccgacggtcccgtggggcctcggtcccgttgggtaccgaacgggtaccttaccgttccacgttacctccttactcgtagacgggcgggtcgtgggacgaacgggcgacacgtagnc

SEQ ID NO: 53403 - DNA, 598 bp, Homo sapiens
  misc_feature: GYAE6OF01A9CP0.29.78.H01.1.454.CMB.1.raw
  modified_base (414)..(414): a, c, t, g, unknown or other
  misc_feature (414)..(414): n is a, c, g, or t
  modified_base (593)..(593): a, c, t, g, unknown or other
  misc_feature (593)..(593): n is a, c, g, or t
  modified_base (597)..(598): a, c, t, g, unknown or other
  misc_feature (597)..(598): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgacaaatggagagcctgagactcgacgacacggccgtctattattgtagttaaaggcgagcgtaggaagtaccggggacccggggccgacgttcgaccgacgtcggggaccgagggggacgcgtcggtccaccgtctccncacgccctccaaccgaacgggcccacgtccggtccttcccccgtcggcccacccctcctaccaacgacgcctacccgtccgtcggggccacgacgcacgcccgtggcctcgccgtggtacgaacggtacctctccgacgtacctctactcgtggacggccgggcgtggacgacggcganatgnn

SEQ ID NO: 53404 - DNA, 761 bp, Homo sapiens
  misc_feature: GYAE6OF01C208O.29.78.H01.1.454.CMB.1.raw
tcagatagagtactcacgaccggtgctcgatttagtgtgagtagtttgggtttggagtctgcaccatggctcggaccccactcctcttcctcaccctcctcctccactgcacagggtctctctcccagcctgtgctgactcaatcgccctctgcctctgcctccctgggaggctcggtcaaggtcacctgtactctgagcagtggacacagcagctacgccatcgcttggcatcagcagaggccagacacgggccctgttactgatgacagtcaacaatgatggcagtcacgaggcgaaagggggacggatcccgtagactcgctttctcacgtctccagtccttcgtcgggccctggacgtccgtaccttaaccctcaacctaacttcccgtccccgggtacccttcccgtaaggttcccgttagggaacggggtaacttcggggaacgggtcctttacggtaacctttaacgttttaaccgttggttacccgaacgggttaccccggttggggggaacccttaaccggttcggggaccttaacgttttacccggtaacgggggttttccccggtttaacccggggggaaacccccggggggttaaaccctaaaccgggggttccccgtaaaccccggggtttccgggttaccccggggttacccgaacccgggtaacccccccggaaacggggtacccccctaaaaccccccgttacggtttaccgtaccccgtaacccgtttcccgtttaacccccgg

SEQ ID NO: 53405 - DNA, 520 bp, Homo sapiens
  misc_feature: GYAE6OF01A24XD.29.78.H01.1.454.CMB.1.raw
  modified_base (319)..(319): a, c, t, g, unknown or other
  misc_feature (319)..(319): n is a, c, g, or t
  modified_base (502)..(502): a, c, t, g, unknown or other
  misc_feature (502)..(502): n is a, c, g, or t
  modified_base (507)..(507): a, c, t, g, unknown or other
  misc_feature (507)..(507): n is a, c, g, or t
tcagatagagtactcacgaccggtgctcgatttagtgtgagtagtttgggtttggggtccgagccatggtgcagactccccagagctctcctcctcctccactgcacagggtctctctcccagcctgtgctgactcaatcgccctctgcctctgcctccctgggaggctcggtcaaggtcacctgtactctgagcagtggacacagcagctacgccatcgcttggcatcagcagaggccagacacgggccctgttacttgatgacagtcaacatgatggcagtcacaggcgaagggggacggatcccgtgatcgcttcncagtctccagctcgtcgggcctgacgcgcctacctcacactcctccggcctccagtctaggaggatgaggctagacttattactgtacaggaccgtggggaccacgtggactagttcgaggttccgtacgggaccgggacacggtccgaccggtcgtcggacacggcccgaagccccaccctntcgcncttctcgtacccc

SEQ ID NO: 53406 - DNA, 616 bp, Homo sapiens
  misc_feature: GYAE6OF01DBZEX.29.78.H01.1.454.CMB.1.raw
  modified_base (613)..(613): a, c, t, g, unknown or other
  misc_feature (613)..(613): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgacaaatggagagcctgagactcgacgacacggccgtctattattgtgttaaaggcgagcgtaggaagtacgggaccggggccgacgttgaccacgtggggccgagggggacgcgtggtccaccgtctcctcacgcctccaccaacgggcccacgtccggtccttcccccgcggccctaccctccctcccaacgacgcctacccgtcgtcggggccacgacgccacgccccgtgggcctcgccgtcggtcgaacgggtaccttaccgttaccgtacgttacctccttaactccgtaggacggtccggggcttgggaccgaacgggccgacaacgtaggnacg

SEQ ID NO: 53407 - DNA, 608 bp, Homo sapiens
  misc_feature: GYAE6OF01AFYM1.29.78.H01.1.454.CMB.1.raw
  modified_base (606)..(606): a, c, t, g, unknown or other
  misc_feature (606)..(606): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaggcgagctggaatacgggaccgggcccgacttgaccacgtggggccaggggacgctggtcaccgtctcctcacgccctccaccgaacgggcccagtccggtccttcccccctcggcccaccctccctcccaagacgccaccctcgtcggggccacgacgccgacgccccgtggggcctcggtcccgtcgggtaccgaacgggtaccttaaccgttcccacgttaccctcttacgttccgtggacggccggggccgtgggaccgaacgggcgaccgagtggncg

SEQ ID NO: 53408 - DNA, 552 bp, Homo sapiens
  misc_feature: GYAE6OF01DZDZY.29.78.H01.1.454.CMB.1.raw
  modified_base (379)..(379): a, c, t, g, unknown or other
  misc_feature (379)..(379): n is a, c, g, or t
  modified_base (550)..(551): a, c, t, g, unknown or other
  misc_feature (550)..(551): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaagggctggagtgggtctcggctattagtggcagtggtggcgctatatattatgcagacgccctgaagggccgttcaccatttccagagacaattcgaaagaacacgctgtatctgcaaaatggagagcctgagactcgacgacacggccgtctattattgtagttaaagcgagctggaatacgggaccgggcccacttgaccacgtggggccaggggacncgtggtcaccgtctcctcagcctccaccgaacggcccatcggtccttccccctcggccaccctcctaccaagacgcacctcgtcggggcacgagcacgcccgtggctgccgtggtacaacggactaccgttcacgtactactatctgagcgggctggacaacggcagatgnng

SEQ ID NO: 53409 - DNA, 561 bp, Homo sapiens
  misc_feature: GYAE6OF01D5QRP.29.78.H01.1.454.CMB.1.raw
  modified_base (560)..(561): a, c, t, g, unknown or other
  misc_feature (560)..(561): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccggggcccgacttgaccacgtggggccaggggacgctggtcaccgtctcctcacgccctccaccgaacgggcccatccggtccttccccctcggccaccctccctccaacgacgccacctcgtcggggcacgacgcacgccctgggctcgcctggtcgaaggacctacttccagtacctctactctgaggcgggctggacgacggcgacatagnn

SEQ ID NO: 53410 - DNA, 595 bp, Homo sapiens
  misc_feature: GYAE6OF01EXH17.29.78.H01.1.454.CMB.1.raw
  modified_base (593)..(593): a, c, t, g, unknown or other
  misc_feature (593)..(593): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccggggcccgacttgaccacgtggggccagggggacgctggtcaccgtctccctcacgcctccaccgaacgggcccatccggtccttccccctggcccaccctcctccaagacgcacccgtcgtcggggccacgacgcacgcccgtcgggcctcggcccgttgggtaccaacgggtaccttacccgttccaacggttaccttaccttacttcctggacggcgggccgtcggacgacggcgacagtagncg

SEQ ID NO: 53411 - DNA, 665 bp, Homo sapiens
  misc_feature: GYAE6OF01CC0U3.29.78.H01.1.454.CMB.1.raw
  modified_base (664)..(665): a, c, t, g, unknown or other
  misc_feature (664)..(665): n is a, c, g, or t
tcagatagagtactcacgaccggtgctcgatttagtgtgagtagtttgggtttgggggcgcctgggtacggccgggggggtcgctgagactctcctgtgcggcctctggatttaagttttaggagtcatgccatgaactgggtccgccaggctccagggaaggggctggagtgggtctcggctattagtgcagtggtggcgctatatattatgcagacgccctgaagggccgttcaccatttccagagacaattcgaaagaacacgctgtatctgacaaatggagagcctgagactcgacgacacggccgtctattatgtagtaaaggcgagcgtagaagtacggggacccgggccgtacttcgaccacgtcggggaccgagggggacgcgtggtccgacccgttctccctcgacgtccctccaaccgtaacgggcccacgttccggttccctttccccccgttcggcccctaccccgtaccctacccgaaacgacgaccctacccgtccggtcggggaccaaccgacgaccgaccggccccgtcgggccgtcggcccgttacgggtaccgaacgggtacccttaaccgttacccgtacggttaccttacctacgttccgttaggacggtcgggccgttggaccggaacggcgacacgtacggnn

SEQ ID NO: 53412 - DNA, 621 bp, Homo sapiens
  misc_feature: GYAE6OF01EU0PH.29.78.H01.1.454.CMB.1.raw
  modified_base (614)..(614): a, c, t, g, unknown or other
  misc_feature (614)..(614): n is a, c, g, or t
  modified_base (620)..(621): a, c, t, g, unknown or other
  misc_feature (620)..(621): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccaggggaaggggctggagtgggtctcggctattagtggcagtggtggcgctatatattatgcagacgccctgaagggccggttcaccatttccagagacaattcgaagaacacgctgtatctgacaaatggagagcctgagactcggacgacaccgggccgtctattattggtaggttaaaaggcgagcgtagggaacgtacggggacccggggcccgtacgttcgaccgacgtgggggcccgagggggacgcgtggtccaccgtctcctcacgccctaccaccgaacgggcccacgtccggtccttcccccgtgggcccacccctcctacccaacgacgccaccgtcggcgggggaccacgacgcacgcccgtgggcctcggcccgttcggcaacggtacctaccttccgacgttactacctagtcgtaggacggcgggacgtgggacgtaagggccganagtagnn

SEQ ID NO: 53413 - DNA, 586 bp, Homo sapiens
  misc_feature: GYAE6OF01A70U4.29.78.H01.1.454.CMB.1.raw
  modified_base (584)..(584): a, c, t, g, unknown or other
  misc_feature (584)..(584): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccgttcaccatttccagagacaattcgaagaacacgctgtatctgcaaatggagagcctgagactcgacgacacggccgtctattatgtgttaaaggcgagctggaataccggggaccggggcccgacttcgaccacgtggggccgaggggacgcgtggtcaccgtctcctcagcctccaccaacgggcccagtccggtccttcccccgtcggcccaccctccctaccgaacgacgcaccctccgtcgggggccacgacgccacgcccgtcgggcgtcgcccgtcggtacaacggaccttacctcctacgtacctactacgtctgacggcggcgtcggacgacggccgacagtgngc

SEQ ID NO: 53414 - DNA, 650 bp, Homo sapiens
  misc_feature: GYAE6OF01A3WQ1.29.78.H01.1.454.CMB.1.raw
  modified_base (646)..(646): a, c, t, g, unknown or other
  misc_feature (646)..(646): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgacaaatggagagcctgagactcgacgacacggccgtctattattgtagttaaaggcgagctggaataccgggaccggggcccgacttcgaccacgtggggccaggggacgctggtcaccgtctcctcacgcctccaccgaacgggcccacgttcccggtaccttcccccgtcgggtcccaccccgttccctaccaaacggacgaccctaacccgtccgtcgggggaccacgacgcgacgcccgtcgggcctcggtccgtacggtccgaaacgggtaccttaaccgttcccgtaacgttacctaccgttaacgttcgtacggaacggtccgggggtacgtacgggacgtaaacgggccggacacgttaagggntacg

SEQ ID NO: 53415 - DNA, 618 bp, Homo sapiens
  misc_feature: GYAE6OF01DP1GQ.29.78.H01.1.454.CMB.1.raw
  modified_base (616)..(616): a, c, t, g, unknown or other
  misc_feature (616)..(616): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgacaaatggagagcctgagactcgacgacacggccgtctattattgtagttaaaggcgagctaggaagtacggggacccgggcccgacttcgaccacgtggggccaggggacgcgtggtcaccgtctcctcacgccctccgaaccgaacgggcccacgtccggtcccttcccccgtcggccctacccctccctaccaacgacgcctacccgtccgtcgggggaccacgacgccgacgcccgtcgggccgtcggtccgtcggtacgaacggtaccttaccttccgtacgtaccttctacgttcgtggacggccgggccgtggaccgtacgggacgacagtagncg

SEQ ID NO: 53416 - DNA, 554 bp, Homo sapiens
  misc_feature: GYAE6OF01BPABE.29.78.H01.1.454.CMB.1.raw
  modified_base (533)..(533): a, c, t, g, unknown or other
  misc_feature (533)..(533): n is a, c, g, or t
  modified_base (549)..(549): a, c, t, g, unknown or other
  misc_feature (549)..(549): n is a, c, g, or t
  modified_base (553)..(554): a, c, t, g, unknown or other
  misc_feature (553)..(554): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccggggcccgacttgaccactggggccagggggacgctggtcaccgtctcctcagccctccaccaacgggcccatccggtccttccccctcggccaccctcctccaacgacgcaccctcgtcgggggccacagcacgcccgtcgggctcgccgtggtcaacggactacttccacgtacctctatctgngcgggctggcaggcgnatgnn

SEQ ID NO: 53417 - DNA, 639 bp, Homo sapiens
  misc_feature: GYAE6OF01D9VXX.29.78.H01.1.454.CMB.1.raw
  modified_base (238)..(238): a, c, t, g, unknown or other
  misc_feature (238)..(238): n is a, c, g, or t
tcagatagagtactcacgaccggtgctcgatttagtgtgagtagtttgggtttggggtccgagccatggtgcagactccccagagctctcctcctcctccactgcacagggtctctctcccagcctgtgctgactcaatcgccctctgcctctcgccctcccgtgggaggctcggtcaaggtcacctgtactctgagcagtggacacagcagctacgccatcgcttggcatcagcagnggccagacgaccgggccctcgttacttgatgacagtcaacaatgatggcagtcacgagcggaagggggacgactccgtgacgttcgcctttcacgacgttcctccgagtcctcggtcgggtcctgacgccgtacctaccctcaactacgtcccgtcccggtaccctcgacgttcgagggtacggagtcggacggtctacgtacttacgtttacgtcgtacgacggtaccggtggggacctacgtggtacttacgttcgtacgggttccggttacccggggaacccgggtacctaacgggtcccgtacccgggtccggttaccggtaccgaccggacccccgaaacggacccccctaaaccccgtcgttaccgtacctaccttcccgttcccggtccccccg

SEQ ID NO: 53418 - DNA, 674 bp, Homo sapiens
  misc_feature: GYAE6OF01AO89R.29.78.H01.1.454.CMB.1.raw
  modified_base (239)..(239): a, c, t, g, unknown or other
  misc_feature (239)..(239): n is a, c, g, or t
tcagatagagtactcacgaccggtgctcgatttagtgtgagtagtttgggtttggggggagagaggagtccacccctgggatcttcaggtgttttcatttggtgatcaggacggaacagagagaactcaccatggagtttgggctgagctggcttttcttgtggctattttaaaaggtgtccagtgtgacgtgcagttggtggagtctgggggcgcctggggtacggccgggggggtcncgtgagactctcctgtgcggcctctggattaagtttaggagtcatgccatgaacgtgggtccgccaggctccgaggggaagggcgtgggaggtcgggtcgtcggctattaggtggcaggtgggtggcgactatatattagtgctagaccgccgtaggaaacgggtcccggtttacaccctagttttcccaaggacgaactaaacgtttacgaaaggaaaccaccggtcgtaggttaactccgtagacctaaagtgggaagtacgccgtaggacaccgtacgaaccgacgacggtaccgttactaatttattcggtaagttaacggacgaaggtcgtagggaaccggtaacccgggggacccgggtccccggtaagttccggaccggtccggacggggcccggagggggaccgtcggtcggtcccgccgttcccgg

SEQ ID NO: 53419 - DNA, 631 bp, Homo sapiens
  misc_feature: GYAE6OF01CL37H.29.78.H01.1.454.CMB.1.raw
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgacaaatggagagcctgagactcgacgacacggccgtctattattgtagttaaaggcgagctaggaacgtacgggaccgggccgacttgaccacgtggggccaggggacgctggtcaccgtctcctcacgccctccaaccgaacgggccccacgtccggttcccttccccccgtcgggcccacccctccctaccaacgacgccaccttcggcggggaccacgacgccgacgcccgtacgggcctcggccgttggtaccgaagggtacccttaaccgttaccctacggttaaccttccgttaagttccgtggacgggccggggtccgtgggaccgtaacgggccgacaacgtagtgcg

SEQ ID NO: 53420 - DNA, 748 bp, Homo sapiens
  misc_feature: GYAE6OF01EKUUP.29.78.H01.1.454.CMB.1.raw
tcagatagagtactcacgaccggtgctcgattttagtgtgagtagtttggggttttgggttgggggtactcgtactccccaggcccgttcccgtggcttgacgtcaatcggccctcgtggcctctgcctcccgtgggttaggctcggtacaaggttcgaccttgtaaccttctcgaggtcagtggaccacaggctacgcctttacggccagttccgtcttcggcagtcaggcgacggacggccgacgaccgacggggacccgtcgttacgttagagtcgacagtccaaactaagtggagtgggacgaagtcaacgtagacgaagggggcggactcccgtggaacgtccggtccttcctcacgtctccgacgcttccgacgggaccctggacgtccgccttaccttcgacctaaacttccgtaccggcctccgagtctaggaggactggacgtctagtactagttacgcgtacgacggtaccgtgggcctagtcggctagttccaccggttacgttacggaaccgggtactaacgggtccgtaccggttcgggtacggtaacgaccgtacccgaacgggccccctaaacccgctttccgtaccaccgttcccgttcccgttacccccgacccggtacccttaccggtaccggtttccccttcccgttaacgttccccgtaccggtaccggtaccccggggtacgtcggacccgtaaacgggtcccgacgggtataaccggcgtcgccgg

SEQ ID NO: 53421 - DNA, 772 bp, Homo sapiens
  misc_feature: GYAE6OF01D8FAX.29.78.H01.1.454.CMB.1.raw
tcagatagagtactcacgaccggtgctcgatttagtgtgagtagtttgggtttgggggcgcctgggtacgggccgggggggtcgctgagactctcctgtgcggcctctggattaagttttaggagtcatgccatgaactgggtccgccaggctccgaggggaagggctggaggtgggtctcggctagttaggtggcaggtggtggcgctatatattagtgcagacgccctggaacgggtccgttcacctattccagagactaattcgaagacacgctagtatctgacaaagtggagagcctgagactcgacgacgacggtccgtcttatttattgtagttaaaggcgagtcgttagggaaacgtaccggggacccggggtacccgtacgttacgaaccgacggtcgggggacccgtaacggggggaccgtcggttacgggtcccgtaacccggttccttaccccgtcgtaacccggaccccttaccccgaaaccccggaaaccggggtccccgtaaccgtttcccgggttaccccgtttccccccccgtcgggtacccctaaccccccgtaccccttacccgaaacggtaccgtccccgtaaacccttccgggtcgggggaaccacgaacggtcccgaaccggccccgttaggggcccgttcggacccgttcgggttaccgaacggtaccgtacccttacgtaaccgtaccttaccttacgtccgtagggacggtccgggcgtacggacgaacgggtcccagtacgtagctg

SEQ ID NO: 53422 - DNA, 590 bp, Homo sapiens
  misc_feature: GYAE6OF01CFY8N.29.78.H01.1.454.CMB.1.raw
  modified_base (588)..(588): a, c, t, g, unknown or other
  misc_feature (588)..(588): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacggggaccggggcccgacttcgaccacgtggggccagggggacgctgggtcaccgtctcctcacgcctccaccaacgggcccacgtcggtccttcccccgtcggcccaccccgtcctcccaacgacgccaccctccgtcgggggccacgacgcgacgcccgtgggcctcggcctcggtcaacggtactaccgttccacgttacctacttacgtctaggacggcgggcgtggacgaagggcgacactgncg

SEQ ID NO: 53423 - DNA, 583 bp, Homo sapiens
  misc_feature: GYAE6OF01CGJYZ.29.78.H01.1.454.CMB.1.raw
  modified_base (582)..(582): a, c, t, g, unknown or other
  misc_feature (582)..(582): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaaagaacacgctgtatctgcaaaatggagagcctgagactcgacgacacggccgtctattattgtgttaaaggcgagctggaagtacgggaccggggcccgacttgaccacgtggggccagggggacgcgtggtcaccgtctcctcacgccctcccaaccgaacgggcccaacgtccggtccgttccccccgtcggccctacccctccctacccaacgacgccacccgtccgtcgggggccacacgcacgcccgtgggcctcgcctggtcaaggtacctactccacgtactctactcgtgaggcgggctggacgacggcacatgnc

SEQ ID NO: 53424 - DNA, 581 bp, Homo sapiens
  misc_feature: GYAE6OF01EKR77.29.78.H01.1.454.CMB.1.raw
  modified_base (562)..(562): a, c, t, g, unknown or other
  misc_feature (562)..(562): n is a, c, g, or t
  modified_base (579)..(579): a, c, t, g, unknown or other
  misc_feature (579)..(579): n is a, c, g, or t
  modified_base (581)..(581): a, c, t, g, unknown or other
  misc_feature (581)..(581): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccgttcaccatttccagagacaattcgaagaacacgctgtatctgcaaatggagagcctgagactcgacgacacggccgtctattattgtgttaaaggcgagctggaatacggggaccgggcccgacttcgaccacgtggggccaggggacgcgtggtccaccgtctccctcacgccctccaccgaacgggcccacgtccggtccttcccccgtcggccctacccctccctacccgaacgacgcctaccctcgtcgggggcacgacgcacgcccgtggctcgccgtcggtacacggaccttactccgtacgtactctatctgacggcgggcgnggacgacggcgacatgngn

SEQ ID NO: 53425 - DNA, 512 bp, Homo sapiens
  misc_feature: GYAE6OF01DMGGL.29.78.H01.1.454.CMB.1.raw
  modified_base (326)..(326): a, c, t, g, unknown or other
  misc_feature (326)..(326): n is a, c, g, or t
  modified_base (432)..(432): a, c, t, g, unknown or other
  misc_feature (432)..(432): n is a, c, g, or t
  modified_base (510)..(511): a, c, t, g, unknown or other
  misc_feature (510)..(511): n is a, c, g, or t
tcagatagagtactcacgaccggtgctcgatttagtgtgagtagtttgggtttggtggtctctctcccagcctgtgctgactcaatcgccctctgcctctgcctccctgggaggctcggtcaaggtcacctgtactctgagcagtggacacagcagctacgccatcgcttggcatcagcagaggccagacacgggccctgttacttgatgacagtcaacaatgatggcagtcacagcgaaaggggggacggatccctgacttcgcttctcagtctcagctcgtggcctggacgcgctacctcacaatcctccggctcagtctgagntgagctgactatactgtcagtccgtggggcacgtggctagttcgacggtcgttcggaaccgggtacaaggtccgaccgtcgtcggcacgcccgaaggccaacccgntcgtaccacgttctcgttaccccacctcctactacgtacctctatcgtgaggcggctacggcgaaggtcactatacgnnc

SEQ ID NO: 53426 - DNA, 603 bp, Homo sapiens
  misc_feature: GYAE6OF01EF93L.29.78.H01.1.454.CMB.1.raw
  modified_base (602)..(602): a, c, t, g, unknown or other
  misc_feature (602)..(602): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccgggcccgacttgaccacgtggggccagggggacgcgtggtcaccgtctcctcagcctccaccaagggcccatcggtccttccccctcggccaccctcctccaacgacgccaccctcgtcggggccacgacgcacgcccgtgggcctcgcccgttggtaccgaacggacctaccttcccgaacgttacctccttacgttccgtaggacggccggggtacgtcggggaccgtaaacgggtccgaccgaagttacggnc

SEQ ID NO: 53427 - DNA, 643 bp, Homo sapiens
  misc_feature: GYAE6OF01DA16Q.29.78.H01.1.454.CMB.1.raw
  modified_base (580)..(580): a, c, t, g, unknown or other
  misc_feature (580)..(580): n is a, c, g, or t
tcagatagagtactcacgaccggtgctcgatttagtgtgagtagtttgggtttggggtccgagccatggtgcagactccccagagctctcctcctcctccactgcacagggtctctctcccagcctgtgctgactcaatccgccctctcgcctctcgccctcccgtgggaggctcggtcaaggtccacctgtactctgagcaggtggacacagcagctacgccatcgctggcatcagcgagacggccagaccgaccgggtcccttcgttacttgatcgacagtacaaataagtgatcggacagtcaacgaggacgggaaacgggggacggtacctcccgtagacgtcgtcttcgtacgacgtcctaccgcgtccgtcgtcgggtcgtacggacgccgtacctacctacaactaacgtcccgtcccgaccttaccgaggtcgtaggaacggtatcggagtcgtagtaacttaagttactacggtacgacggtaccggtagggccaaccggtggtacttagttacggtacgggttcgacccggggaccgggaactacggccgtaacccggtcggtccggtanacccggacccgaacccggaccccaaccctagtccgaccttaccgtccttcccggttacccccg

SEQ ID NO: 53428 - DNA, 565 bp, Homo sapiens
  misc_feature: GYAE6OF01EA7KG.29.78.H01.1.454.CMB.1.raw
  modified_base (564)..(565): a, c, t, g, unknown or other
  misc_feature (564)..(565): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccggggcccgacttgaccacgtggggccaggggacgctggtcaccgtctcctcacgccctccaaccgaacgggcccacgtccggtccttcccccgtcggcccacccgtcctaccaacgacgcaccctcgtcggggccacacgcacgcccgtgggctcgccgtggtcaaggacctacttccacgtactctactctgaggcggctggacgaggcgacatgnn

SEQ ID NO: 53429 - DNA, 588 bp, Homo sapiens
  misc_feature: GYAE6OF01BYT3L.29.78.H01.1.454.CMB.1.raw
  modified_base (576)..(576): a, c, t, g, unknown or other
  misc_feature (576)..(576): n is a, c, g, or t
tcagatagagtactcacgaccggtgctcgatttagtgtgagtagtttgggtttggggtctgagagaggagtccacccctgggatcttcaggtgttttcatttggtgatcaggacggaacagagagaactcaccatggagtttgggctgagctggctttttcttgtggctattttaaaaggtgtccagtgtgacgtgcagttggtggagtctgggggcgcctggggtacgggccgggggggtcgctgagactctcctgtgcggcctctggattaagttttaggagtcatgccatgaactggggtccgcaggctccgaggggaaggggctgggagtggggtctcggctagttagtggcaggtggtggcgctatatattatgcagaccgccctggaacgggtccgttcacctatttccagagacaagttcgaagaacacgctgtacttctagacaaagtggagacgcctgagactcgacgacacggcctctattattgtagttaaagcgtagcgtaggaagtccggggacccgggcccgtaccgttcggacccgtacggtcggggaccgagggggaccncggtggtacccg

SEQ ID NO: 53430 - DNA, 593 bp, Homo sapiens
  misc_feature: GYAE6OF01B5VL2.29.78.H01.1.454.CMB.1.raw
  modified_base (304)..(304): a, c, t, g, unknown or other
  misc_feature (304)..(304): n is a, c, g, or t
  modified_base (312)..(312): a, c, t, g, unknown or other
  misc_feature (312)..(312): n is a, c, g, or t
  modified_base (589)..(589): a, c, t, g, unknown or other
  misc_feature (589)..(589): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctagtatctgcaaatggagagcctgagactcgacgacncggccgtntattattgtgttaaaggcagctaggaatacgggaccgggccgacttcgaccacgtggggccagggggacgcgtggtcaccgtctcctcagcctccaccgacggcccagtccggtccttccccctggacccaccctccctaccgaacgcgaccacctcgtcggggcaacgcgccgacgcccgtagggcctcgtaccgtcggacaacgggtacctaccgttcctaacgtcctaccgttagtccgtagacggtcgggtcgtggacacgggacgacagtgngacg

SEQ ID NO: 53431 - DNA, 601 bp, Homo sapiens
  misc_feature: GYAE6OF01BGXS9.29.78.H01.1.454.CMB.1.raw
  modified_base (386)..(386): a, c, t, g, unknown or other
  misc_feature (386)..(386): n is a, c, g, or t
  modified_base (600)..(601): a, c, t, g, unknown or other
  misc_feature (600)..(601): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctggaagggccggttcaccatttccagagacaattcgaagaacacgctgtatctgcaaatggagagcctgagactcgacgacacggccgtctattattgtagttaaaggcgagctggaagtacggggaccggggcccgacttgaccacgtggggccagggggacncgtggtcaccgtctcctcacgccctccaccgaacgggccccagtccggttcccttcccccgtcggcccaccccgtccctaccaacgacgccacccgtcgtcgggggaccacgcgccacgcccgtcggccgtcgcccgtcggtacaacggaccttaccttcccgacgtacctcctacgtcgtggacggccgggcgtcgggacgacggcgacatgnn

SEQ ID NO: 53432 - DNA, 567 bp, Homo sapiens
  misc_feature: GYAE6OF01CLTVC.29.78.H01.1.454.CMB.1.raw
  modified_base (382)..(382): a, c, t, g, unknown or other
  misc_feature (382)..(382): n is a, c, g, or t
  modified_base (565)..(565): a, c, t, g, unknown or other
  misc_feature (565)..(565): n is a, c, g, or t
  modified_base (567)..(567): a, c, t, g, unknown or other
  misc_feature (567)..(567): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacatgctgtatctgcaaatggagagcctgagactcgacgacacggccgtctattattgtgttaaaggcgagctgggaatacggggaccgggcccgacttgaccacgtggggccaggggacnctggtcaccgtctcctcagccctaccaccaacggcccactccggtccttcccccgtggccacccctcctacccaacgacgccaccctcgtcggggcacacgcacgcccgtgggcctcgccgtggtaccgaacggtacctacttccagttacctcgtctctgacgcgggctggcgaaggcgcangn

SEQ ID NO: 53433 - DNA, 767 bp, Homo sapiens
  misc_feature: GYAE6OF01D6BUF.29.78.H01.1.454.CMB.1.raw
  modified_base (184)..(184): a, c, t, g, unknown or other
  misc_feature (184)..(184): n is a, c, g, or t
  modified_base (208)..(208): a, c, t, g, unknown or other
  misc_feature (208)..(208): n is a, c, g, or t
  modified_base (219)..(219): a, c, t, g, unknown or other
  misc_feature (219)..(219): n is a, c, g, or t
  modified_base (242)..(242): a, c, t, g, unknown or other
  misc_feature (242)..(242): n is a, c, g, or t
  modified_base (367)..(367): a, c, t, g, unknown or other
  misc_feature (367)..(367): n is a, c, g, or t
  modified_base (383)..(383): a, c, t, g, unknown or other
  misc_feature (383)..(383): n is a, c, g, or t
  modified_base (415)..(415): a, c, t, g, unknown or other
  misc_feature (415)..(415): n is a, c, g, or t
tcagatagagtactcacgaccggtgctcgatttagtgtgagtagtttgggtttggggtctgagagaggagtccacccctgggatcttcaggttgttttcatttggtgatcaggacggaacagagagaactcaccatggaggtttgggctgagcggtgtgtttctaggtcgctaagtttaaaggntcagtgtgcgtgctagttggtggngtcgtggggcnccggtgggtcgggccgggggtcncgtgagctctccgtgcgcggctgtaggtattaagtttaggatcatcgccaagtcgtaactcggttcccgccaggccgtaccggaaggggaacggggcgtagggtaggttcgggtaccgttccggngtttaagttggtcggngtaggtggtggacctagtattagtaatttagngaccgaggacccgtcccgttaagggaaccgggttccgtcccaccgtttagttacccgagtaacgacttaaacgttacgaaacgaacgaccgttactgttacgtacgtaggaactaaggtgacgtaccgtactaggaacgccgtaacgaaccggttacccgaccggtaccgtttactttaagttaccggtttacggttaaagttaaccgggaggttaacgtaccgggtaaggggttaaacccggtaccccggggggtacccccggtaccggtttacccggaaacccggtccccgggtaacgggttaccggggacccggttaaccggggccgtttacgcccggggttacccccg

SEQ ID NO: 53434 - DNA, 679 bp, Homo sapiens
  misc_feature: GYAE6OF01EXB8D.29.78.H01.1.454.CMB.1.raw
  modified_base (375)..(375): a, c, t, g, unknown or other
  misc_feature (375)..(375): n is a, c, g, or t
  modified_base (394)..(394): a, c, t, g, unknown or other
  misc_feature (394)..(394): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaaggccggttcaccatttccagagacaattcgaagaacacgctgtatctgcaaatggagagcctgagactcgacgacacggccgtctattatgtgttaaaggcgagctggaatacgggaccgggccacttcgaccactggggccaggggacncgtggtccaccgtctcccncacgcctccaccaacgggcccacgtcggtccttcccccgtcggcccaaccccttccgtaccctaaacggacgtacccgaacccgttccgtacgggggtaccaaccgacgaccgaaccggccccgttacggggcccgtcgggtcccgttaggggtacccaaacgggtacccttaaccgttacccgacggtttaaacctaccgttaacgtttccggtaggtaaccgggtccgggggtaccgttaggggacccgtaaacggggccgtaacccgtagttaacgcgtacg

SEQ ID NO: 53435 - DNA, 569 bp, Homo sapiens
  misc_feature: GYAE6OF01EEIE4.29.78.H01.1.454.CMB.1.raw
  modified_base (564)..(564): a, c, t, g, unknown or other
  misc_feature (564)..(564): n is a, c, g, or t
  modified_base (568)..(569): a, c, t, g, unknown or other
  misc_feature (568)..(569): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacggggaccggggcccgacttgaccacgtcggggccagggggacgctggtcaccggtctcctcagccctccaccaacgggcccatccggtccttccccctggcccaccctcctccaacgacgccacctcgtcggggacacagccacgccctgggcctggccctggtacaacgggtactacttcccagtcctactactctggacgccggggctgggacacgggcanatgnn

SEQ ID NO: 53436 - DNA, 583 bp, Homo sapiens
  misc_feature: GYAE6OF01CKMDL.29.78.H01.1.454.CMB.1.raw
  modified_base (366)..(366): a, c, t, g, unknown or other
  misc_feature (366)..(366): n is a, c, g, or t
  modified_base (579)..(579): a, c, t, g, unknown or other
  misc_feature (579)..(579): n is a, c, g, or t
  modified_base (582)..(583): a, c, t, g, unknown or other
  misc_feature (582)..(583): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccggggcccgaacttcgaaccncgtggggccagggggacgcgtggtccaccgtctcctcacgcctccaccgaacgggcccatccggtccttccccctcggcccaccctccctacccaacgacgccacccgtacgtcgggggccaaccgacgccgacgcccgtcgggcgtcgtccctggtccaaggctaccgttccacgtactctaactctgaggtcgggctggcaacggcgacanagnn

SEQ ID NO: 53437 - DNA, 688 bp, Homo sapiens
  misc_feature: GYAE6OF01B374S.29.78.H01.1.454.CMB.1.raw
  modified_base (246)..(246): a, c, t, g, unknown or other
  misc_feature (246)..(246): n is a, c, g, or t
  modified_base (416)..(416): a, c, t, g, unknown or other
  misc_feature (416)..(416): n is a, c, g, or t
tcagatagagtactcacgaccggtgctcgatttagtgtgagtagtttgggtttggggtctgagagaggagtccacccctgggatcttcaggttgttttcatttggtgatcaggacggaacagagagaactcacatggagtttgggctgagctggtcttttctgtggcttaattttaaaaggtgtccagtgtgacgtgcaggttggtggagtcgtgggggcgccgtggggtacgggccggggggtcncgtggagactctccgtgtgcggtcctcgtggtaatttaaggttttaggagtcagtcgaccagtacgaacgtggggtcccacgaggcctaccggaaggggaaggggctgggaggtcgggtctcgggtacttagttaggtggcgtaggtgggtggcgcttaatattagttanggactacgaccgtcccgtaggaacgggtcccgtttacaccgttattaccgaagactactaagttacgaaagtaaccacgtactagtactcgtagaacaaagtggacgacgcgtagagacctacgaacgaccgaccggtacctactaagtttagttaggtagttaaacggcgtaaggccgttagggaaaccggtaccggggaccccgggaccctacgttaccgaacccgtacggtacggggacccgaaggggacccgtcggtacggtaccccg

SEQ ID NO: 53438 - DNA, 700 bp, Homo sapiens
  misc_feature: GYAE6OF01BLXHX.29.78.H01.1.454.CMB.1.raw
  modified_base (246)..(246): a, c, t, g, unknown or other
  misc_feature (246)..(246): n is a, c, g, or t
  modified_base (307)..(307): a, c, t, g, unknown or other
  misc_feature (307)..(307): n is a, c, g, or t
  modified_base (354)..(354): a, c, t, g, unknown or other
  misc_feature (354)..(354): n is a, c, g, or t
  modified_base (360)..(360): a, c, t, g, unknown or other
  misc_feature (360)..(360): n is a, c, g, or t
tcagatagagtactcacgaccggtgctcgatttagtgtgagtagtttgggtttggggtctgagagaggagtccacccctgggatcttcaggtgttttcatttggtgatcaggacggaacagagagaactcaccatggagtttgggctgagcggtcgtgtttctaggtggctaattttaaaaggtgtcagtgtgacgtgcagttggtggagtcgtggggcgccgtggggtaccggccgggggggtcncgtgagactctccgtgtgccggcctgtggattaagtttagagtcatgccatgaactggccnccaggctccgagggaacggcgtggagtggtctcggctagttagtggngtgtgngctactatatatatcgacacgcgccgtaggacggtcgtaccacgtacttacgagtaacgtactaacgtaacgaaacgacgtacgtacgtagtactacgtaacgaacgtaaaggtacggaacgtacgtaccgtaggaccgtaaccgtaccggaaccggacccggtacccggtaccgttacgtttaacgtttaggttacggttaacggttaaacgggccggtaagtacggtaacgggtaaccgggtacccggggtaccccggggtacccgtacgttacccggaaccggtaccggggtaccggggacccgggtacggggacccgtccgggttccggtaccccg

SEQ ID NO: 53439 - DNA, 740 bp, Homo sapiens
  misc_feature: GYAE6OF01DW3MW.29.78.H01.1.454.CMB.1.raw
  modified_base (234)..(234): a, c, t, g, unknown or other
  misc_feature (234)..(234): n is a, c, g, or t
tcagatagagtactcacgaccggtgctcgatttagtgtgagtagtttgggtttggggtccgagccatggtgcagactccccagagctctcctcctcctccactgcacagggtctctctcccagcctgtgctgactcaatccgccctctcgcctctcgccctcccgtggggaggctcggtcaaggtccacctgtactctgagcagtggacacagcagctacgccatcgctggcancagcaggacggccaagacgaccgggccttacgttacttgatcgaactagtacaaactaattggagtcgggacaacgtccaacgaaggaccgggaaacggggggaccggtactccccgtaggtactccggtctttacctcgacgttcctacccaggtctcggtcggggcctaggacgtccgacctacccgtacaacgtactcccgtcccggtacctccaggttccgtaggacggtacgtgggacggtcttaagtaaccttacgtttacgtacgcccggtaacgggtcccggttggggaacctaccggttcggaccgttaacggttccggtacggggtttacccggacccgggggtaaacccgggtaccgtaaaccgggttccccgacccgggtttacccgggcccggttacgaaccccggaccccccggtaaacggaccccccttaaacccccggtacttccgggttacccctaacccgtttcccgttcccccgggttacccccccg

SEQ ID NO: 53440 - DNA, 760 bp, Homo sapiens
  misc_feature: GYAE6OF01CT8OM.29.78.H01.1.454.CMB.1.raw
  modified_base (244)..(244): a, c, t, g, unknown or other
  misc_feature (244)..(244): n is a, c, g, or t
tcagatagagtactcacgaccggtgctcgatttagtgtgagtagtttgggtttggggtctgagagaggagtcccacccctgggatcttcaggtgttttcatttggtgatcaggacggaacagagagaactcaccatggagtttgggctgagcgtggtctttctggtggctaatttaaaaggtgtccagtgtgacgtgcagttggtggagtcgtgggggcgccgtggggtacggccggggggtcnctgagactctcctgtgcggcctcgtggtatttaaggttttggagtcatcgccatgaacgtggtccgaccaggcctccgagggaaggggctggaggtgggtctcgggctagttagtggcagtggtggcgctatagtattatgcagaccgtccgtaggaacgggcccggttacaaccgtactttaccgagtacgaactaacgttacgaaagtaaccgaacgtcgttagtaagtccgtagaaccgtaaagtgggaacgacgtacccgttaggaaccgaccgttaccgggaaaccaccggaaccggtcccgttagttaacgtttagttacgggttaaggttaaaaccgggtcgtaacgggtacgttacgggggaaaaccggttaaccccgggggggtaccccggggtaacccccggtaaacgttttacccggggaaacccccggttaacggggttaaccccgggggggacccggtaaacgggggggaccccgtaccggggtttcccgggtaaacccccgg

SEQ ID NO: 53441 - DNA, 620 bp, Homo sapiens
  misc_feature: GYAE6OF01C2KFC.29.78.H01.1.454.CMB.1.raw
  modified_base (401)..(401): a, c, t, g, unknown or other
  misc_feature (401)..(401): n is a, c, g, or t
  modified_base (618)..(618): a, c, t, g, unknown or other
  misc_feature (618)..(618): n is a, c, g, or t
  modified_base (620)..(620): a, c, t, g, unknown or other
  misc_feature (620)..(620): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgacaaatggagagcctgagactcgacgacacggccgtctattattgtagttaaaggcgagctaggaatacgggaccggggcccgacttgaccacgtcggggccaggggacgctggtccacgtctccncgagccctccaccaacgggcccacgtccggtccttcccccgtcggcctacccctcctacccaagacgccaccgtcgtcggggcacgacgccgacggccccgtacgggcctcggcccgtcgggtaccgtaacgggaccttacccgttacctacgttaccttcgtacgttctacggacggtccgggccgttcgggaccgtaacgggccgacacgtacgngn

SEQ ID NO: 53442 - DNA, 615 bp, Homo sapiens
  misc_feature: GYAE6OF01B4CXO.29.78.H01.1.454.CMB.1.raw
  modified_base (180)..(180): a, c, t, g, unknown or other
  misc_feature (180)..(180): n is a, c, g, or t
  modified_base (186)..(186): a, c, t, g, unknown or other
  misc_feature (186)..(186): n is a, c, g, or t
  modified_base (201)..(201): a, c, t, g, unknown or other
  misc_feature (201)..(201): n is a, c, g, or t
  modified_base (205)..(205): a, c, t, g, unknown or other
  misc_feature (205)..(205): n is a, c, g, or t
  modified_base (210)..(210): a, c, t, g, unknown or other
  misc_feature (210)..(210): n is a, c, g, or t
  modified_base (218)..(219): a, c, t, g, unknown or other
  misc_feature (218)..(219): n is a, c, g, or t
  modified_base (221)..(221): a, c, t, g, unknown or other
  misc_feature (221)..(221): n is a, c, g, or t
  modified_base (223)..(224): a, c, t, g, unknown or other
  misc_feature (223)..(224): n is a, c, g, or t
  modified_base (228)..(228): a, c, t, g, unknown or other
  misc_feature (228)..(228): n is a, c, g, or t
  modified_base (233)..(233): a, c, t, g, unknown or other
  misc_feature (233)..(233): n is a, c, g, or t
  modified_base (243)..(246): a, c, t, g, unknown or other
  misc_feature (243)..(246): n is a, c, g, or t
  modified_base (248)..(249): a, c, t, g, unknown or other
  misc_feature (248)..(249): n is a, c, g, or t
  modified_base (272)..(272): a, c, t, g, unknown or other
  misc_feature (272)..(272): n is a, c, g, or t
  modified_base (274)..(274): a, c, t, g, unknown or other
  misc_feature (274)..(274): n is a, c, g, or t
  modified_base (276)..(276): a, c, t, g, unknown or other
  misc_feature (276)..(276): n is a, c, g, or t
  modified_base (283)..(283): a, c, t, g, unknown or other
  misc_feature (283)..(283): n is a, c, g, or t
  modified_base (285)..(285): a, c, t, g, unknown or other
  misc_feature (285)..(285): n is a, c, g, or t
  modified_base (290)..(290): a, c, t, g, unknown or other
  misc_feature (290)..(290): n is a, c, g, or t
  modified_base (292)..(292): a, c, t, g, unknown or other
  misc_feature (292)..(292): n is a, c, g, or t
  modified_base (304)..(304): a, c, t, g, unknown or other
  misc_feature (304)..(304): n is a, c, g, or t
tcagatagagtactcacgaccggtgctcgatttagtgtgagtagtttgggtttggggtctgagagaggagtccacccctgggatcttcaggtgttttcatttggtgatcaggacggaacagagagaactcaccatggagtttgggctgagcggcgtggttctaaggcgcaatttaaaggntcagtntgctgcagtgtgagntggngctgngcgggcgnngncnnctgngcgcntgatagtagnnnncnnacgtcgcgcgcgcgcgaggaggngngngtgtcgngntgtgngngagtggtgcgtntagtagtatagtgcgacgaccgcgtacggacggtacgtactacgtacgttacgtagacgtaacgtaacgtacgaacgaacgacgtactagtactcgtacgacgtaagtaggacgacgtacgacgacgtaccgtaccgaacgacgtaccgtaccgttacgttaacgtttagtttaggttacggtaacggtacggtacggtacggtaacgggtaaccgggtaacccggggtacccgggtacccggtaccggtaccggtaccggaccggtaccgggtacccgggaacgggtaccggtccggtaccggtacccgg

SEQ ID NO: 53443 - DNA, 621 bp, Homo sapiens
  misc_feature: GYAE6OF01ED85Z.29.78.H01.1.454.CMB.1.raw
  modified_base (331)..(331): a, c, t, g, unknown or other
  misc_feature (331)..(331): n is a, c, g, or t
tcagatagagtactcacgaccggtgctcgatttagtgtgagtagtttgggtttggtggtctctctcccagcctgtgctgactcaatcgccctctgcctctgcctccctgggaggctcggtcaaggtcacctgtactctgagcagtggacacagcagctacgccatcgcttggcatcagcagaggccagacacgggccctcgttacttgatgacagtacaacaatgatggcagtcacagcgaagggggacggatccctgatcgcttctcagtcctccagtcctcgtgggccctggacgccgcctacctcaacaactctccggcctccagtcngaggatggagctagactattactgtcgagtaccgtggggctacgtggactagttcgacgggttccgtaccggggaaccgggtaccgtaacgggtcccaccggttcggtccgggtacaccggacccctaacgggaccccctaaaccccgtacgttcgtaaccctcctttacccgttcccgtttacccccaccccgttcctaccgtacgttacctacgttaacttcccggtacggacggtcccggggtacgtacgggtaccgaaacgggttccgacgtaacgaggtcacgtg

SEQ ID NO: 53444 - DNA, 610 bp, Homo sapiens
  misc_feature: GYAE6OF01CSUKY.29.78.H01.1.454.CMB.1.raw
  modified_base (607)..(607): a, c, t, g, unknown or other
  misc_feature (607)..(607): n is a, c, g, or t
  modified_base (609)..(609): a, c, t, g, unknown or other
  misc_feature (609)..(609): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctaggaagtacgggaccggggccgacttcgaccacgtggggccgaggggacgcgtggtccaccgtctcctacagccctccaccgagggccccagttccggtcccttccccccgtggccctaccccttccctacccaacgacgacctacccgtcggtcggggccacgacgaccacggccccgtggggtcctcggtccgtcgggtacgaacggtacctaccttcccgacgtaccttctagtccgtgacggtcgggctcggacgaacggcgacagtgngng

SEQ ID NO: 53445 - DNA, 773 bp, Homo sapiens
  misc_feature: GYAE6OF01DXUQ0.29.78.H01.1.454.CMB.1.raw
  modified_base (262)..(262): a, c, t, g, unknown or other
  misc_feature (262)..(262): n is a, c, g, or t
  modified_base (268)..(268): a, c, t, g, unknown or other
  misc_feature (268)..(268): n is a, c, g, or t
  modified_base (276)..(276): a, c, t, g, unknown or other
  misc_feature (276)..(276): n is a, c, g, or t
  modified_base (771)..(771): a, c, t, g, unknown or other
  misc_feature (771)..(771): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcgagccgccgtaggacgggtccgtcacttcttacgagacactatacgaanacacgntgtatctnaacaagtggagacgcgagacgacgacgaccgaccgaccggtccgtattaatttagttggttaaggtaacggcgagtcggtaaggtaacgggaccggggcccggaccgtacgtacgaaccgcgggtccgggacgggacgggccgtcggtcggtacccgtaccgttccctccgtacgacccgtccctacccgaaaccgggacccggtaccctaccggttcccggttcccccttcccggtcccgtaccccctacccctacccgtaacgaaccggaccgtaccccgtaccgttccggggtaccggggaccaacggtacgaccggtacccggtcccgggtacgggtccgtaccggttccggttacgggtaaaccggtaaccggttaccctttacccgttaaccggtaaccgttacccgttacgttaaccgttccggtaacgggtccggggtcccggttacgggtacccgggaaacgggtaccggacccgtagtaacgcgngc

SEQ ID NO: 53446 - DNA, 628 bp, Homo sapiens
  misc_feature: GYAE6OF01BSZ0V.29.78.H01.1.454.CMB.1.raw
  modified_base (626)..(626): a, c, t, g, unknown or other
  misc_feature (626)..(626): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccgagggaaggggctggagtgggtctcggctattagtggcagtggtggcgctatatattatgcagacgccctgaagggccgttcaccatttccagagacaattcgaagaacacgctgtatctgacaaatggagagcctgagactcgacgacacgccgtctattattgtagttaaaggcgagcgtaggaaacgtaccggggacccgggcccgacttcggacccgacgtcgggggaccgaggggacgcgtcggtcaccgtcctcctcgacgtccctccaccgacgggacccacgtcccggttcccttccccccgtcggtacccaccccgtccctaccgaacgacgcctacctcgtcggggaccacgacgcgacgcccgtcggcgtcgccgtcggtacgaacggtactaccgttaccgacgttacctactcgtccgtaggacggccgggtcgacgggccgaacggacgacacgtagncg

SEQ ID NO: 53447 - DNA, 608 bp, Homo sapiens
  misc_feature: GYAE6OF01B61KT.29.78.H01.1.454.CMB.1.raw
  modified_base (607)..(608): a, c, t, g, unknown or other
  misc_feature (607)..(608): n is a, c, g, or t
tcagatagagtactcacgaccggtgctcgatttagtgtgagtagtttgggtttgggggcgcctgggtacgggccgggggggtcgctgagactctcctgtgcggcctctggattaagttttaggagtcatgccatgaactgggtccgccaggctccgagggaaggggctggagtgggtctcggctattagtggcagtggtggcgctatatattatgcagacgcctgaagggccgttcaccatttccagagacaattcgaaagaacacgctgtatctgacaaatggagagcctgagactcgacgacgacggccgtctatttatgtagttaaaggcgagctaggaagtacggggaccggggccgacgttggaccacgtggggccaagggggacgcgtggacaccgtctacctcagcctaccacgaacgggcccacgtcggttaccttcccctcggccaccctcctaccaacgacgcacctcgtcggggcacgacgcgacgccgtcgggctcggtccgtaggtcgaaggtacctaccgttaccgtaacgtactaccttacgtcgtaggacggcgggtaccgtagggaccgaacgggaccgagtaacgacgnn

SEQ ID NO: 53448 - DNA, 664 bp, Homo sapiens
  misc_feature: GYAE6OF01BROG6.29.78.H01.1.454.CMB.1.raw
  modified_base (661)..(661): a, c, t, g, unknown or other
  misc_feature (661)..(661): n is a, c, g, or t
  modified_base (663)..(663): a, c, t, g, unknown or other
  misc_feature (663)..(663): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgccaggctccagggaagggctggagtgggtctcggctattagtggcagtggtggcgctatatatatgcagacgccctgaaggccggtcacattccagagacaattcgaagaacacgctgtatctgacaaagtggagagacctggagactcggacgacacggccgtctattacttgtagttaaacggcgagtctaggaaagtaccggggaccggggcccgtagttcggaccaacggtggggaccgaggggaccgtcgtcgggtccaccgttcctccctacgacgtcccgtacccaccgaaccggggcccaacgttccggttcccgttccccccgtacgggtcccctaccccgtccgtaacccgtaagccggtacctacccgtcgtcgggggacctaccgacgccgaacgcccggtggccgtcgacgtacggtacaacgggtcctaacctccgacgttacctacctaagttccgtggtaacggccgggtacctcgggacctacgggccacgtagtacggngng

SEQ ID NO: 53449 - DNA, 609 bp, Homo sapiens
  misc_feature: GYAE6OF01BPH1M.29.78.H01.1.454.CMB.1.raw
  modified_base (386)..(386): a, c, t, g, unknown or other
  misc_feature (386)..(386): n is a, c, g, or t
  modified_base (608)..(608): a, c, t, g, unknown or other
  misc_feature (608)..(608): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgacgactcgacgacacggccgtctattattgtgttaaaggcgagctggaagtacggggaccgggccgacgttcgaccgacgtggggccagggggacncgtggtccaccgtctcctcacgcctccaccgacgggcccagtccggtccttccccgtcgccaccctcctaccaagacgctacctcgtcggggcacgagccacgcccgtacgggccgtcgtccgttgggtacaacgggtacctacgttcctaacggttaccttactaacgtcgttaggacgggtccgggtcgtacgggacgtaacgggccgacgacgtagcgng

SEQ ID NO: 53450 - DNA, 810 bp, Homo sapiens
  misc_feature: GYAE6OF01DA5C2.29.78.H01.1.454.CMB.1.raw
  modified_base (183)..(183): a, c, t, g, unknown or other
  misc_feature (183)..(183): n is a, c, g, or t
  modified_base (248)..(248): a, c, t, g, unknown or other
  misc_feature (248)..(248): n is a, c, g, or t
  modified_base (267)..(267): a, c, t, g, unknown or other
  misc_feature (267)..(267): n is a, c, g, or t
  modified_base (372)..(372): a, c, t, g, unknown or other
  misc_feature (372)..(372): n is a, c, g, or t
  modified_base (399)..(399): a, c, t, g, unknown or other
  misc_feature (399)..(399): n is a, c, g, or t
tcagatagagtactcacgaccggtgctcgatttagtgtgagtagtttgggtttggggggagagaggagtccacccctgggatcttcaggtgttttcatttggtgatcaggacggaacagagagaactcaccatggagtttgggctgagcgtgtcgttttctaggtggctaagttttaaaaggngtcagtgtgacgtgcaggttggtggagtcgtgggggcgccgtgggggtacgggccgggggggtcncgtggagacttctcctggngccggcctgtaggtatttaaggttttaggagttcatcgccagtgaacgttcgggtccgccgacggccgtccgagggggaaggggcgtggaggtgggtcgtccggnttagttaggtggctaggtggtcggcgntataattattagtgcaacgaccgcccgtaggaaccgggtccggtttaccaaccgtactttacccaagtaacgaacccgtaaagtttaaccggaaagaaacccacggtacccttacggttaaatccttaaggtaaccgaaaagttaggggaaacggtaacgaccccggttaaggaacgttaaaccccgggtacggaacccgtaaaccggacccgggtaaccccggtttacctttaacgttttaaaggttttacggtaaaggttttaaaacggggacgggaaccggttacggtaacgggtaaacgggttaaaccccgggggaccccgggggtaacccgtacgtttaccggaacccgtacgggtacggggaccggtaacgggggacgaccggttcggtacccgcccgttacccg

SEQ ID NO: 53451 - DNA, 636 bp, Homo sapiens
  misc_feature: GYAE6OF01C21BL.29.78.H01.1.454.CMB.1.raw
tcagatagagtactcacgaccggtgctcgatttagtgtgagtagtttgggtttggggtctgagagaggagtccacccctgggatcttcaggtgttttcatttggtgatcaggacggaacagagagaactcaccatggagtttgggctgagctggcttttcttgtggctattttaaaaggtgtccagtgtgacgtgcagttggtggagtctgggggcgcctgggtacggccggggggtcgctgagactctcctgtgcggcctctggattaagtttaggagtcatgccatgaactgggtccgccaggctccgaggggaaggggctggagtgggtctcggctattagtggcagtggtggcgctatatattatgcagacgccctggaacgggccggtttcaccgtatttcccagagacaattcgaaagaacacgctgtatctgacaaatgggaagacgtccgtgacgactccggaacgaccgaccgggtccgttcttaatttagtttacggttagttaaaacgggccggtaacggcgttaggggaaacgttacccgggggaccccgggggtacccgtaacgttaccggaacccgtacggtccgggggacccgtaggggggaaccgtcgtcgggtaccccg

SEQ ID NO: 53452 - DNA, 594 bp, Homo sapiens
  misc_feature: GYAE6OF01DZCNZ.29.78.H01.1.454.CMB.1.raw
  modified_base (243)..(243): a, c, t, g, unknown or other
  misc_feature (243)..(243): n is a, c, g, or t
  modified_base (266)..(266): a, c, t, g, unknown or other
  misc_feature (266)..(266): n is a, c, g, or t
  modified_base (294)..(294): a, c, t, g, unknown or other
  misc_feature (294)..(294): n is a, c, g, or t
  modified_base (300)..(300): a, c, t, g, unknown or other
  misc_feature (300)..(300): n is a, c, g, or t
  modified_base (320)..(320): a, c, t, g, unknown or other
  misc_feature (320)..(320): n is a, c, g, or t
  modified_base (323)..(323): a, c, t, g, unknown or other
  misc_feature (323)..(323): n is a, c, g, or t
  modified_base (336)..(336): a, c, t, g, unknown or other
  misc_feature (336)..(336): n is a, c, g, or t
  modified_base (340)..(340): a, c, t, g, unknown or other
  misc_feature (340)..(340): n is a, c, g, or t
  modified_base (351)..(351): a, c, t, g, unknown or other
  misc_feature (351)..(351): n is a, c, g, or t
tcagatagagtactcacgaccggtgctcgatttagtgtgagtagtttgggtttggggtctgagagaggagtccacccctgggatcttcaggtgttttcatttggtgatcaggacggaacagagagaactcaccatggagtttgggctgagctggctttttcttgtggctaattttaaaaggtgtccagtgtgacgtgcagttggtggagtctgggggcgcctggggtacggccgggggggtcnctgagactctcctgagcggctgngaagtcgtacgagtgatgcatgatggcncaggcncgaggaggctggagtggtcnggntatgtgcagtggngcgntatatagtagngcacgacgtacgaggaacggtccgtacaacgtacttacgaagtacgaactaacgtacgaaacgtaacaacgtactagtaactcgtaacgaactaagtacggtaagtacgtaccgtacgtacgtacgtacgaacgacgacgtaccgtacgtagttagtagtagtaagtacgagtacgtaggtacggtaccgggtaccggaccggtacgtacgacgacggtacggacggacggacgcgtcgtacg

SEQ ID NO: 53453 - DNA, 576 bp, Homo sapiens
  misc_feature: GYAE6OF01DZ78W.29.78.H01.1.454.CMB.1.raw
  modified_base (561)..(561): a, c, t, g, unknown or other
  misc_feature (561)..(561): n is a, c, g, or t
  modified_base (571)..(571): a, c, t, g, unknown or other
  misc_feature (571)..(571): n is a, c, g, or t
  modified_base (575)..(576): a, c, t, g, unknown or other
  misc_feature (575)..(576): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccattttccagagacaaattcgaagaacacgctgtatctgcaaatggagagcctgagactcgacgacacggccgtctattattgtgttaaaggcgagctggaatacggggaccgggccgacttgaccacgtggggccaggggacgcgtggtccaccgtctccctcacggccctaccaccgaacggggccccagtccggtcctttccccccgtcggcccacccctcctacccaagacgccaccctcgtcgggggcacgacgcgacgcccgtgggcctgccttcgggtacaaggccttacttaccagtactctatctgaggcgggntggcacggcnatgnn

SEQ ID NO: 53454 - DNA, 599 bp, Homo sapiens
  misc_feature: GYAE6OF01BWWNR.29.78.H01.1.454.CMB.1.raw
  modified_base (596)..(596): a, c, t, g, unknown or other
  misc_feature (596)..(596): n is a, c, g, or t
  modified_base (598)..(598): a, c, t, g, unknown or other
  misc_feature (598)..(598): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtagttaaaggcgagcgtggaagtacggggaccgggcccgacttcgaccacgtggggccgaggggacgcgtcggtcaccgtctcctcacgccctaccaccgaacgggcccacgtccggtccttcccccgtcggccctaccctccctaccaacgacgcctacctcgtcggggcacgacgcgacgcccgtgggctcgccgtcggtacgaaggtacctacttccacgttactccttacgtcgttagacggtcgggccgtggacgaacgggcgacgacgtgngng

SEQ ID NO: 53455 - DNA, 683 bp, Homo sapiens
  misc_feature: GYAE6OF01EBFU4.29.78.H01.1.454.CMB.1.raw
  modified_base (247)..(247): a, c, t, g, unknown or other
  misc_feature (247)..(247): n is a, c, g, or t
  modified_base (550)..(550): a, c, t, g, unknown or other
  misc_feature (550)..(550): n is a, c, g, or t
  modified_base (682)..(682): a, c, t, g, unknown or other
  misc_feature (682)..(682): n is a, c, g, or t
tcagatagagtactcacgaccggtgctcgatttagtgtgagtagtttgggtttgggggcgcctgggtacggccggggggtcgctgagactctcctgtgcggcctcgtggagttaagtttaggagtcatgccatgaactgggtccgccaggctccagggaaggggctggagtgggtctcggctattagtggcagtggtggcgctatatattatgcagacgccctgaaggccgttcaccatttccaganacaattcgaagaacacgctgtatctgacaaatggaagagtcctgacgactcgacgacgacggcgtctattattgtagttaaaggcgagcgtggaagtaccggggccggaccgtacgttcgaccacgtcggggccagggggaccgcgtggtccgtacccgttcgtcctccgaacgccccttaccgaacccgaacggggcccctaacgttcccggttcccctttcccccgtcgggtacccctaccccgttccctacccggaaacgtaccgtacccaacccgttccgtcggggaccacgacgaccncggccccgtggccctcgtacccgttcggttacggaacggtaccctttaaccgtacctaggttaccctacgttaccgtcgttacgggcggcccgggtcgttacgggaccgaacgggcccaggaacgttagcgng

SEQ ID NO: 53456 - DNA, 724 bp, Homo sapiens
  misc_feature: GYAE6OF01C0ZO5.29.78.H01.1.454.CMB.1.raw
  modified_base (144)..(144): a, c, t, g, unknown or other
  misc_feature (144)..(144): n is a, c, g, or t
  modified_base (722)..(722): a, c, t, g, unknown or other
  misc_feature (722)..(722): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccnccaggcctccgagggagggctggagtgggtctcggctattagtggcagtggtggcgctatattattatgcagaccgccctaggaacgggtccgtacacctatttccgaagagaactattacgaagaaccacgctagtatctagactaagtggagagcctagagacgtacgacgaccgacggtccgtacttaatttagttgttaggttaaacggcgtagtacgtaggaacggtaaccggggacccgggacccgtacgttacgaccgacggtacggggaccggaaggggaccgtcggtacggtcccgaccgtcctccgtaccgacgcccgtaccaccgaaccggcccctaacggttccgttccccttcccccggtccgacccctaccccgtccctaaccgaagccgcccgtaaccgtccgggtcgggacctacgacgccgaccggtcccgtcggtaccgtccggtaccgttcgggaaccttaacgggtacccttaccgttaacccgtaaccgttaccgttactaaccgtccggtaggtaccggtcgggtcggtaccggacggacggacaccgtagtacgngc

SEQ ID NO: 53457 - DNA, 858 bp, Homo sapiens
  misc_feature: GYAE6OF01EQPZH.29.78.H01.1.454.CMB.1.raw
tcagatagagtactcacgaccggtgctcgatttagtgtgagtagtttgggtttggggtccgagccatggtgcagactccccagagctctcctcctcctccactgcacagggtctctctcccagcctgtgctgactcaatcgccctctgcctctcgcctcccgtggggaggctcggtcaaggtcacctgtactctgagcagtggacacagcagctacgccatcgcttggcatcagcagacggccagacgaccggccctcgttactgatgacagtacaacaagtgagtggacagtcacgaggacggaagggggacggactccgtgtactcgtcttctcgacgtcctcgacgtctcggtcgggtcctggacgtccgtacctaccctacgaacctaacgtcccgtcccgggtacccttaccgtaggttacccgtagggacggtaacggtacggtacgggtccttacggtaacctttaacgtttacccgttacggttacccgtaaccggggtacccgggttacgggggggtaccctaaccgggttaccggggttaccgttaacggttttacccggggttaaccgggggttttacccccggggttttaacccggggggggaaacccccggggggggtaaacccgttaaacccgggggtttaccccggtaacccccggggttttcccggggttaaccccggggggttaaccctaacccccggggtaaaccccccgggaaaacccccgggtacccccccccggtaaaaccccccccggttaaccggttttaccccgggttaaaccccccgtttaaccccgggttttccccgggtttcccccccggtttttaccccccccccccggg

SEQ ID NO: 53458 - DNA, 550 bp, Homo sapiens
  misc_feature: GYAE6OF01B37AS.29.78.H01.1.454.CMB.1.raw
  modified_base (545)..(545): a, c, t, g, unknown or other
  misc_feature (545)..(545): n is a, c, g, or t
  modified_base (549)..(549): a, c, t, g, unknown or other
  misc_feature (549)..(549): n is a, c, g, or t
tcagatagagtactcacgaccggtgctcgatttagtgtgagtagtttgggtttgggggcggcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctacttattgtgttaaaggcgagctggaatacgggaccggggccccgacttgaccacgtcggggccaggggacgctggtcaccgtctcctcagccctccaccaagggcccactcggtcttcccccgtggccaccctcctccaagacgcacctcgtggggccacagcacgccctgggctcgcctggtcaacggactacttccagtactctatctgaggcgggctggcacggcganatgnc

SEQ ID NO: 53459 - DNA, 727 bp, Homo sapiens
  misc_feature: GYAE6OF01DSGZL.29.78.H01.1.454.CMB.1.raw
  modified_base (287)..(287): a, c, t, g, unknown or other
  misc_feature (287)..(287): n is a, c, g, or t
  modified_base (716)..(716): a, c, t, g, unknown or other
  misc_feature (716)..(716): n is a, c, g, or t
  modified_base (722)..(722): a, c, t, g, unknown or other
  misc_feature (722)..(722): n is a, c, g, or t
tcagatagagtactcacgaccggtgctcgatttagtgtgagtagtttgggtttggtggtctctctcccagcctgtgctgactcaatccgccctctgcctctcgcctcccgtgggaggctcggtcaaggtcacctgtactctgagcagtggacacagcagctacgccatcgcttggcatcagcagaggccagacgacgggcccttcgttacttgatgacagtacaaacaatgatggacagtacacgaggacggaaaggggggacggactcccgtagactccgtcttcncgacgtcctccgagtcctcggtcggggcctggaccgtccgtcctaaccgtccaactaacgttcccgtcccggccctcgagttcgaggaggtactaggacgtcttacggactttacgttacgtcggtaccgacggtaccggtggggaccctacggtcggtacttacgtttaccggtacggggttcccggttaccggggaacccggggtaaccgtaacgggttccctacccgggttcggtccgggtaaccacccggtaaccccgaacgggtacccccaaaccccggtctttaccgtacccgtaccgttccccgttaccccggttacccccctacccgtttccaccgttaccgtttacctacccgtaacgttccggtaccgggacggtccggggtactcccggggaacgttaacccgggcctaaacggttanacggcngtacg

SEQ ID NO: 53460 - DNA, 581 bp, Homo sapiens
  misc_feature: GYAE6OF01BVIUY.29.78.H01.1.454.CMB.1.raw
  modified_base (337)..(337): a, c, t, g, unknown or other
  misc_feature (337)..(337): n is a, c, g, or t
  modified_base (407)..(407): a, c, t, g, unknown or other
  misc_feature (407)..(407): n is a, c, g, or t
tcagatagagtactcacgaccggtgctcgatttagtgtgagtagtttgggtttggagtctgcaccatggctcggaccccactcctcttcctcaccctcctcctccactgcacagggtctctctcccagcctgtgctgactcaatccgccctctgcctctgccctccctgggaggctcggtcaaggtcacctgtactctgagcagtggacacagcagctacgccatcgcttggcatcagcaggaggccagaccgaccgggcccttcgttacttgatgacagtacaaacaatgatggacagtcacgaggcgaagggggcggatccctagactcgcttcncagtcctccgagctcgtgggcctggacgcgtcctaccacacactcctcccggcctccgagtccagaggtntggacggtctaggacttagtaccgtgtcgaggtaccgtggggacctacggtgctacgttcgacggttccgtaccgggaccgggtactacggtccgacccgggttcgaccggtacgaccggacccgaaccggacccctaaccccgagttaccgaccctacgttcccgttaccccg

SEQ ID NO: 53461 - DNA, 608 bp, Homo sapiens
  misc_feature: GYAE6OF01DV58P.29.78.H01.1.454.CMB.1.raw
  modified_base (321)..(321): a, c, t, g, unknown or other
  misc_feature (321)..(321): n is a, c, g, or t
tcagatagagtactcacgaccggtgctcgatttagtgtgagtagtttgggtttggggtccgagccatggtgcagactccccagagctctcctcctcctccactgcacagggtctctctcccagcctgtgctgactcaatcgccctctgcctctgccctcccgtgggaggctcggtcaaggtcacctgtactctgagcagtggacacagcagctacgccatcgctggcatcagcagaggcagacacggcctgttactgatgacagtcaacaatgatggcagtcacgaggacggaagggggacggactccgtgactcgcttcncagtctcagtctcgtgggcctggacgccgtactacctcaactaactccgtcccggctccgagtcgtaggaggagtggacggtctagtacttaattacgtgtacacggtacccggtgggactacgtggtactagtttcgacgggttccggttaccggggaaccgggtaaccgtaacgggtcccgtaacccgggttcggtaccgggtaccaaccggaccccgtaaaccgggccccctaaacccccgtcgttaccggtaccctaccggtcccgttccggttacccccccg

SEQ ID NO: 53462 - DNA, 698 bp, Homo sapiens
  misc_feature: GYAE6OF01EOHL8.29.78.H01.1.454.CMB.1.raw
  modified_base (694)..(694): a, c, t, g, unknown or other
  misc_feature (694)..(694): n is a, c, g, or t
tcagatagagtactcacgaccggtgctcgatttagtgtgagtagtttgggtttgggggcgcctgggtacggccgggggggtcgctgagactctcctgtgcggcctctggattaagtttaggagtcatgccatgaactgggtccgccaggctccgagggaaggggctggagtgggtctcggctattagtggcaggtggtggcgctatatattatgcagaccgccctggaacgggccgttcacctatttccagagactaattcgaagaacacgctgtatctgacaaagtggagacgcctagacgactcgacgacgaccggtccgtacttatttagttaggtagttaaaggcgtagcgtagggacgtacggggacccgggcctagttcgaccgacggtcggggaccgagggggacgtcgtcggtccgtaccgtccgtcctcgacgtccctacccgaaccgaaccgggcccacgttcccgtcccgttcccccgtcggtccctacccctcctaccgaacgaccgcctaccgtccgggtacggggaccacgacgccgaccggcccgtcgggtcctccgggtcccgtagggtaccctaacgggtacccttacccgttaccgaaccgtttaccttaccgttaccgttcggtacggaacgggtccgggtccggacgggtaccgaacgggccgacgtacgtagngacg

SEQ ID NO: 53463 - DNA, 576 bp, Homo sapiens
  misc_feature: GYAE6OF01BVUMW.29.78.H01.1.454.CMB.1.raw
  modified_base (283)..(283): a, c, t, g, unknown or other
  misc_feature (283)..(283): n is a, c, g, or t
  modified_base (380)..(380): a, c, t, g, unknown or other
  misc_feature (380)..(380): n is a, c, g, or t
  modified_base (575)..(576): a, c, t, g, unknown or other
  misc_feature (575)..(576): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatgganagcctgagactcgacgacacggccgtctattattgtgttaaaggcgagctggaatacgggaccggggcccgacttgaccactggggccaggggaccncgtggtcaccgtctcctcacgcctccaccaggcccagtcgtcctccccctggccaccctcctccaacgacgcctacctcgtcgggggccacgacgccacgcccgtggggcctcggcccgttggtccgaaggtacctaccttcccaacgttcctactagtctggacgccgggctcggcgaacgggcgacgactggnn

SEQ ID NO: 53464 - DNA, 581 bp, Homo sapiens
  misc_feature: GYAE6OF01CRTCB.29.78.H01.1.454.CMB.1.raw
  modified_base (483)..(483): a, c, t, g, unknown or other
  misc_feature (483)..(483): n is a, c, g, or t
  modified_base (578)..(578): a, c, t, g, unknown or other
  misc_feature (578)..(578): n is a, c, g, or t
tcagatagagtactcacgaccggtgctcgatttagtgtgagtagtttgggtttgggggcgcctgggtacgggccgggggggtcgctgagactctcctgtgcggcctctggatttaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgacaaatggagagcctgagactcgacgacacggccgtctattatgtagttaaaggcgagctggaagtacggggacccggggcccgacttgaccacgtggggaccagggggacgcgtcggtccaccggttctccgtcacgccctacccaaccgaacgggcccatccggtccttcccccctggcccaccctcctccaagcgcacctcgnggggcacagcacgcccgtgggctcgcctggtacgaacggactaccttccacgtacctctacgtctgacggcggcgtcggcgaacggcgacagtgngcg

SEQ ID NO: 53465 - DNA, 603 bp, Homo sapiens
  misc_feature: GYAE6OF01C6W5G.29.78.H01.1.454.CMB.1.raw
  modified_base (151)..(151): a, c, t, g, unknown or other
  misc_feature (151)..(151): n is a, c, g, or t
tcagatagagtactcacgaccggtgctcgatttagtgtgagtagtttgggtttgggtccggagccatggtgcagacctccccaggagctctcctccctcctccactgcacagggtctctctcccagcctggtgctgactcaatcgcccttntgcctctgcctccctgggacgctcggtcaaggtcaccgtggtaactctgacgcagtggacacgagcagctacgccatcgcttggcatcagcagagccagacacggcctcgtacttgatgacagtcaacatgatggcaggtcagaggacgaagggggaccgatcccgtgactcgtcttctcgaggtcctccgagtctcgtcgggccttaggacgccgtctaccctcaactacgtcccgtcccggccctaccgagttccgtaggtaggattggtacggtctaggtacttaagttaccgtacgtaacgacgtaccggtcggggactacgtcggacttagtcggacggttccgttaccgggaccgggtaacctaggtccaaccggtcggtccggtacaccggtacccgaacggaccccaacccgtcgttacgtactacctcgttcccgttaccccc

SEQ ID NO: 53466 - DNA, 722 bp, Homo sapiens
  misc_feature: GYAE6OF01AURKE.29.78.H01.1.454.CMB.1.raw
  modified_base (313)..(313): a, c, t, g, unknown or other
  misc_feature (313)..(313): n is a, c, g, or t
tcagatagagtactcacgaccggtgctcgatttagtgtgagtagtttgggtttgggggcgcctgggtacggccggggggtcgctgagactctcctgtgcggcctctggatttaagtttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgacaaatggagagcctgacgactcgacgacgacggccgtntattatgtagttaaaggcgagctaggaacgtaaccggggacccggggacccgtacgttcgacccgacggtcgggggacccgaagggggaccgcgtcggttccgacccggttccttcccgtaccgacgccccgtacccgaacccggaaacgggcccctacgttcccggttccctttcccccccgtcgggtacccctacccctcccgtacccaacgaccgccctacccgtaccggtcggggacccaccgacgtacccgacgcccgtcgggccgtcgtcccgtcggttaccgaacgggtacccttaacccgttcccgtaacgttaccgttaccgttaacgttccgtacgggtaccggcccggggtccgttaccgggaacgtaaccggggccggacgtaacggttagccgtag

SEQ ID NO: 53467 - DNA, 614 bp, Homo sapiens
  misc_feature: GYAE6OF01DGD1M.29.78.H01.1.454.CMB.1.raw
  modified_base (252)..(252): a, c, t, g, unknown or other
  misc_feature (252)..(252): n is a, c, g, or t
  modified_base (474)..(474): a, c, t, g, unknown or other
  misc_feature (474)..(474): n is a, c, g, or t
  modified_base (486)..(486): a, c, t, g, unknown or other
  misc_feature (486)..(486): n is a, c, g, or t
  modified_base (508)..(508): a, c, t, g, unknown or other
  misc_feature (508)..(508): n is a, c, g, or t
  modified_base (602)..(602): a, c, t, g, unknown or other
  misc_feature (602)..(602): n is a, c, g, or t
tcagatagagtactcacgaccggtgctcgatttagtgtgagtagtttgggtttggggggaagaggaagactgacggtccacccctgggatcttcaggtgttttcatttggtgatcaggacggaacagagagaactcaccatggagtttgggctgagcgtgtcgttttctggtggctaattttaaaaggtgtcagtgtgacgtgcagttgggtggagtcgtgggggcgcctggggtacgggccgggggggtcnctgagactctcctgtgcggcctcgtggtattaagttttaggagtcaatgccatgaacgtgggtcccgccaggctccgagggaaggggctgggaggtgggtctcggcttagttaggtggcgaggtggtggcgtctaatattattatgcaggaccgcccgtaggaacgggcggttaccactatttccaagacgaactaacgtacgaaagaacacggctgtatcngacaagtggaangcctagacgtactacgacgacncggtccgtctattattgtagtaaggctagcgtaggaacggtacgggacccgggccgtacgttacggaaccgcggtcgggggaccgaggggaccncggtcgggtccc

SEQ ID NO: 53468 - DNA, 636 bp, Homo sapiens
  misc_feature: GYAE6OF01CGNUN.29.78.H01.1.454.CMB.1.raw
  modified_base (632)..(632): a, c, t, g, unknown or other
  misc_feature (632)..(632): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacggggacccgggcccgacttcgaccactcgggggccaggggacgcgtggtcaccgtctcctcacgccctccaccgaagggcccagtccgtccttcccccgtcggcccaccctcctaccaacgacgccaccctcgtcgggggccacgacgaccacggcccgtcggggccgtcggcccgttcgggtaccgaaacggtaccttaaccgttcccgtaacgttaaccgttccgttaacgttccgtacggacggtccggggaccgtcgggtaccgaaacggggccgaccgaagtacgntacg

SEQ ID NO: 53469 - DNA, 630 bp, Homo sapiens
  misc_feature: GYAE6OF01EIA76.29.78.H01.1.454.CMB.1.raw
  modified_base (181)..(181): a, c, t, g, unknown or other
  misc_feature (181)..(181): n is a, c, g, or t
  modified_base (191)..(191): a, c, t, g, unknown or other
  misc_feature (191)..(191): n is a, c, g, or t
  modified_base (205)..(205): a, c, t, g, unknown or other
  misc_feature (205)..(205): n is a, c, g, or t
  modified_base (212)..(212): a, c, t, g, unknown or other
  misc_feature (212)..(212): n is a, c, g, or t
  modified_base (349)..(349): a, c, t, g, unknown or other
  misc_feature (349)..(349): n is a, c, g, or t
  modified_base (359)..(359): a, c, t, g, unknown or other
  misc_feature (359)..(359): n is a, c, g, or t
  modified_base (422)..(422): a, c, t, g, unknown or other
  misc_feature (422)..(422): n is a, c, g, or t
  modified_base (443)..(443): a, c, t, g, unknown or other
  misc_feature (443)..(443): n is a, c, g, or t
tcagatagagtactcacgaccggtgctcgatttagtgtgagtagtttgggtttggggtctgagagaggagtccacccctgggatcttcaggttgttttcatttggtgatcaggacggaacagagagaactcaccatggagtttgggctgagcggtgtgtttctaggtcgctatttaaaggngtcagtgtgngtgcagtgtgagtntggggcnctggtacggccggggggtgctgagactctcctgtgcggcctgtggtatttaagttttaggattcatcgccaatgaacttgggtccgccaggcctccgaggggaagggctgggaggtggggtctcggatagttgtggntgtgtgtcgntatatatagtgcgagcgccgtaggacggtccgtactactattacgagactaactagtacgaanaacgcgtattagtacttcganacgtaagtaggacgacgtacgtagtacgacgtacgaacgacgacggtaccgtacgttatttagttaggttacggttaaggtacggtacgtacgtacgggtaacgggtaccggggtacccgggtacccggtaccgtaccggtacccggtaccggtaccgggacgggacgggaccggtcggtcggtccg

SEQ ID NO: 53470 - DNA, 657 bp, Homo sapiens
  misc_feature: GYAE6OF01DLTMN.29.78.H01.1.454.CMB.1.raw
  modified_base (653)..(653): a, c, t, g, unknown or other
  misc_feature (653)..(653): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtagttaaaggcgagctaggaagtacggggacccggggcccgacttcgaccacgtcgggggccgaagggggacgcgtggtccaccgtctccctcacgtccctccaaccgacgggcccacgtccggtccttccccccgtcggcccaccctccctaccaacgtacgccacccgtcgtcggggccacgacgcacgcccgtcgggcctcggtcccgtcgggtaccgaacgggtaccttaaccgttaccctaacggttacccttacgttaacgttccgttagggaacgggtcccggggtccgttacggggacgtaaccggggaccgtaccaacggttagngacg

SEQ ID NO: 53471 - DNA, 836 bp, Homo sapiens
  misc_feature: GYAE6OF01ECBMX.29.78.H01.1.454.CMB.1.raw
tcagatagagtactcacgaccggtgctcgatttagtgtgagtagtttgggtttggggtctgagagaggagtccacccctgggatcttcaggtgttttcatttggtgatcaggacggaacagagagaactcaccatggagtttgggctgagctggtctttttcttgtggcttaattttaaaaggtgtccagtgtgacgtgcagttggtggagtcgtgggggcgccgtgggtacgggccggggggtcgcgtgagactctcctgtgcggcctcgtggtatttaagtttaggagtcatgccatgaacgtgggtccgccgaggcctccggaggggaaggggcgtgggaggttcggggtcgtcggtacttagttaggtggcgtagggtgggtcggcgtacttaattaagtacgtttaagtggaccgtaacggacccgaccccgttagggaaaccgggggtccccggtttaccaacccgttaacgttttacccgaaggtaacgtaaccgtaaacgtttaccggaaaacggaaacccgtaccggtacctttaggttaacttccgttaagaacgtaaaagttcgggaaagtaccggtacccgttagggaacggtacccgttaacgggaacccggtaacccggtaacccggggtaccccggtttacttttaaagttttagttacgggtttaaggttaaaacggggcgtaagggtaccgttaaggggtaaaaccgggttacccggggggaacccccgggggtaccccgttacggtttacccgggaaccccgtacggggtccgggggaccccgggaagggggtacccgtcggttaccgggttaccccg

SEQ ID NO: 53472 - DNA, 614 bp, Homo sapiens
  misc_feature: GYAE6OF01B7TU7.29.78.H01.1.454.CMB.1.raw
  modified_base (322)..(322): a, c, t, g, unknown or other
  misc_feature (322)..(322): n is a, c, g, or t
  modified_base (394)..(394): a, c, t, g, unknown or other
  misc_feature (394)..(394): n is a, c, g, or t
  modified_base (492)..(492): a, c, t, g, unknown or other
  misc_feature (492)..(492): n is a, c, g, or t
  modified_base (611)..(611): a, c, t, g, unknown or other
  misc_feature (611)..(611): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgcctgaagggccgttcacattccagagacaatcgaagaacacgctgatctgacaatggagagcctgagactcgacgacacggcgtctattattgtacgttaaagngagcgtagaagtaccgggaccgggccgtacttgaccacggtggggaccgaggggacgcgtggaccaccgtcncctcagccctccgaaccgacgggacccacgtaccggtccttcccccgtgcccctacccctcctaccgaagacgccaaccgtcggtacggggccaacgngtaccacgtccccgtagggccctcgcccgttggacctaacggtaccttaaccgttcctaacgtacctacgttactcgtagacggtcgggcgttagggaccgtaacggcgacgtagtggntcg

SEQ ID NO: 53473 - DNA, 719 bp, Homo sapiens
  misc_feature: GYAE6OF01AE8AE.29.78.H01.1.454.CMB.1.raw
  modified_base (405)..(405): a, c, t, g, unknown or other
  misc_feature (405)..(405): n is a, c, g, or t
  modified_base (717)..(717): a, c, t, g, unknown or other
  misc_feature (717)..(717): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgccaggctccagggaagggctggagtgggtctcggctattagtggcagtggtggcgctatatattatgcagacgccctggaacgggccggttcacctatttccagagacaattacgaagaacacgctgtatctgacaaagtggagagcctagagactcgacgacaccggtccgtactattagtgttaggtaaggcgagcgtaggaacgtaccggggacccgggccgtacgttcgaccgtacggtggggaccgagggggaccncggtacggtccgtacccggttcctcccgtacgaccgtccccgtacccgaacccgaaccggggcccgtacgtcccggttaccccttccccccgtacggacccccgtaccccttaccccgtaaccgaacggtacccgtacccgtacccgttaccgggtcggggaccaccggtacgaccgtacccgtcccgggtcgggtcctacggtcccggtacgggtacctaaccgggtacccttaccgttaccaacgttaccgttacctacgttccgtcggacgggtccggtacgtacgggacgacggtccctagaacgtgngc

SEQ ID NO: 53474 - DNA, 619 bp, Homo sapiens
  misc_feature: GYAE6OF01DDBIC.29.78.H01.1.454.CMB.1.raw
  modified_base (184)..(184): a, c, t, g, unknown or other
  misc_feature (184)..(184): n is a, c, g, or t
  modified_base (221)..(221): a, c, t, g, unknown or other
  misc_feature (221)..(221): n is a, c, g, or t
  modified_base (244)..(244): a, c, t, g, unknown or other
  misc_feature (244)..(244): n is a, c, g, or t
  modified_base (267)..(267): a, c, t, g, unknown or other
  misc_feature (267)..(267): n is a, c, g, or t
  modified_base (363)..(363): a, c, t, g, unknown or other
  misc_feature (363)..(363): n is a, c, g, or t
  modified_base (500)..(500): a, c, t, g, unknown or other
  misc_feature (500)..(500): n is a, c, g, or t
tcagatagagtactcacgaccggtgctcgatttagtgtgagtagtttgggtttggggtctgagagaggagtccacccctgggatcttcaggtgttttcatttggtgatcaggacggaacagagagaactcaccatggagtttgggctgagcgtgtcgttttctaggtggctaattttaaaaggngtcagtgtgacgtgcagttggtggagtcgtgggggcnccgtgggtacggccggggggtcncgtgagctctcctgtgcggcctntggattaagtttgagtcatgccatgaactgggtccgcgaggcctcgaggggaacgggctggagtgggtctcggctagttggtgcgagtggtggcgntatatattatgcagacgtcccgtgaacgggccggttacacctatttccagagaactaattcgaaagaacacgctgtatactgaacaaagtggaagacgccgtagaacgtacgtcgaacgaccgaccggtacccgttnttaagtttagttaggttagtaaaggtcgtagacgtagggtaaacgggtaccggggacccgggtacccggtacgtaccggaccgacgggtacgggacggaggggaccgtcgtccggtccg

SEQ ID NO: 53475 - DNA, 520 bp, Homo sapiens
  misc_feature: GYAE6OF01EP3BG.29.78.H01.1.454.CMB.1.raw
  modified_base (146)..(146): a, c, t, g, unknown or other
  misc_feature (146)..(146): n is a, c, g, or t
tcagatagagtactcacgaccggtgctcgatttagtgtgagtagtttgggtttggggtccgagccatggtgcagactccccagagctctcctcctcctccactgcacagggtctctctcccagcctgtgctgactcaatcgccctntgcctctgcctccctgggaggctcggtcaaggtcacctgtactctgagcagtggacacagcagctacgccatcgcttggcatcagcagaggccagacacgggccctcgttacttgatgacagtcaaacaatgatggcagtcacagcgaaagggggacggatccctgactcgcttctcagtctccagctcgtgggcctgagcgctactcacaatctccgcctcagtctgagatgagctgactattactgtcaggaccgtggggcacgtggctatttccgaggtccgttacgggacccgggtaccaacggtccgaccgtcggtcggtacacgcccgaacggcccaaccccgtactacgtccacttctccgttcccc

SEQ ID NO: 53476 - DNA, 632 bp, Homo sapiens
  misc_feature: GYAE6OF01CO4BJ.29.78.H01.1.454.CMB.1.raw
  modified_base (395)..(395): a, c, t, g, unknown or other
  misc_feature (395)..(395): n is a, c, g, or t
  modified_base (449)..(449): a, c, t, g, unknown or other
  misc_feature (449)..(449): n is a, c, g, or t
  modified_base (626)..(626): a, c, t, g, unknown or other
  misc_feature (626)..(626): n is a, c, g, or t
  modified_base (628)..(628): a, c, t, g, unknown or other
  misc_feature (628)..(628): n is a, c, g, or t
tcagatagagtactcacgaccggtgctcgatttagtgtgagtagtttgggtttgggggcgcctgggtacgggccgggggggtcgctgagactctcctgtgcggcctctggattaagttttaggagtcatgccatgaactgggtccgccaggctccgagggaaggggctggagtgggtctcggctattaggtggcaggtggtggcgctatatattatgcagacgccctagaacgggccgttcacctattccagagacattcgaagaacacgctgtatctgacaagtggagacgcctgacgactcgacgacgaccggtccgtatattattgtagttaagcgagcgtagaagtacgggccgggccgtactcgaccgaacggtcgggaccgaggggacncgtggtccacgtctcctcacgcctccgacgacggcccagtccgtccttccccgnggccctaccctcctaccgagacgcctaccgtcggtacggggacaacgcgacgaccggccgtacgggcctcggccttacggacgaacggtaccttaccgtaccgtacgtaccgttacttacgccgttagggaaccggtccgggaccgtacgggaccgtaaacgggccgtagtaacggngngacg

SEQ ID NO: 53477 - DNA, 622 bp, Homo sapiens
  misc_feature: GYAE6OF01AZMHP.29.78.H01.1.454.CMB.1.raw
  modified_base (463)..(463): a, c, t, g, unknown or other
  misc_feature (463)..(463): n is a, c, g, or t
  modified_base (619)..(619): a, c, t, g, unknown or other
  misc_feature (619)..(619): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattatgtgttaaaggcgagctggaatacggggaccggggcccgacgttgaccgtacgtcgggggccgagggggacgcgtggtccaccggtctcctcgacgccctaccaccgaacgggcccagtccgtccttcccccgtcggccaccctcccnccaacgacgccacccgtccgtcggggccacgacgccacgcccgtcgggccgtcggtcccgtcggtacgaacggtaccgttaccgttacctacgtaccttcttaacgtctaggacgggtccggggacgtcgggacgtaacgggaccgacgtacgtgngcg

SEQ ID NO: 53478 - DNA, 585 bp, Homo sapiens
  misc_feature: GYAE6OF01ESH8S.29.78.H01.1.454.CMB.1.raw
  modified_base (583)..(583): a, c, t, g, unknown or other
  misc_feature (583)..(583): n is a, c, g, or t
  modified_base (585)..(585): a, c, t, g, unknown or other
  misc_feature (585)..(585): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccaggggaaggggctggagtgggtctcggctattagtggcagtggtggcgctatatattatgcagacgccctgaagggccggttcaccatttccagagacaattcgaagaacacgctgtatctgacaaatggagagcctgagactcgacgacacggccgtctattattgtgttaaaggcgagctggaagtacgggaccgggcccgacttcgaccacgtcggggccgaggggacgtcgtggtccaccgtctcctcacgcctccaccgacggccacgtccgtccttcccccgtggcccaccctcctccaacgcgcacctcgtcggggcacgacgcacgccgtcggctcgtccgtcggtacaacggtactaccgtcacgttacctctacgtcgttaggacggtcgggcgtcggaccgtaacgggcacgagtagngn

SEQ ID NO: 53479 - DNA, 621 bp, Homo sapiens
  misc_feature: GYAE6OF01EM40I.29.78.H01.1.454.CMB.1.raw
  modified_base (404)..(404): a, c, t, g, unknown or other
  misc_feature (404)..(404): n is a, c, g, or t
  modified_base (611)..(611): a, c, t, g, unknown or other
  misc_feature (611)..(611): n is a, c, g, or t
  modified_base (618)..(618): a, c, t, g, unknown or other
  misc_feature (618)..(618): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggtcggttcaccatttccagagacaattcgaagaacacgctgtatctgcaaatggagagcctgagactcgacgacacggccgtctattattgtgttaaaggcgagctggaacgtacgggaccggggcccgacttcgaccacgtggggaccgaggggacgcgtcggtcaccgtctccncgacgcctccaaccgaacgggcccacgtccggtccttcccccgtcggcccaccctccctaccaacgacgccaccctcgtcggggccacgacgcgacgcccgtgggcctcgtccgttcggtaccgaacggtaccttaccgttaccctaacgttaccgtacttacgttcgtacggacggtccggggcgtcgggaccgtaacgggccganacgtagngcg

SEQ ID NO: 53480 - DNA, 628 bp, Homo sapiens
  misc_feature: GYAE6OF01EP0EJ.29.78.H01.1.454.CMB.1.raw
  modified_base (625)..(625): a, c, t, g, unknown or other
  misc_feature (625)..(625): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgacaaatggagagcctgagactcgacgacacggccgtctattattgtagttaaaggcgagctgggaatacggggacccggggcccgacttcggaccacggtcggggaccgagggggacgcgtcgggtccacccggtctcccgcacgccctaccacccgaacgggccccaacgtcccggtccttccccccgtggtccccaccccttcccgtacccaacggacgccctacccgtccggtcggggaccacgacgccacgcccgtcgggcctcgtccgtggtaccaacggaccttaccgttccaacgtacctaccttacgtcgtgacggtcgggctggacgaacggcagacgtgntcg

SEQ ID NO: 53481 - DNA, 613 bp, Homo sapiens
  misc_feature: GYAE6OF01ERYY2.29.78.H01.1.454.CMB.1.raw
  modified_base (386)..(386): a, c, t, g, unknown or other
  misc_feature (386)..(386): n is a, c, g, or t
  modified_base (611)..(611): a, c, t, g, unknown or other
  misc_feature (611)..(611): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccgttcaccatttccagagacaattcgaagaacacgctgtatctgcaaatggagagcctgagactcgacgacacggccgtctattattgtgttaaaggcgagctaggaagtacgggcccgggcccgacttcgaccgacgtcggggccaagggggacncgtggtccaccggtctacctcgacgccctacccaaccgaacgggcccacgtccggttccttccccccgtcggtccctacccctcccgtaccaaacgacgcctacccgtccgtacggggtaccacgacgacgacgacccgtcgggcgtcgccgtcggtacgaacggtactaccttccgacgtacctactactctagacggcgggcgtggacgtaacggcgacatgncg

SEQ ID NO: 53482 - DNA, 503 bp, Homo sapiens
  misc_feature: GYAE6OF01DETHD.29.78.H01.1.454.CMB.1.raw
  modified_base (428)..(428): a, c, t, g, unknown or other
  misc_feature (428)..(428): n is a, c, g, or t
  modified_base (446)..(446): a, c, t, g, unknown or other
  misc_feature (446)..(446): n is a, c, g, or t
  modified_base (480)..(480): a, c, t, g, unknown or other
  misc_feature (480)..(480): n is a, c, g, or t
  modified_base (500)..(501): a, c, t, g, unknown or other
  misc_feature (500)..(501): n is a, c, g, or t
  modified_base (503)..(503): a, c, t, g, unknown or other
  misc_feature (503)..(503): n is a, c, g, or t
tcagatagagtactcacgaccggtgctcgatttagtgtgagtagtttgggtttggtggtctctctcccagcctgtgctgactcaatcgccctctgcctctgcctccctgggaggctcggtcaaggtcacctgtactctgagcagtggacacagcagctacgccatcgcttggcatcagcagaggccagacacgggccctcgttacttgatgacagtcaacaatgatggcagtcacagcgaaagggggcggatccctgatcgcttctcagtctccagcctctggggcctgagcgctacctcacaactcctccggcctccagtctgaggatgaggctagacttattacgtgtcagccgtggggcacgtggcattcgaggtcgttcggaacgggacaaggtcaccgtcgtcgcacgcccaagcccaacccntcgcactcgtcgttcccnccctctcacgttactctagtctcggaggccgggntcgggcaacgggcacatagnngn

SEQ ID NO: 53483 - DNA, 576 bp, Homo sapiens
  misc_feature: GYAE6OF01AXSVJ.29.78.H01.1.454.CMB.1.raw
  modified_base (574)..(574): a, c, t, g, unknown or other
  misc_feature (574)..(574): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattatgtgttaaaggcgagctggaatacggggaccgggccgacttgaccactggggccaggggacgctggtcaccgtctcctcagcctccaccaacgggcccatccggtcttcccccctggcccaccctccctccaacgacgccacctcgtcgggggcacgacgccacgcccgtagggcctcgcccgtggtcaacgggacctaccttccgacgtacctactacgtcgtgacggcgggcgtcggacgaacgggcgacgactgncg

SEQ ID NO: 53484 - DNA, 701 bp, Homo sapiens
  misc_feature: GYAE6OF01AEHHV.29.78.H01.1.454.CMB.1.raw
tcagatagagtactcacgaccggtgctcgatttagtgtgagtagtttgggtttggggcgcctgggtacggccggggggtcgctgagactctcctgtgcggcctctggattaagttttaggagtcatgccatgaactgggtccgccaggctccagggaagggctggagtgggtctcggctattagtggcagtggtggcgctatatattatgcagacgcctgaagggccgttcaccattccagagacatcgaagaacacgctgtatctgacaaagtggacgagcctgacacgtcgacgacacggccgtctattattgagttaaaggcagacgtaggaacgtaccggggaccggggcccgacgttcgacccacggtcggggacccgagggggaccgcgtcggtaccaccggttcctccctcgacgtccctcccgaccgaaccggggccctacgtccggttccccttcccccgtcggacccctaccccgttccctacccgaaacggacctccgtacccggtccggtaccgggggacccaccgaacggtacccgaccggtccccggttcgggcccgtcggtcccggtacgggtaccgaacggtaacccgtttaccgtacccgtacgttacccgttacgtaccgttccggtaggtacgggccggggtaccgttcgggaccggaacgggtcccgacgaacgtgccgag

SEQ ID NO: 53485 - DNA, 696 bp, Homo sapiens
  misc_feature: GYAE6OF01ED4ZX.29.78.H01.1.454.CMB.1.raw
tcagatagagtactcacgaccggtgctcgatttagtgtgagtagtttgggtttgggggcgcctgggtacggccgggggggtcgctgagactctcctgtgcggcctctggattaagtttaggagtcatgccatgaactgggtccgccaggctccgaggggaaggggctggagtgggtctcggctattaggtggcaggtggtggcgctatatattatgcagaccgccctaggaacgggccggttacaccgtactttccagacgaactaacttcggaaaagaaccacgctagtactctgaacaagtggagagcctgacgactacgacgacgcggtcgtctattacttgtagttaaacggcgtagcgtaggaacgtaccggggacccgggaccgtacgttcggaccgtacggtcggggaccgacggggacgtcgtcggtcctaccggtctcccgtacgacgtcccgtaccgaccgaacgggccctacgttcccggtcccttcccccgtcgacccctaccctcccgtacccgaaggaccgacccgtaccgtccgggtcgggacctaccgacgcgaccgcccggtaggtcctcggaccgttcggtacgtaaccggtacccttaccgtaccgtaccgttactacttacgtcgttacggacggtccgggtacgtacgggaccgaacgggccatacggtagcgtg

SEQ ID NO: 53486 - DNA, 622 bp, Homo sapiens
  misc_feature: GYAE6OF01CMPOD.29.78.H01.1.454.CMB.1.raw
  modified_base (614)..(614): a, c, t, g, unknown or other
  misc_feature (614)..(614): n is a, c, g, or t
  modified_base (620)..(620): a, c, t, g, unknown or other
  misc_feature (620)..(620): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtagttaaaggcgagctggaagtacggggaccggggcccgacgttcgaccacgtcggggccgaggggacgcgtggtccgaccgtctcctcacgccctccaccgaacgggcccacgtccggtccttcccccgtcggccctacccctccctaccaacgacgcctacccgtcggtcggggccacgacgccgacgcccgtagggcctcggtcccgtggtacgaacggtccttaaccgttcccaacgtaccttacttacgtcgtgggacggtccggggccgtgggaccgaaacgggccganacgtgncg

SEQ ID NO: 53487 - DNA, 868 bp, Homo sapiens
  misc_feature: GYAE6OF01ET34N.29.78.H01.1.454.CMB.1.raw
tcagatagagtactcacgaccggtgctcgatttagtgtgagtagtttggggtttgggagagctctggggagtctgcaccatggctcggaccccactcctcttcctcaccctcctcctccactgcacaggtctctctcccagcctgtgctgactcaatccgccctctcgcctctcgccctcccgtggggacgccgtcggtacaacggtccaccttgtacctcgtagacgcaggtcggacacgagcacgacctacgcctagtcgtcgtggctactcgagcgaggacgaccagaccgaccggtcctcgttactgacgtgacgactacaaactagtagacgtgactacgtacaacgacggacgggtaacgggggaccgtaccgtccgtagtacgttcgtacttcgtacgtacgttcccgtacgttacggcccgtttacggtcggtacccgttaggaacccggtccgtacccgttaacccgtacctaaccgttaaccgttccccgggtaaccccggtacccgttacccggtaacggttccggtaagggtaaccgggttacgtaaccggggttaacggtccgtttaacggtaacccgtttaacgtttaccggtaacgttaccccggtaaacgggtacccggggttcgggtaacccgttaacgggtacccggttaaccgttaccggtttacccggttaacccgggggtttacccgggttaaccccggggggtaaaccccggggttaaaccccggtaacggggtttaacccccggtacccgggggttttacccgtaacccccggggtttaacccgaaacccggggttaaccccccggaaacccgggtaaccccccgtaaacccccggttaaccggg

SEQ ID NO: 53488 - DNA, 690 bp, Homo sapiens
  misc_feature: GYAE6OF01B8EW2.29.78.H01.1.454.CMB.1.raw
  modified_base (689)..(689): a, c, t, g, unknown or other
  misc_feature (689)..(689): n is a, c, g, or t
tcagatagagtactcacgaccggtgctcgatttagtgtgagtagtttgggtttgggggcgcctgggtacggccgggggggtcgctgagactctcctagtgcggcctctggattaagttttaggagtcatgccatgaactgggtccgccaggctccgagggaaggggctggagtggtctcggctattagtggcagtggtggcgctatatattatgcagacgccctaggaagggccggttcacctatttccagagacaattcgaagaacacgctgtatctagactaagtggagacgctagacgacgcggaccgaccgaccggccgttactattagttaggttaggttaaggacgtagacgtaggaacggtaccggggacccgggccgtacgttcgaccgacggtcgggaccgacggggccgtcgtcggtccgtaccgtctcctcgacgtccctacccgaccgaaccgggaccctacgttcccggttccccttacccccgtacggacccctaccctacccgtaccgaacggacgacccgtaccgtccgggtcgggaccacgacgaccgtaccggtcccggtcggtccgtccggtccgtcggtacgtaacggtacctaccgttaccgtacgtacctacgttacgtcgtaggacggtccggtacgtacggacggtacggcgtacgtacgtgtgng

SEQ ID NO: 53489 - DNA, 705 bp, Homo sapiens
  misc_feature: GYAE6OF01AOJE0.29.78.H01.1.454.CMB.1.raw
  modified_base (315)..(315): a, c, t, g, unknown or other
  misc_feature (315)..(315): n is a, c, g, or t
  modified_base (701)..(701): a, c, t, g, unknown or other
  misc_feature (701)..(701): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatattattatgcagacgccctgaagggtccggttcaccatttccagagacaattcgaagaacacgctgtatctgacaaatggagagcctgacgactcgacgacacggccgtntaattagttgtagttaaaggcgagctagggaacgttaccgggggacccggggccctaacgttcgaacccgtacggtcgggggaccgtaaggggggaccgtccgtacgggtacctaacccggttcctacccgtccgaaccgtcccctacccgaacccggaaccggggtccccaacgttcccggttccccttccccccgtcggcccctaccccgtccctaccgaacgacgccctacccgtcggtcggggaccacgcgaccgtaccggcccgtacgggccgtccgtaccggttccggtaaccgtaacggtacccttaccgtacccgtacgttaacccttctacgtccgtagggaccggtcgggccgttggacgaacggccgacagtagngtcg

SEQ ID NO: 53490 - DNA, 717 bp, Homo sapiens
  misc_feature: GYAE6OF01E50I1.29.78.H01.1.454.CMB.1.raw
  modified_base (711)..(711): a, c, t, g, unknown or other
  misc_feature (711)..(711): n is a, c, g, or t
  modified_base (715)..(717): a, c, t, g, unknown or other
  misc_feature (715)..(717): n is a, c, g, or t
tcagatagagtactcacgaccggtgctcgatttagtgtgagtagtttgggtttggtggtctctctcccagcctgtgctgactcaatcgccctctgcctctgcctccctgggaggctcggtcaaggtcacctgtactctgagcagtggacacagcagctacgccatcgcttggcatcagcaggacggccagaccgaccgggtccctacgttacttgatagacagtacaacaatgagtggcagtacgacgacggacgggaacggggacggtacctccgtagtctcgtcttctacgtacgtcctccgagtccgtcggcggtccgtcgaccgtaccgtaccctacctacctaacctaccgtccccgtacccggtaccttacgacgtcgtaggaggtacgtcgggtaacgtccgttaacgtaaccgtttacgtaccgtacgtacggaccgggtaccggtcggtacgttacggtacggttaccgttacgggttaccggtaccggggttacccgggtaaacccgggacccggggtactaaccgggttcccgtaccgggttacccgaccggtacccacccgggaccccgtaacccgtaccccgtaacccgtccgttaccgtaccccgttcccgttccccgttacccgttcccccgtcctaccgttactaaccgttctccgtaggccggtcggacgtccgggtgaccgacgtacgactancgannn

SEQ ID NO: 53491 - DNA, 696 bp, Homo sapiens
  misc_feature: GYAE6OF01CKOMR.29.78.H01.1.454.CMB.1.raw
  modified_base (397)..(397): a, c, t, g, unknown or other
  misc_feature (397)..(397): n is a, c, g, or t
  modified_base (695)..(695): a, c, t, g, unknown or other
  misc_feature (695)..(695): n is a, c, g, or t
tcagatagagtactcacgaccggtgctcgatttagtgtgagtagtttgggtttgggggcgcctgggtacggccgggggggtcgctgagactctcctgtgcggcctcgtggaagttaagtttaggagtcatgccatgaactgggtccgccaggctccgagggaaggggctgggagtgggtctcggctattagtggcagtggtggcgctatatattatgcagacgccctggaagggtcgttcaccatttccagagacaattcgaaagaacacgctgtatctgacaaatggagagcctgagactcgacgacacggccgtactattattggtagttaaaggcgaagctagggaagtacggggccggggaccacgttcgaccacggtggggccagggggacncgtggtacccaccgttctccgtacacggtccctaccgaaccgaacgggaccctaaggtcccgtcccgttcccccgtcgggtccccaccccgtccgtaacccgaacggaccgaccgtaacccgttcgggtacgggggaccaacgacgtacccgaacggcccggttaggggccctcgggtccgttacgggtaaccgaacgggtacccttaaccgtttccgaacggttaccttccgtttaacgtccgttagggaccggggtaccgggtcgtcgggaaccgtacgggacgacctaagtgcgng

SEQ ID NO: 53492 - DNA, 539 bp, Homo sapiens
  misc_feature: GYAE6OF01ELKKK.29.78.H01.1.454.CMB.1.raw
  modified_base (480)..(480): a, c, t, g, unknown or other
  misc_feature (480)..(480): n is a, c, g, or t
  modified_base (520)..(520): a, c, t, g, unknown or other
  misc_feature (520)..(520): n is a, c, g, or t
  modified_base (535)..(535): a, c, t, g, unknown or other
  misc_feature (535)..(535): n is a, c, g, or t
  modified_base (539)..(539): a, c, t, g, unknown or other
  misc_feature (539)..(539): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccggggcccgacttgaccactgggggccaggggacgctggtcaccgtctcctcagcctccaccaagggcccatccggtccttccccctggcccaccctcctccaacgacgccacctctggggcacagcagcccgngggctgcctggtcaaggactacttccagtactctatctgngcggctggacaggcnatgn

SEQ ID NO: 53493 - DNA, 573 bp, Homo sapiens
  misc_feature: GYAE6OF01DVJ3V.29.78.H01.1.454.CMB.1.raw
  modified_base (388)..(388): a, c, t, g, unknown or other
  misc_feature (388)..(388): n is a, c, g, or t
tcagatagagtactcacgaccggtgctcgatttagtgtgagtagtttgggtttggggtccgagccatggtgcagactccccagagctctcctcctcctccactgcacagggtctctctcccagcctgtgctgactcaatcgccctctgcctctgcctccctgggaggctcggtcaaggtcacctgtactctgagcagtggacacagcagctacgcaatcgcttggcatcagcagagccagacgacggcctcgttacttgatgacagtacaacaatgatggcagtcacgagacggaagggggacggatcccgtagactcgcttctcagtctcagtcctcgtcgggcctgacgcgtctacctcaactaactccgtcccggcttcagttcngaggatggagtctagtacttattactcggtacacgaccggtgggctacggtggactacgtttacgacgggttccgtacggggaacccgggacctaacgggtccctacggtccgtcggtacaccgaccccgaaacggccccaaaacccgtcgttacgaccttaccgtccgttccggttaccccccg

SEQ ID NO: 53494 - DNA, 841 bp, Homo sapiens
  misc_feature: GYAE6OF01EMIY3.29.78.H01.1.454.CMB.1.raw
tcagatagagtactcacgaccggtgctcgatttagtgtgagtagtttgggtttgggtctgagagaggagtcccacccctgggatcttcaggttgttttctatttggtgatcaggacggaacagagagaactcaccatggtaggtttgggctgaggcgtggtcgttttcttaggtggtacttaagttttaaaaggtcgtcagtgtgacgtgctaggttggtggtaggtcggtggggcgtccgtggggtaccggggccggggggtcgcgtggacgacctcctccgtggtcgccggtccttcgtaggttaagttttaaggttttaggtagtcagtcgacctagtacgtaaccggtcgggtacccgcgacggtccgtaccggaagggggtaacggggtcggtagggtaggttcgggtcgtcggtacttagttaggtggcgtaggtgggtcggcgtacttagttaattattagcgacgacgtaccggtccgtacgggtacgggtcccgtacctaaccgtacgtttaccgaagaagtaacccccccccccccccccccccccccccccccgtaagtaacgaaacgtaaccgtaacgtacgtacgtacgtacgtacgtaacgtaagtaggacgacgtaccgtacgacgtaccgtaccggaaccgaacccgtaccggtacccgttacgtttaacgtttacgtttaaggttaacggttaacggtacggtacggtacggtaacgggtaaccgggtaacccggggtacccggggtacccggtacccggttacccggtaacccggtaccgggtaccggggtaccgggacggggtaccggtcggtccggtcccg

SEQ ID NO: 53495 - DNA, 580 bp, Homo sapiens
  misc_feature: GYAE6OF01AM5I3.29.78.H01.1.454.CMB.1.raw
  modified_base (292)..(292): a, c, t, g, unknown or other
  misc_feature (292)..(292): n is a, c, g, or t
  modified_base (450)..(450): a, c, t, g, unknown or other
  misc_feature (450)..(450): n is a, c, g, or t
  modified_base (458)..(458): a, c, t, g, unknown or other
  misc_feature (458)..(458): n is a, c, g, or t
  modified_base (478)..(478): a, c, t, g, unknown or other
  misc_feature (478)..(478): n is a, c, g, or t
tcagatagagtactcacgaccggtgctcgatttagtgtgagtagtttggggtttggggagagctctggggagtctgcaccatggctccggaccccactcctcttcctcaccctcctcctccactgcacagggtctctctcccagcctgtgctgactcaatcgccctctgcctctgcctcccgtgggaggctcggtcaaggtccacctgtactctgagcagtggacacgagcagctacgccatcgcttggcatcagcagacggccagaccacgggtccctgttactgatgacngtacaacaatgaatggcagtcacgagacggaagggggtaccggacttcccgtggacttcgcttactcgacggtcctacccgagtcccttcggtcggggtaccctaggacggtccctacctaccgtacactaactcccgttccggacctaccgagttcnggaacggntaggagtcagtaactattcncgtacgagccgtgggccaggtgcttacgtcgacggttcgtacgggaacccgggactaggtcccgaccggtgtcggcaaccggaccgaaccgccctaaccgcg

SEQ ID NO: 53496 - DNA, 663 bp, Homo sapiens
  misc_feature: GYAE6OF01CWP6L.29.78.H01.1.454.CMB.1.raw
  modified_base (263)..(263): a, c, t, g, unknown or other
  misc_feature (263)..(263): n is a, c, g, or t
  modified_base (658)..(658): a, c, t, g, unknown or other
  misc_feature (658)..(658): n is a, c, g, or t
  modified_base (662)..(662): a, c, t, g, unknown or other
  misc_feature (662)..(662): n is a, c, g, or t
tcagatagagtactcacgaccggtgctcgatttagtgtgagtagtttgggtttggtggtctctctcccagcctgtgctgactcaatcgccctctgcctctgcctccctgggaggctcggtcaaggtcacctgtactctgagcagtggacacagcagctacgccatcgcttggcatcagcagagccagacacgggccctgttactgatgacagtcaacaatgatggcagtcacgagcgaaagggggcggatccctgatcgcttntcagtctcagcctcgtcggcctgacgcgtactaccgtacacctaatccgtcccgggccctccgtactcgtcggaaggtatggacggtctggaactattacgtagtcgacgaccgtggggctaacgtcggctacgttcgacggttccgttaccgggaacccggggtaaccgaacgggttccgaacccgggttccggtaccgggtaccgaaccggtaaccccgaacccggtacccccgtaaaccccgtaccgtaccggttacctaacccgttcccgttaccggttcccccctaccccgttccgtaaccgtaccgttacccgttccgttaaccttcggtaccggagggtacccgggtcggttacccgggacggaacccgggtacgacctaagtaacgntcgng

SEQ ID NO: 53497 - DNA, 602 bp, Homo sapiens
  misc_feature: GYAE6OF01BDZRU.29.78.H01.1.454.CMB.1.raw
  modified_base (505)..(505): a, c, t, g, unknown or other
  misc_feature (505)..(505): n is a, c, g, or t
  modified_base (596)..(596): a, c, t, g, unknown or other
  misc_feature (596)..(596): n is a, c, g, or t
  modified_base (598)..(598): a, c, t, g, unknown or other
  misc_feature (598)..(598): n is a, c, g, or t
tcagatagagtactcacgaccggtgctcgatttagtgtgagtagtttgggtttgggggcgcctgggtacggccggggggtcgctgagactctcctgtgcggcctctggattaagtttaggagtcatgccatgaactgggtccgccaggctccagggaaggggctggagtgggtctcggctattagtggcagtggtggcgctatatattatgcagaccgcccgtgaagggccggttcacctatttccagagacaattcgaagaacacgctgtatctgcaaatggagagcctgagactcgacgacacggccgtctacttattcgtagttaaaggcgagcgtaggaagtacgggaccgggaccgacgttcgaccgtacgtcggggccaagggggacgcgtcggtcaccgtctcccgtcgacgcctccgaccgaacgggcccagtccggtccttccccgtcgccctaccctcctacccgaagacgccaccgtcgtcggggcacgcgacncgcccgtggcgtcgtccgttgtacaacggtacctacgtaccgtagtacctcttaagtctagacggtcggcgtcgacgtaacggcgactagngngacg

SEQ ID NO: 53498 - DNA, 656 bp, Homo sapiens
  misc_feature: GYAE6OF01D9TXQ.29.78.H01.1.454.CMB.1.raw
  modified_base (429)..(429): a, c, t, g, unknown or other
  misc_feature (429)..(429): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgccaggctccgagggaaggggctgggagtgggtctcggctattagtggcagtggtggcgctatatattatgcagaccgccctaggaacgggccgttcacctatttccagacgacaattcgaaagaacacgctgtatctgacaaagtggagagcctgagactcgacgacgacggccgtactatttattggtagttaaaggcgagcgtagggaagtaccggggacccgggcccgtacgttcgaccacggtcggggccgagggggactcgtcggtccaccgtctccgcncgcctccaccgaacggcccacgtccgtcctccccgtcgccctccctccaccaacgccgcctaccgtcggtacgggaccacgacgcgacgcccgtcgggcctccggtccgtacggtacgtaaccggtaccttaccgttccgtacgttaccttaccgttacgttccggtacggtaccgggcggggttaccgtacgggacccgtaacgggaccgtaccgtacgtgcgtag

SEQ ID NO: 53499 - DNA, 565 bp, Homo sapiens
  misc_feature: GYAE6OF01A8HJE.29.78.H01.1.454.CMB.1.raw
  modified_base (189)..(189): a, c, t, g, unknown or other
  misc_feature (189)..(189): n is a, c, g, or t
  modified_base (250)..(250): a, c, t, g, unknown or other
  misc_feature (250)..(250): n is a, c, g, or t
  modified_base (267)..(267): a, c, t, g, unknown or other
  misc_feature (267)..(267): n is a, c, g, or t
  modified_base (300)..(300): a, c, t, g, unknown or other
  misc_feature (300)..(300): n is a, c, g, or t
  modified_base (340)..(340): a, c, t, g, unknown or other
  misc_feature (340)..(340): n is a, c, g, or t
  modified_base (349)..(349): a, c, t, g, unknown or other
  misc_feature (349)..(349): n is a, c, g, or t
  modified_base (352)..(352): a, c, t, g, unknown or other
  misc_feature (352)..(352): n is a, c, g, or t
  modified_base (358)..(358): a, c, t, g, unknown or other
  misc_feature (358)..(358): n is a, c, g, or t
  modified_base (451)..(451): a, c, t, g, unknown or other
  misc_feature (451)..(451): n is a, c, g, or t
  modified_base (457)..(457): a, c, t, g, unknown or other
  misc_feature (457)..(457): n is a, c, g, or t
  modified_base (492)..(492): a, c, t, g, unknown or other
  misc_feature (492)..(492): n is a, c, g, or t
tcagatagagtactcacgaccggtgctcgatttagtgtgagtagtttgggtttggggggaagaggaagactgacggtccacccctgggatcttcaggtgttttcatttggtgatcaggacggaacagagagaactcaccatggagtttgggctgagcggtgtgtttctaggtcggctaattttaaaggngtcagtgtgacgtgcagttggtggagtctggggcgcctggggacggcgggggggtcgctgngactctctgtgcggctntggattagtttgagtcatgcatgaactgggccnccagctccagggagggctggagtgggtctggctatgtgcngtggtgcgntanattatntgacagacgccctaggaacgggccgttcactagtttccgaaggacaactaagttccaaagacacgtactgtactactgactaaagtgaggacncgagancgcgacgacgaccgtctattattagtgtagtacgngagtacggtagtacggtaccggggaccggccgtcgtacgaccgacggtcgggacggagggcgtcggtcggtac

SEQ ID NO: 53500 - DNA, 637 bp, Homo sapiens
  misc_feature: GYAE6OF01DRT6W.29.78.H01.1.454.CMB.1.raw
  modified_base (144)..(144): a, c, t, g, unknown or other
  misc_feature (144)..(144): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccnccaggctccgagggaagggctggagtgggtctcggctattagtggcagtggtggcgctatatattatgcagacgccctgaagggccgttcacctatttccagagacaattcgaagacacgctgtatctgacaaatggagagcctgacgactcgacgacacggccgtactattattgtagttaaaggcgagcgtaggaagtaccgggaccgggccgtacgttcgaccacgtcggggaccgaggggactcgtcggtcctaccggtctcccgtacacgtccctaccgaccgaacgggccctacgtccggtcccttacccccgtcggaccctacccctccgtaccgaagcctaccgtacccgtcggtcgggaccacgacgcacgtcccgtggcctacgccgttacggtacaacggtaccttacccttacgtacgtacctacttacgtccgtagcggtccgggcgtcgggaccgaaggtcccgaatacgtaagtgacg

SEQ ID NO: 53501 - DNA, 798 bp, Homo sapiens
  misc_feature: GYAE6OF01BVGB9.29.78.H01.1.454.CMB.1.raw
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccgagggaagggctggagtgggtctcggctattagtggcagtggtgcgctatatattatgcagacgccctaggaacgggccgttcacctatttccagagacaattcgaagaacacgctgtatctgacaaatggagagcctagacgacgtcgaaccgacgaccggccgttctaatttagttagtaggttaaaaggcgtaaggtcgtagggtaaacgtacccggggacccggggacccgtacgttacggaacccgtacggtcgggggacccgaagggggacgtaccggttcggtacccgtaccggttccctcccgtaccgaccggtacccctaccccgtaacccggaaaccgggggtcccctaaccggttcccggtttaccccgttcccccccgtacgggaccccctaacccccgttcccgtaacccgaaacggaccctacccgtaaccccggttccgggtacggggggtaccccaaccggtaacgggcccgtaaccggtccccgggtttacggggcccttaccgggtacccggtttaccggtacggaaaccggttaccttacccgttaccgtaccgtttactaccgttaacgtccgttagggaccggtccggacggtcggtaacggacgggtcaacggacgtggcag

SEQ ID NO: 53502 - DNA, 662 bp, Homo sapiens
  misc_feature: GYAE6OF01CRXMY.29.78.H01.1.454.CMB.1.raw
  modified_base (649)..(649): a, c, t, g, unknown or other
  misc_feature (649)..(649): n is a, c, g, or t
tcagatagagtactcacgaccggtgctcgatttagtgtgagtagtttgggtttggggtctgagagaggagtccacccctgggatcttcaggtgttttcatttggtgatcaggacggaacagagagaactcaacatggagtttgggctgagctggtctttttcttgtggcttaattttaaaaggtgtccagtgtgacgtgcagttggtggagtcgtgggggcgccgtggggtacgggccggggggtcgcgtgagactctcctggtcgcggcctcgtaggtatttaaggttttaggagttcagtgcatgactgggtccgcaggctcgaggggaagggctgggaggtggtcgtcggcttagttaggtggcgtaggtgggtggcgtctatattatagtgacagaccgtcccgtaggaacggggtccgttaccaccgtatttaccgagtacaacgtaattacgaaacgaacacgtcttagtatcgtagaacaagtaggacgacgtaccgtagagacgtaccgaacggaaccgaccggtccgtacttagttagttacggttagtaaacggcgtagacgtaggaacggtacccgggggacccggcccggtagttacccggacccgtacgggtccggggaccgggacggggaaccgnggtccggtacccg

SEQ ID NO: 53503 - DNA, 772 bp, Homo sapiens
  misc_feature: GYAE6OF01BQPJP.29.78.H01.1.454.CMB.1.raw
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgccgaggctccgagggaagggctggagtgggtctcggctattagtggcaggtggtggcgctatatattatgcagacgccctggaacgggccggttcaccgtatttaccagacgaactaattcgaaagaaccgacgtctgtatctagactaaagtggagacgcctagacgacgtacgacgacgacggtaccgtacttattattgtagttaaggcgagacgtaggaacgtaccggggacccgggaccgtacgttcgaccgacgtcggggaccgacggggacgcgtcggtcctaccgtcctccgtacgacgacccgtccgaacccgacgggccccacgttaccggttccccgttcccccgtacggtacccctaccccgttcccgtacccgaaacggacctacccgtacccgttccgggtacggggacccaaccggtacgacccgtaccggtccccggtacgggtccctccggtacccggtagggttaacccgaaccgggttacccttaacccgtttaaccgtaaccgttaaccgtttaccgttaacggttcccggttagggacccggggtcccggggtacgttaccggggaacggtaaccgggtaccgggtaacctaagggttacggcacgg

SEQ ID NO: 53504 - DNA, 598 bp, Homo sapiens
  misc_feature: GYAE6OF01EZ0M6.29.78.H01.1.454.CMB.1.raw
tcagatagagtactcacgaccggtgctcgatttagtgtgagtagtttgggtttggggtccgagccatggtgcagactccccagagctctcctcctcctccactgcacagggtctctctcccagcctgtgctgactcaatcgccctctgcctctgcctcccgtgggaggctcggtcaaggtcacctgtactctgagcagtggacacagcagctacgccatcgcttggcatcagcaggaggccagaccgaccgggccctcgttacttgatgacagtacaaacaatgagtggacagtcacgaggacggaaagggggacggactcccgtgactccgtcttctcgacgtcctccgagtctcggtcgggcctgacgcgcctacctcacaactccgcccggtcctccagtcgtaggaggatggacgctagtacttattacgtgtacgacgtaccgtgggctacgtcggactacgttcgtacgggttccgtaccggggaacccgggaccgtaacggtccgaccggttccgggtccggtacgaccggaccccgaaccggaccccaaccccgtacgtacgtaccctaccttccgtcccggttcccccg

SEQ ID NO: 53505 - DNA, 664 bp, Homo sapiens
  misc_feature: GYAE6OF01CVAZ2.29.78.H01.1.454.CMB.1.raw
  modified_base (219)..(219): a, c, t, g, unknown or other
  misc_feature (219)..(219): n is a, c, g, or t
  modified_base (243)..(243): a, c, t, g, unknown or other
  misc_feature (243)..(243): n is a, c, g, or t
  modified_base (310)..(310): a, c, t, g, unknown or other
  misc_feature (310)..(310): n is a, c, g, or t
  modified_base (489)..(489): a, c, t, g, unknown or other
  misc_feature (489)..(489): n is a, c, g, or t
tcagatagagtactcacgaccggtgctcgatttagtgtgagtagtttgggtttggggggagagaggagtccacccctgggatcttcaggtgttttcatttggtgatcaggacggaacagagagaactcaccatggagtttgggctgagctggtctttttcttgtggcttattttaaaaggtgtccagtgtgacgtgcagttggtggagtcgtgggggcncgtggggtacgggccggggggtcnctgagactctcctgtgcggcctctggtatttaaggtttgggagtcattcgccatgaacgtgggtccncgaggcctcgaggggaaggggctgggagtgggtctcggctaagttaggtgcgtaggtgggtggcgtcttagtattattatggactagaccgcccgtaggaacggggcccggtttacaccgtatttcccgaagacgaactattacgaagaacacgtctagtatcgtagacaagtggaagngcctaggacgacgtcgaacgaccgaaccggtccgtacttaattagtttaggttaggttaaggcgtaggtacgttagggaaacggtaccgggggaccccgggtcccgtacgttcggaacccgtacgggcggggacccggtaacgggggacctcgggtcggtccgtaccgttccccg

SEQ ID NO: 53506 - DNA, 590 bp, Homo sapiens
  misc_feature: GYAE6OF01EH8AG.29.78.H01.1.454.CMB.1.raw
  modified_base (581)..(581): a, c, t, g, unknown or other
  misc_feature (581)..(581): n is a, c, g, or t
  modified_base (588)..(588): a, c, t, g, unknown or other
  misc_feature (588)..(588): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccggggcccgacttgaccacgtggggccagggggacgcgtggtcaccgtctcctcacgtccctccaccaacgggcccatccggtccttccccctggcccaccctcctccaacgacgccaccctccgtcgggggccaacgacgcgacgccctcgggcctcgcccgtggtcgaacggacctaccttccaacgtacctcttacgttctgacggcgggacgtcggacgtaacgggccganacgtagngc

SEQ ID NO: 53507 - DNA, 624 bp, Homo sapiens
  misc_feature: GYAE6OF01EDDGB.29.78.H01.1.454.CMB.1.raw
  modified_base (622)..(622): a, c, t, g, unknown or other
  misc_feature (622)..(622): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgacaaatggagagcctgagactcgacgacacggccgtctattattgtagttaaaggcgagctaggaactacggggaccggggccacgttcgaccacgtcggggccgaggggacgcgtggccaccgtctccgtcacgccctaccaccgaacgggcccacgtcccggtccttcccccgtcggcccaccctccctaccgaacgacgccaccgtccgtcgggggccacgacgccgacggccccgtcgggccgtcgtccgtcggtacgaacggtacctaaccgttcccaacgttccgtacttacgtcgtacggacgggtccgggcgtacgggacgtaacgggacgtacagtgncg

SEQ ID NO: 53508 - DNA, 616 bp, Homo sapiens
  misc_feature: GYAE6OF01CM0TZ.29.78.H01.1.454.CMB.1.raw
  modified_base (197)..(197): a, c, t, g, unknown or other
  misc_feature (197)..(197): n is a, c, g, or t
  modified_base (277)..(277): a, c, t, g, unknown or other
  misc_feature (277)..(277): n is a, c, g, or t
  modified_base (356)..(356): a, c, t, g, unknown or other
  misc_feature (356)..(356): n is a, c, g, or t
tcagatagagtactcacgaccggtgctcgatttagtgtgagtagtttgggtttggggtccgagccatggtgcagacctccccagagctctcctcctcctccactgcacagggtctctctcccagcctgtgctgactcaatccgccctctgcctctcgcctcccgtgggagctcggtcaaggtcacctgtactctgancagtggacacagcagccacgccatcgctggcatcagcagaggccagacgacgggcctcgttacttgatgacagtacaaanaatgatggacagtcacgaggacggaaacgggggacggtactcccgtagacgtccggtcttcctacgtacgtcctaccgngtccgtcgtcgggtcctggacgccgtacctaccgtaccgtaacaacgttccccgtaccggtccctaccgtagtccgtaggacggtagtacggacggtctacgtaacttacgttacgtcgtacgacggaccggtgggacctacgtcggtacgtcgttacggacggttaccggttaccgggaaccgggtactaacggtccgtaaccggtcgtaccgcgaaccgcccgaccgacccaccctcgtcactctccgtccgtacccc

SEQ ID NO: 53509 - DNA, 631 bp, Homo sapiens
  misc_feature: GYAE6OF01EUR9W.29.78.H01.1.454.CMB.1.raw
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaagtacgggaccgggcccgacttcgaccacgtcggggccagggggacgcgtggtccaccggtctccctcacgccctaccaccgaacgggcccacgtccggtccttccccccgtcgggcccacccgtccctacccaacgacgcccacccgttcgtcgggggccaacgacgccacggcccgtagggcctcggccgttggtacgaacgggtacccttaccttccgaacgttaccttacttacgtccgtaggacgggccggggcgtacgggaccgaaacgggcgaccgtaagtagctag

SEQ ID NO: 53510 - DNA, 671 bp, Homo sapiens
  misc_feature: GYAE6OF01ETMWW.29.78.H01.1.454.CMB.1.raw
  modified_base (310)..(310): a, c, t, g, unknown or other
  misc_feature (310)..(310): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtntatttattgtagttaaaacggcgagcgtggaagtaccggggacccggggtcccgacgttcgaccgacgtcgggggaccagggggacgcgtcgggtccaacccggttctccctcgacggcccctaccacccgaacggggcccctacgttccggtccctttccccccgtcgggtacccctaccccgtccctacccgtaacggacgtacccaacccgttccggtcgggggaccaacgacggccgtaccggccccgtacggggcctcggtcccgtcgggtacgaacgggtacctaccgttccctaagttacctcttacgtccgtggacggtcggggctgggaccgtaacgggccgacactagcag

SEQ ID NO: 53511 - DNA, 588 bp, Homo sapiens
  misc_feature: GYAE6OF01EKLTN.29.78.H01.1.454.CMB.1.raw
  modified_base (586)..(587): a, c, t, g, unknown or other
  misc_feature (586)..(587): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaagtacgggaccgggcccgacttgaccacgtggggccagggggacgcgtggtcaccgtctcctcacgcctccaccgaacgggcccatccgtcttccccctcggccaccctcctccaagacgccacctcgtggggccacgacgcacgcccgtagggcctgcccgttagggtccaagggacccttacttcccgagttacctcttacgtccgttgacggcggggccgttgggacgtaacgggaccgagatagnng

SEQ ID NO: 53512 - DNA, 625 bp, Homo sapiens
  misc_feature: GYAE6OF01DUB77.29.78.H01.1.454.CMB.1.raw
  modified_base (329)..(329): a, c, t, g, unknown or other
  misc_feature (329)..(329): n is a, c, g, or t
  modified_base (623)..(623): a, c, t, g, unknown or other
  misc_feature (623)..(623): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccgagggaagggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtagttaaggngagctaggaagtacggggaccgggccgacttcgaccacgtcggggccgaggggacgcgtggtcaccgtctcctcacgccctccaaccgaacgggcccacgtcccggttcccttcccccgtcgggccctacccctccctacccgaaacgacgcctacccgttccggtcgggggcccaacgacgccaccggcccgtgggcctacggcccgttggtaccgaacggtacccttaaccttcccgacgttaccttctacgtcgtaggcggtccgggcgtcggacgtaacgggcacagtgncg

SEQ ID NO: 53513 - DNA, 717 bp, Homo sapiens
  misc_feature: GYAE6OF01C8XAY.29.78.H01.1.454.CMB.1.raw
  modified_base (286)..(286): a, c, t, g, unknown or other
  misc_feature (286)..(286): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccgagggaaggggctggagtgggtctcggctattagtggcagtggtggcgctatatattatgcagacgccctgaagggccggttcaccatttccagagacaattcgaagaacacgctgtatctgacaaatgganagcctgagactcgacgacacggccgtctattatgtagtaaaggcgagctaggaaagtaccggggacccggggcccgacgttcggaaccctacggtcggggggaccgaagggggaccgtcgtcgggtccaacccggttcctccctcgaccgtcccctacccgaacccgaacggggacccctacgttcccggttacccctttcccccccgtacggcccctaaccccctcccttaacccgaacggaccgtacccgtacccgttccggtaccggggggccaaccgacggaccgaccggtccccgtcggggtacccgtcggtcccgttcgggtaccgaacgggtaccttaaccgttacccgaacgttaccgttactacgttccgtaggacgggtccggggtccgtagggaccgaacgggaccgacgaagtgctacg

SEQ ID NO: 53514 - DNA, 599 bp, Homo sapiens
  misc_feature: GYAE6OF01ASFWQ.29.78.H01.1.454.CMB.1.raw
  modified_base (327)..(327): a, c, t, g, unknown or other
  misc_feature (327)..(327): n is a, c, g, or t
tcagatagagtactcacgaccggtgctcgatttagtgtgagtagtttgggtttggggtccgagccatggtgcagactccccagagctctcctcctcctccactgcacagggtctctctcccagcctgtgctgactcaatcgccctctgcctctgcctcccgtgggaggctcggtcaaggtccacctgtactctgagcagtggacacagcagctacgccatcgcttggcatcagcagacggccagacaccgggccctcgttacttgatgacagtcaaacaatgatggcagtcacagacgaaggggggacggatcccgtgatcgcttcnctagtctccagtctcgtcgggcctgagccgtctacctacaacctaactccgtcccggacctccgagttcctaggaggagtcggagcttacggaactttacgttacgtgtactacggtaccggtggggacctacggtggacttacgttcgtacgggttccgttaccggggaccgggtaaccgtaacggtcccgtaccggtcgtccgggtacaccggaccccggaaccgtccccgaaaccccgtagactacctaccgttcctcccgggttcccc

SEQ ID NO: 53515 - DNA, 573 bp, Homo sapiens
  misc_feature: GYAE6OF01EM4M1.29.78.H01.1.454.CMB.1.raw
  modified_base (457)..(457): a, c, t, g, unknown or other
  misc_feature (457)..(457): n is a, c, g, or t
  modified_base (565)..(565): a, c, t, g, unknown or other
  misc_feature (565)..(565): n is a, c, g, or t
  modified_base (571)..(572): a, c, t, g, unknown or other
  misc_feature (571)..(572): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattatgtgttaaaggcagctggaatacgggaccggggcccgacttcgaccacgtggggccaggggacgcgtggtccaccgtctcctcagcctccaccaacgggcccactcggtccttccccctggcccaccctcctccaacgacnccgacctcgtcggggccacgacgcacgcccgtcgggctcgcctggtacaaggtacctacgtccacgttacctcgttactctggacggcgggctcgggacacgggcganacgtgnng

SEQ ID NO: 53516 - DNA, 600 bp, Homo sapiens
  misc_feature: GYAE6OF01EH41R.29.78.H01.1.454.CMB.1.raw
  modified_base (410)..(410): a, c, t, g, unknown or other
  misc_feature (410)..(410): n is a, c, g, or t
  modified_base (597)..(597): a, c, t, g, unknown or other
  misc_feature (597)..(597): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaagtacgggaccggggcccgacgttcgaccactcggggcgaggggacgcgtggtcgaccgtcgtcctcacgccncctttaccaacgggcccacgtccggtccttacccccgtcggcccaccctccctaccaacgacgcaccctcgtcggggcacgacgcgaacgtccgtacgggccgtcgccgtcggtactaacggaccgttacctccgtacgtacctcttaacgtcgtgacggtcgggcgtcggcgtacggcgacagtgngcg

SEQ ID NO: 53517 - DNA, 772 bp, Homo sapiens
  misc_feature: GYAE6OF01E14UX.29.78.H01.1.454.CMB.1.raw
  modified_base (430)..(430): a, c, t, g, unknown or other
  misc_feature (430)..(430): n is a, c, g, or t
tcagatagagtactcacgaccggtgctcgatttagtgtgagtagtttgggtttgggggacggccgtgggtacggccgggggggtcgctgagacgtctcctgtgcggcctctggattaacgttttaggagtcactcgccatgactgggtccgccaggctccagggaaggggctggagtgggtctcggctattagtggcacgtggtggcgctatacgtattatgcacgacggccctgaacgggtccggttcacctatttccagagtacgaattcgaaagaacacgcttggtacttctgaccaaagtggagacgcctgacgaccttcggacgtacacgggcctacttattagttcgtgttaaaggcgagtcctaggaagtaccgggaccggggccccgtacgtacggacctacggttcgggccgaacggggcnccgtggtccaccggtccgtaccgacgacgccgttaccgaaccgtaacggggtccccaacggtttccggtcccgtttaccccccgtaggggcccctaaccccgtccgtaacccggaacggtacgcccgtaacccgttccggtaccgggggtacctaaccgaacggacccaacggtccccggtacgggtacccgttacgggtaccccggtttagggtaaccgtaaccgggttacgtttaacccggtaccgtaccggttaccgtaccgttaacgtccgttacgggaccgggtcgggtaccggttacgggacccgtaaacggggccgaccgtaacgtccggtcgcg

SEQ ID NO: 53518 - DNA, 747 bp, Homo sapiens
  misc_feature: GYAE6OF01BC95N.29.78.H01.1.454.CMB.1.raw
tcagatagagtactcacgaccggtgctcgatttagtgtgagtagtttgggtttggggtccgagccatggtgcagactccccagagctctcctcctcctccactgcacagggtctctctcccagcctgtgctgactcaatccgccctctgcctctcgccctcccgtgggaggctcggtacaaggtcacctgtactctgagcaggtgacacagcagctacgccatcgcttggcatcagcaggacggccagaccgaccgggtcccttcgttacttagatcgaacagtacaaactaatgagtcggcagtccaacgacggacgggaaagggggacggtactcccgtgactcgtcttcgtcgtacgtccgtccagtcgtcgtcgggccgtaggcgtccgtccctaccctactaaccgtaaccgttcccgtccccgggtacccttaccgtaggttccgtaggtaaccgggtagttccgggaaggttcccgttaacggttaaccttttacggtttaaccgtaccggttacgaacgggttacccgggttcgggggacctaaccgggttacggtacccgttaacggtttcccgggtaaacggggttttcccgggtaacccgggggtaacccggggtaaccgtaaccgggttccccgtaaccgggtttcccgggacggtacccgacccggtaaccccgaacccggtacccccaaccgtcgttccggtaccctaccgttccggtcccccgttacccccg

SEQ ID NO: 53519 - DNA, 616 bp, Homo sapiens
  misc_feature: GYAE6OF01E2HSE.29.78.H01.1.454.CMB.1.raw
  modified_base (609)..(609): a, c, t, g, unknown or other
  misc_feature (609)..(609): n is a, c, g, or t
  modified_base (615)..(616): a, c, t, g, unknown or other
  misc_feature (615)..(616): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtagttaaaggcgagctaggaagtaccggggacccggggcccgacgttacgacctaacgtcggggaccgagggggaccgcgtcggtccaccggtctcctcgacgccctcccaaccgaacgggcccacgttccggtcccttcccccgtcggccctacccctcctacccaagacgcctaccctcggtcggggaccacgacgccgacgcccgtcgggctcgccgtgtacgaacggtaccttacgtcctacgtacctctaacgtcgtaggacggtccggcgtggaccgaggccganagtagnn

SEQ ID NO: 53520 - DNA, 739 bp, Homo sapiens
  misc_feature: GYAE6OF01BDM3G.29.78.H01.1.454.CMB.1.raw
  modified_base (737)..(737): a, c, t, g, unknown or other
  misc_feature (737)..(737): n is a, c, g, or t
tcagatagagtactcacgaccggtgctcgatttagtgtgagtagtttgggtttgggggcgcctgggtacggccgggggggtcgctgagactctcctgtgcggcctctggattaagtttaggagtcatgccatgaactgggtccgccaggctccgagggaaggggctggagtgggtctcggctattagtggcagtggtggcgctatatattatgcagacgcccgtggaacgggccggttcacctatttccagagacaattcgaagaacacgctgtatctgacaaagtggagagcctagagactcgacgacacggccgtctattagttgtagttaaaggcgagtcgtagggaacgtaaccggggacccggggaccccgtacgttccggaaccacggtcgggggaccgaagggggaccgcgtcggtccgaaccgtcctacctcgacgccccgtaccaacccgaacgggcccacgttcccggtccccttaccccccgtcggacccctaccccgttcccgtacccgaaacgtacgacccgtacccgtccggtaccgggggacctaaccgaccgccgaacccggtccccggttacggggtcccgtccggtaccccgttaggggtaaccctaacgggtaacccgttaaccgttacccggtaacgttaccctaccgttacgttccgtacgggtaacgggcccgggtcggtaccgggaccggtaacgggaccgacgtaagtacggncg

SEQ ID NO: 53521 - DNA, 581 bp, Homo sapiens
  misc_feature: GYAE6OF01BGZ25.29.78.H01.1.454.CMB.1.raw
  modified_base (580)..(580): a, c, t, g, unknown or other
  misc_feature (580)..(580): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgacgactcgacgacacggccgtctattattgtgttaaaggcgagctggaatacggggaccggggcccgacttcggaccacgtggggaccgagggggacgcgtggtcaccggtctcctcacgcctccaccgaacgggcccatccggtccttccccctggccaccctccacccaagacgccaccgtcgtcggggcacacgccgacgccccgtgggctcgccctggtaccaacggacctaccttccacgtacctactactcgtgacggccgggctcggacgaacggcgacatgnc

SEQ ID NO: 53522 - DNA, 695 bp, Homo sapiens
  misc_feature: GYAE6OF01C1JWY.29.78.H01.1.454.CMB.1.raw
  modified_base (252)..(252): a, c, t, g, unknown or other
  misc_feature (252)..(252): n is a, c, g, or t
  modified_base (392)..(392): a, c, t, g, unknown or other
  misc_feature (392)..(392): n is a, c, g, or t
tcagatagagtactcacgaccggtgctcgatttagtgtgagtagtttgggtttgggggaagaggaagactgacggtccacccctgggatcttcaggtgttttcatttggtgatcaggacggaacagagagaactcaccatggagtttgggctgagcgtgtcgttttctagtggctaattttaaaaggtgtccagtgtgacgtgcaggttggtggagtcgtgggggcgccgtggggtacgggccggggggtcnctgagactctcctgtgcggcctcgtggtatttaaggttttaggagtcatgccatgaactcgggtccgaccgaggcctaccgaggggaaggggctgggagtgggtcgtcggcttagttaggtggcgtaggtggtggccgtntaatattattatgacgagaccgcccgtaggtaaccgggccggtttacaaccgtacgtttacccgaaggtacgaaacgtaacgttaccggaaaacgtaaccgaacgtcgttagtaacgttcctaggaactaaaaggtggaacgtacgccgtagaacgtaccgtacgaaccgacgaccggtcccgtattaagtttagttagtagttaaacggcggtagacgtagggaacggtacccggggacccgggtacccgtagttaccggaccgtacggtcggggaccgtaggggaacctggtcggtacccg

SEQ ID NO: 53523 - DNA, 559 bp, Homo sapiens
  misc_feature: GYAE6OF01BN22V.29.78.H01.1.454.CMB.1.raw
  modified_base (376)..(376): a, c, t, g, unknown or other
  misc_feature (376)..(376): n is a, c, g, or t
  modified_base (557)..(559): a, c, t, g, unknown or other
  misc_feature (557)..(559): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaaagaacacgctgtatctgcaaatggagagcctgagactcgacgacacggccgtctattatgtgttaaaggcgagccgaatacgggaccgggcccgattgaccactggggccaggggacnctgggtccaccggtctccctcacgcctaccaccgaacgggcccacgtccggtccgttcccccctcggccacccctccctccaacgacgccacctcgtcggggcacagcacgcccgtggcctgcctggtcaaggtactactccagtactctatcgtgagcggctcggcaacggcgacatagnnn

SEQ ID NO: 53524 - DNA, 757 bp, Homo sapiens
  misc_feature: GYAE6OF01C88Z8.29.78.H01.1.454.CMB.1.raw
  modified_base (239)..(239): a, c, t, g, unknown or other
  misc_feature (239)..(239): n is a, c, g, or t
  modified_base (514)..(514): a, c, t, g, unknown or other
  misc_feature (514)..(514): n is a, c, g, or t
  modified_base (535)..(535): a, c, t, g, unknown or other
  misc_feature (535)..(535): n is a, c, g, or t
tcagatagagtactcacgaccggtgctcgatttagtgtgagtagtttgggtttggggggagagaggagtccacccctgggatcttcaggtgttttcatttggtgatcaggacggaacagagagaactcaccatggagtttgggctgagcgtggtcttttctgtggcttatttaaaggtgtcagtgtgaagtgcagttggtggagtcgtgggggcgccgtggggtacgggccggggggtncgtgagaccttctccgtgtcgccggtcctcgtggtatttaaggttttaggagtcatcgccagtacgaacgtgggtccgccgtacggctaccggaggggacgggcgtagggaggttgggtcgtcggcgttagttaggtggcgtaggtgggtcggtcgtacttaattagttatttagtcgacgtaacggacccgtcccgtagggaacgggtcccggtttaccacccgttaagtttcccgaagtaacgtaacgtaacgtacggaaacgaacgtaccgnttacgtatcgtagactaaagnggaagtacgcgtagaacgtaccgacggaaccgaccgtaccgggtaccgtttactttaagtttacgtacggtttaacggtaacggtcgtacggtacgtaacgggtaaaccgggtaccggggaaccccggggtacccgtaggttacccggacccgggtacgggtaccggggaccgggtaaacgggggccgttacggttaccgggccccgttaaccggttccccg

SEQ ID NO: 53525 - DNA, 645 bp, Homo sapiens
  misc_feature: GYAE6OF01C0LM9.29.78.H01.1.454.CMB.1.raw
  modified_base (251)..(251): a, c, t, g, unknown or other
  misc_feature (251)..(251): n is a, c, g, or t
tcagatagagtactcacgaccggtgctcgatttagtgtgagtagtttgggtttgggggaagaggaagactgacggtccacccctgggatcttcaggtgttttcatttggtgatcaggacggaacagagagaactcaccatggagtttgggctgagctggtctttttcttgtggctaattttaaaaggtgtccagtgtgacgtgcagttggtggagtctgggggcgccgtggggtaccggccgggggggtcnctggagactctcctgtcgcggcctcgtggatttaaggttttaggagttcatgccagtgaactcgggtccgccaggctccgagggaaggggcgtggaggtgggtctcggtcgtagttaggtggcaggtggtggcgtcgtattatacttatgacagacgcccgtaggaacgggcccgtttcgacctatttaccgagagactaacttcgaaagacgacgtcgtagttactcgtagactaaagtgggacgagtcctagacgacgtacgaacgaccgaccggtccgtattacttagttagttaggttaaacggcgtaggtacgtagggaacggtaacggggaccccggggaccgtcgtacgacccgtcggtacgggccgaggggacgcgtcggtacccg

SEQ ID NO: 53526 - DNA, 756 bp, Homo sapiens
  misc_feature: GYAE6OF01ETDTB.29.78.H01.1.454.CMB.1.raw
  modified_base (752)..(752): a, c, t, g, unknown or other
  misc_feature (752)..(752): n is a, c, g, or t
  modified_base (754)..(754): a, c, t, g, unknown or other
  misc_feature (754)..(754): n is a, c, g, or t
tcagatagagtactcacgaccggtgctcgatttagtgtgagtagtttgggtttggtggtctctctcccagcctgtgctgactcaatccgccctctgcctctgcctcccgtgggaggctcggtcaaggtcacctgtactctgagcagtggacacagcagctacgccatcgcttggcatcagcagaggccagacaccgggccctcgttacttgatgacagtacaacaatgatggcagtcacgagcggaagggggacggactcccgtaggactcgcttctcagtcctccgagccgttcgtcggggtcctggacgccgtccttaccctcaactaacgtcccgtacccggccctccagttcgtaggacggtagtcggacggtcttaggtaacttaagtttacgtcgtacgaccggtaccggtcggggtacctaacgtcggtaccttagtttccggaccggggtttacccggttaacccgggggaaccccggggtaaccgtaaacgggttaccccgtaccgggtttaccggtccgggtaaccgaacccggaacccccggtaacccggaccccctaaaccccgtacgttcccggtaaccctaacccggtttcccgttaccccgtttacccccgtaccccctttacccgtacgtaaaccgtttaccctttaccgtaacgtttcccgtaacggggtacccgggtcccgggggtctacccgggggtaaccaaaccgggggttccctacgtaaacggttccgngncg

SEQ ID NO: 53527 - DNA, 617 bp, Homo sapiens
  misc_feature: GYAE6OF01C0OCA.29.78.H01.1.454.CMB.1.raw
  modified_base (607)..(607): a, c, t, g, unknown or other
  misc_feature (607)..(607): n is a, c, g, or t
  modified_base (617)..(617): a, c, t, g, unknown or other
  misc_feature (617)..(617): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgacaaatggagagcctgagactcgacgacacggccgtctattattgtagttaaaggcgagctaggaagtaccggggacccggggcccgacttcgaccacgtcggggccagggggacgcgtggtcaccgtctcctcacgccctccaccgaacgggcccacgtccggtccctttcccccgtcggccctacccctcctaccaacgacgccgacccgtcgtcggggccacacgccgacgccccgtagggccgtcgccgtcggtaccgaacggtaccttaccgttccctaacgtaccttactactcgtggacggccgggcgtcggacgtaacgggacgngaacgtgcgn

SEQ ID NO: 53528 - DNA, 636 bp, Homo sapiens
  misc_feature: GYAE6OF01BJL25.29.78.H01.1.454.CMB.1.raw
  modified_base (634)..(634): a, c, t, g, unknown or other
  misc_feature (634)..(634): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccgagggaaggggctggagtgggtctcggctattagtggcagtggtggcgctatatattatgcagacgcctgaagggccgttcaccatttccagagacaattcgaaagaacacgctgtatctgacaaagtggagagcctagagactcgacgacgacggccgtctattattgtagttaaaggcgagcgtaggaacgtaccggggacccgggcccgtacgttcgaaccgacgtgggggaccgagggggaccgcgtggtccaccgtcctcctcacgtccctaccaaccgaacgggccctacgtcccggtcccgttcccccgtcgggccctaccctcccgtaccgaacgacgaccaccgtcgtacggggcacgcgacacgccgtcggctcgtcccgtcggtaccgaacggaccttaccgttaccgtacgttacctacttacgtcgtaggacggcgggtcgtcgggacgacgggaccgagacgtagncg

SEQ ID NO: 53529 - DNA, 615 bp, Homo sapiens
  misc_feature: GYAE6OF01BQ35V.29.78.H01.1.454.CMB.1.raw
tcagatagagtactcacgaccggtgctcgatttagtgtgagtagtttggggtttggggagagctctggggagtctgcaccatggctcggaccccactcctcttcctcaccctcctcctccactgcacagggtctctctcccagcctgtgctgactcaatccgccctctgcctctgccctcccgtggggagctcggtcaaggtccacctgtactctgagcagtggacacagcagctacgccatcgcttggcatcagcagacggccagacacgggccctgttactgatgacagtcaacaatgatggcagtcacagcgaaggggcgactcccgtgatcgcttctcacgtctaccagtctcgtcgggcctggacgccgtcctacctcactaactcccgtaccggcctaccgtagtcgtaggagagtggacgtcgtagtaacttagttacgtcgtaccgaacggtaccggtggggacctacggtggaccttagttccgtacgggttacccggttacccggggaacccggggtaacccgaacgggttcccgaacccgggttccggtacccgggttacccgacccggaaccccgaaaccgggacccctaaacccccggtacg

SEQ ID NO: 53530 - DNA, 732 bp, Homo sapiens
  misc_feature: GYAE6OF01E09B0.29.78.H01.1.454.CMB.1.raw
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattagttgtagtttaaaggcgagtcgtaggaagtacggggaccgggccccgtagttcgaccacgtggggaccgagggggaccgcgttcggtccacccgttctccctcgacgccctcccgtaaccgaacgggaccccacgttccgggttcccttccccccgtcgggtcccctacccccttcccttacccgtaacgaccgacctaaccccgttccggtacggggggtacccaacgtaccggaccgaccggtccccggtacggggtcccgtccggtccccgttcgggtaccgtaaacgggtaaccgtttaaccgttacccgtaaccggttaccttacgttaaccgttccgttaggtaaccgggtcccggggtaccgttccggggtaacccggaacggggcccgaggtaacgttaaggcctagg

SEQ ID NO: 53531 - DNA, 582 bp, Homo sapiens
  misc_feature: GYAE6OF01D61VU.29.78.H01.1.454.CMB.1.raw
  modified_base (576)..(576): a, c, t, g, unknown or other
  misc_feature (576)..(576): n is a, c, g, or t
  modified_base (581)..(582): a, c, t, g, unknown or other
  misc_feature (581)..(582): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgacaaatggagagcctgagactcgacgacacggccgtctattattgtagttaaaggcgagctaggaatacggggaccgggccgacttcgaccacgtggggccgaggggacgcgtggtcaccgtctcctcacgcctaccaccgaacgggcccacgtccggttccttcccccgtcggcccaccctcctccaacgacgcctaccgtcgtcggggcacgacgcgacgcccgtggcgtcgccgtcggtacgaacggtactacctccagtacctactactcgtgacggcgggcgtggacgacggcganactgnn

SEQ ID NO: 53532 - DNA, 678 bp, Homo sapiens
  misc_feature: GYAE6OF01C65GB.29.78.H01.1.454.CMB.1.raw
tcagatagagtactcacgaccggtgctcgatttagtgtgagtagtttgggtttggggtccgagccatggtgcagactccccagagctctcctcctcctccactgcacagggtctctctcccagcctgtgctgactcaatccgccctctgcctctgccctcccgtggggagctcggtcaaggtcacctgtactctgagcagtggacacagcagctacgccatcgcttggcatcagcagaggccagaccacgggccctgttacttgatgacagtacaacaatggatggcagtcaacaggcgaagggggacgtatccctgactcgcttctcagttcctccagtcctcgtcggggcccttaggacgccgtaccttacctcaacctaacgttcccgtcccgggtacccttaccgaggttaccgtgggaaaggtacgtcggtacggacctttaaggttaaccttaacgtttacgtacggttaccgaacgggtacccgggttggggaccttaacggtcggtaacgttacgtttaccggcgggtttacccgggttaccggggaacccggggtaccttaaaccgggtccctacccggggttcggtacgggttacccaacggtacccccgaaagggacccccctaaacccgtcgttaccgtacctacccgtccgttcccgttaccccc

SEQ ID NO: 53533 - DNA, 717 bp, Homo sapiens
  misc_feature: GYAE6OF01BNZ5S.29.78.H01.1.454.CMB.1.raw
  modified_base (712)..(712): a, c, t, g, unknown or other
  misc_feature (712)..(712): n is a, c, g, or t
tcagatagagtactcacgaccggtgctcgatttagtgtgagtagtttgggtttggtggtctctctcccagcctgtgctgactcaatcgccctctgcctctcgccctcccgtgggagctcggtcaaggtcacctgtactctgagcagtggacacagcagctactccatcgcttgcatcagcagacgccagacacgggtccctcgttactgatcgacagtacaacaagtgatggacagtcacgaggacggaagggggacggactcccgtgacgtcgtccttcgtcacgttccaccgagtccgtcgtcgggcctggacgccgtccttaacctacaacctaacgttcccgtacccggccttaccgtacgtacgtaggaacggtagtcggacgtcgtagtaaccttacttacgtcgtaccaacgggtacccggtacgggtctaacgtcgggacttacgtttccggacgggttccggttaacccggggaacccggggtaacctaacggtccccgtaccgggttaccggtccggtaaccgaccggtaaccccgaaccggtaccccctaaacccgtccgttaccggtaccctacccgttcccgttacccgttacccccctacccttaccgtccgttaaccgttaaccgttccgttaacggtccgtacgggtacccggccgggtacgaccgggtaacgaaccgggcctaaccgtaagccgngctag

SEQ ID NO: 53534 - DNA, 716 bp, Homo sapiens
  misc_feature: GYAE6OF01C3I1C.29.78.H01.1.454.CMB.1.raw
tcagatagagtactcacgaccggtgctcgatttagtgtgagtagtttgggtttggggtccgagccatggtgcagactccccagagctctcctcctcctccactgcacagggtctctctcccagcctgtgctgactcaatcgccctctgcctctgccctcccgtgggagctcggtcaaggtcacctgtactctgagcagtggacacagcagctacgcatcgctggcatcagcagaggccagacgaccgggccttacgttacttgatgaacagtacaaacgaatggatggcacgtacaacgaggacggaaagggggacggactcccgtagactcggtcttacgcgtagtcctccgacgtccgtcggtcgggccttaggacgtccgtaccttaacccgtctaaccgtaaccttccccggtacccggcccttaccgtaggttcccgtagggtaaacgggtatacgggacggttccttaacgggttaacctttaacgttccgtacggtttaaccggacgggttacccgggtgggggacccttacgggttcgggtaccgtacgttttaccggacggggtttcccggtaaccgggggaacccgggtaacccgttaaacgggtccgtaaccccgggtcggttccggaaccgaccggtaccccgaaaccgaccccggaaacccctcgttaccgtaccacccgttcccggttcccggttccccccg

SEQ ID NO: 53535 - DNA, 574 bp, Homo sapiens
  misc_feature: GYAE6OF01EQXB5.29.78.H01.1.454.CMB.1.raw
  modified_base (572)..(573): a, c, t, g, unknown or other
  misc_feature (572)..(573): n is a, c, g, or t
tcagatagagtactcacgaccggtgctcgatttagtgtgagtagtttgggtttgggggcgcctgggtacggccgggggggtcgctgagactctcctgtgcggcctctggatttaagttttaggagtcatgccatgaactgggtccgccaggctccagggaaggggctggagtgggtctcggctattagtggcagtggtggcgctatatattatgcagacgcctgaagggccgttcaccatttccagagacaattcgaagaacacgctgtatctgcaaatggagagcctgagactcgacgacacggccgtctatttattgtagttaaaggcgagcgtaggaacgtacggggaccgggacccgacttcgaccacgtggggccaggggacgcgtggtcaccgtctcctcacgccctaccaccgaacgggcccacgttccggtccttcccccgtcggcccacccctccctaccaacgacgcctaccgtcgtcggggcacgacgcacgccgtggctcgcgtggtacgacggactactcacgtactctagtctgcgtcggctggacgacggcagatgnng

SEQ ID NO: 53536 - DNA, 696 bp, Homo sapiens
  misc_feature: GYAE6OF01DC1W0.29.78.H01.1.454.CMB.1.raw
  modified_base (262)..(262): a, c, t, g, unknown or other
  misc_feature (262)..(262): n is a, c, g, or t
  modified_base (442)..(442): a, c, t, g, unknown or other
  misc_feature (442)..(442): n is a, c, g, or t
tcagatagagtactcacgaccggtgctcgatttagtgtgagtagtttgggggtttggggagagctctggggagtctgcaccatggctcggaccccactcctcttcctcaccctcctcctccactgcacagggtctctctcccagcctgtgctgactcaatccgccctctcgcctctcgccctcccgtggggaggcgtcggtcaaggtcaccgtgtacctctgagcaggtcggacacgagcagcctacgccatcgcttggcancagcagcgccagaccgaccgggcccttgttactgatagacagtacaacaatgagtggcagtcaacgaggacgggaaggggcgactccgtagactcgtcttctacgacgtcctcgacgtcgtcgtcggctcggacgccgtaccacctacaacctacgtccccgtcccggtacccttaccgnggttccgagggtacggacgtcggtacggtcgttacgtaacgtttacgttaaccgtcggttaccgaccgggttaccggtccgggtactaccggttacgggtcttaaccggtttccgggaaccgggttttcccgggaacccggggtaaaccggggaacccgttaaccggggtccccgtaacccggggttccggtaacccggtacccgaacccgggtaacccccggaacccgggtaaccccctaacccggttaccgg

SEQ ID NO: 53537 - DNA, 623 bp, Homo sapiens
  misc_feature: GYAE6OF01AR5PI.29.78.H01.1.454.CMB.1.raw
  modified_base (302)..(302): a, c, t, g, unknown or other
  misc_feature (302)..(302): n is a, c, g, or t
  modified_base (535)..(535): a, c, t, g, unknown or other
  misc_feature (535)..(535): n is a, c, g, or t
tcagatagagtactcacgaccggtgctcgatttagtgtgagtagtttggggtttggggagagctctggggagtctgcaccatggctcggaccccactcctcttcctcaccctcctcctccactgcacagggtctctctcccagcctgtgctgactcaatcgccctctgcctctgcctcccgtgggagctcggtcaaggtccacctgtactctgagcagtggacacagcagctacgccatcgcttggcatcagcaggacggccaggaccgaccgggcccttcggttactgatgacagtacaanagtgagtggacagtcaagaggacgggaagggggaccggtactcccgtagacgtccgccttactcgtacgttccaccgtacgtccttacggtcgggacccttggaccggtcccgtacccttaacccgtacaaccgtaaccttccccggtaccccggacccttccgagttccgtaacggaggacgtcggacggtctagacctttagtcctaggtaccaacgggtccgtcgggacncgtggcctagttccggagttccggtacgggaccgtacgaggttcccgacggtcgtacggtacacccggacccacgtcccctaccgtcg

SEQ ID NO: 53538 - DNA, 172 bp, Homo sapiens
  misc_feature: GYAE6OF01AOEBA.29.78.H01.1.454.CMB.1.raw
  modified_base (165)..(172): a, c, t, g, unknown or other
  misc_feature (165)..(172): n is a, c, g, or t
tcagatagagtactcacgaccggtgctcgatttagtgtgagtagtttgggtttggggtctccactcccgccttgacgggctgccatcagcccaaggccaaccccactgtcactctgttcccgccctcctcagtactctatctgagcggctggcaaggcgcatagnnnnnnnn

SEQ ID NO: 53539 - DNA, 785 bp, Homo sapiens
  misc_feature: GYAE6OF01D62DJ.29.78.H01.1.454.CMB.1.raw
tcagatagagtactcacgaccggtgctcgatttagtgtgagtagtttgggtttgggggcgcctgggtacgggccggggggtcgctgagactctcctgtgcggcctctggatttaagttttaggagtcatgccatgaactgggtccgccaggctccgaggggaaggggcgtggaggtgggtctcggcttagttagtggcagtggtggcgctatatattatgcagaccgcccgtaggaacgggtccggttccacctactttccagagactaattacgaaagaacacgctgtatctagacaaagtggagacgcctaggagacctacgacgaccgaccggtccgttacttatttagtttaggttaaggttaaaggcgagtcgtaggaacggtaccggggacccgggcccgtacgttacgaccgacggtcggggaccgaggggaccgcgtcggtacctaccgttcctccctcgaccgtccctacccgaaccgaaccgggacccgtaccgtacccggttccccgttcccccgtcccgtaccccgtacccctacccctacccgtaaccgaccgaccgtacccgtccggtcgggtccggaccgacgaccgaccgcccggtccggtccggtccgtccgtaccggtaccggtaaccggtaaccgttaaccgttacccgttaccgttaccgttaccgttacgttaccggtacggtactccgggggggggggggggggggggggggggggggtccgtacgggtaccggtaaccgggaccggacgtaacgtagtagcg

SEQ ID NO: 53540 - DNA, 644 bp, Homo sapiens
  misc_feature: GYAE6OF01E0UGH.29.78.H01.1.454.CMB.1.raw
  modified_base (406)..(406): a, c, t, g, unknown or other
  misc_feature (406)..(406): n is a, c, g, or t
  modified_base (639)..(639): a, c, t, g, unknown or other
  misc_feature (639)..(639): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagacacgctgtatctgcaaatggagagcctgagactcgacgacacggccgtctattatgtgttaaaggcgagctggaacgtacggggacccggggcccgacgttcgaccacgtcggggccagggggacgcgtcggtcaccgtctcccncacgccctccaccgaacggcccacgtccgtccttcccccgtcggcccaccctccctacccaacgacgaccaccctccgtcggggccacgtacgacacggcccgtacgggccgtcggcccgttcgggtaccgaacgggacccttacccgttaccgtacgttaccttaccttacgtccgtaggaacgggccggggtccgtcgggaccggtaaacgggtccggaccgaacgtaggngtacg

SEQ ID NO: 53541 - DNA, 663 bp, Homo sapiens
  misc_feature: GYAE6OF01BP4J6.29.78.H01.1.454.CMB.1.raw
  modified_base (248)..(248): a, c, t, g, unknown or other
  misc_feature (248)..(248): n is a, c, g, or t
  modified_base (404)..(404): a, c, t, g, unknown or other
  misc_feature (404)..(404): n is a, c, g, or t
  modified_base (473)..(473): a, c, t, g, unknown or other
  misc_feature (473)..(473): n is a, c, g, or t
  modified_base (492)..(492): a, c, t, g, unknown or other
  misc_feature (492)..(492): n is a, c, g, or t
tcagatagagtactcacgaccggtgctcgatttagtgtgagtagtttgggtttggggtctgagagaggagtccacccctgggatcttcaggtgttttcatttggtgatcaggacggaacagagagaactcaccatggagtttgggctgagcgtggtctttttctgtggtctaattttaaaaggtgtccagtgtgacgtgcagttggtggagtcgtgggggcgccgtggggtacgggccgggggggtcncgtgagactctccgtgtcgcggcctcgtggtaattaaggttttaggagtcattcgccaatgaactggggtcccgcgaggcctccgaaggggaaggggctgggaggtcgggtcgtcggcttagttaggtggcgaggtggtgcgtactagtatagttngcagaccgccgtaggaacgggccgttacaccgtattccgaagacgaactaagttacgaaagaacacgtntagtactctagactaaagnggagacgcgtagagactacgacgacgacgggtccttagttaactttagttaggtacggttaaacggcgtacgtacggtagggaaaccggtaccggggaccccggggtaccctaacggttccggaaccgtacgggtcggggacccgagggggcccgtccggtgggtaccccg

SEQ ID NO: 53542 - DNA, 784 bp, Homo sapiens
  misc_feature: GYAE6OF01CCHLJ.29.78.H01.1.454.CMB.1.raw
  modified_base (186)..(186): a, c, t, g, unknown or other
  misc_feature (186)..(186): n is a, c, g, or t
  modified_base (437)..(437): a, c, t, g, unknown or other
  misc_feature (437)..(437): n is a, c, g, or t
tcagatagagtactcacgaccggtgctcgatttagtgtgagtagtttgggtttggggtctgagagaggagtcccacccctgggatcttcaggttgttttcatttggtgatcgaggacggaacagagagaactcaccatggtaggtttggctgagcgtgtcgtttctggtgtcttaagtttaaaggngtccagtgtgacgtgctaggttgggtggagtcggtcgggggcgtccggtgggggtaccggggccgggggggtcgccgtgaggtcccttctccgtggtcggccggtccttcgtaggtaagttttaaggttttaggtagtctagtcgtaccagtagtacgtcgggtcccgaccgacggccgtaccggaagggggaacgggggcggtgggtaggtcgggtctcgggggggggggggggtacttagttaggtggngtaggtggtggcgtactatattattagtacgacgacgaccgtaccgtacggtacgggtaccggttaccgtaccgtacttaccgacgacgtaactaacgtacgtaacgaaccgtacgtacgtacgtagtacgtacgtaacgtaaggtaggaggacgtacgtagaacgaccgacgacccgaccgtacccggtaccgttaccgttagtttagttaaggttaacggttaacggtacgtacggtacggtacgggtaacgggtacccggggtaccccggggtaccccggtaccggttaccggacccggtacggtacggggaccgggaccggggacggtccggtccggtcccgg

SEQ ID NO: 53543 - DNA, 637 bp, Homo sapiens
  misc_feature: GYAE6OF01C9M6K.29.78.H01.1.454.CMB.1.raw
  modified_base (635)..(635): a, c, t, g, unknown or other
  misc_feature (635)..(635): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaagggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtagttaaaggcgagctaggaagtacggggacccggggcccgacttcgaccacgtggggccgaggggacgcgtggtccaccgtctcctcacgccctccgaccgaacgggccctacgtccggtccctttccccccgtcgggccctacccctccctacccaacgacgccacccgtcgtcggggccacgacgccacggcccgtgggcctcggcccgttacgggtaccgaacgggtaccttaaccttcccgtaacgttaccttccgttacgttccgtaggacggccggggacctcgggaccgaacgggaccgacgaagtcgncg

SEQ ID NO: 53544 - DNA, 587 bp, Homo sapiens
  misc_feature: GYAE6OF01E5QPN.29.78.H01.1.454.CMB.1.raw
  modified_base (273)..(273): a, c, t, g, unknown or other
  misc_feature (273)..(273): n is a, c, g, or t
  modified_base (580)..(580): a, c, t, g, unknown or other
  misc_feature (580)..(580): n is a, c, g, or t
  modified_base (585)..(586): a, c, t, g, unknown or other
  misc_feature (585)..(586): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatcngcaaatggagagcctgagactcgacgacacggccgtctattattgtgttaaaggcgagctggaatacgggaccgggcccgacttcgaccacgtggggccgaggggacgcgtggtcaccggtctccctcacgccctcccaccgaacgggcccactccggtccttccccctcgggcccacccctccctccaacgacgccaccctccgtcgggggccacgacgcacgcccgtgggcctgccgtcggacaacggactaccttccgtagtacctcttacgtctggacggtcgggcgtgggcgaacggccganagtgnng

SEQ ID NO: 53545 - DNA, 640 bp, Homo sapiens
  misc_feature: GYAE6OF01B4S6J.29.78.H01.1.454.CMB.1.raw
tcagatagagtactcacgaccggtgctcgatttagtgtgagtagtttgggtttggggggaagaggaagactgacggtccacccctgggatcttcaggtgttttcatttggtgatcaggacggaacagagagaactcaccatggagtttgggctgagctggctttttcttgtggctattttaaaaggtgtccagtgtgacgtgcagttggtggagtcgtgggggcgccgtggggtacgggccgggggggtcgctgagactctcctgtgcggcctcgtggatttaagttttaggagtcatgccatgaactgggtccgccaggctccgaggggaaggggcgtgggaggtgggtctcgggcttagttaggtggcaggtggtggcgctatatattatgcagacgcccgtggaacgggcccggttcacctactttccgagacgacaagttacgaaagaaccacgctgtatctgacaaagtggagacgccgtagagacctcggaccgaccgaccggtcccgttacttagtttattaggttagttaaaggcggagtcgtagggtaaacggtaccggggaccccggggtcccgtacgttcggaacccgcggtcgggggacccgaggggggccgtcggtcgggtaccccg

SEQ ID NO: 53546 - DNA, 737 bp, Homo sapiens
  misc_feature: GYAE6OF01C95EO.29.78.H01.1.454.CMB.1.raw
  modified_base (248)..(248): a, c, t, g, unknown or other
  misc_feature (248)..(248): n is a, c, g, or t
  modified_base (270)..(270): a, c, t, g, unknown or other
  misc_feature (270)..(270): n is a, c, g, or t
  modified_base (288)..(288): a, c, t, g, unknown or other
  misc_feature (288)..(288): n is a, c, g, or t
  modified_base (310)..(310): a, c, t, g, unknown or other
  misc_feature (310)..(310): n is a, c, g, or t
tcagatagagtactcacgaccggtgctcgatttagtgtgagtagtttgggtttggggggagagaggagtccacccctgggatcttcaggtgttttcatttggtgatcaggacggaacagagagaactcaccatggagtttgggctgagctggtctttttcttgtggcttaattttaaaaggtgtccagtgtgacgtgcagttggtggagtcgtggggggcgccgtggggtaccgggccgggggggtcnctgagctctcctgtgcggcctntggtatttaagttttggngtcatgccatgaactgggtccncaggctcgaggggagggctgggagtgggtctcggcttagttaggtggcgtaggttgggtggccgacttaagttattaatttatggaccgtaacggaccggtccccgtagggaaccgggggtccccggtttaccaaccccgttaattttccccgaaaggtacgtaaactaatttaccggaaacgaaaccgtacgtacttagttaacttcgtagaacaaagttacgggagacgccgtaggaacgtacctaccggaaccgacgaaccggtcccttacttatttagtttaggttaggtttaaacgggcgtaaggcgttaacggaaacgggttaccgggggaccccgggggtacccgtaacggttcggaccccggtacggtacgggggacccggtacgggggaccgtcgtacgggtcccgtacccggttccc

SEQ ID NO: 53547 - DNA, 716 bp, Homo sapiens
  misc_feature: GYAE6OF01DN126.29.78.H01.1.454.CMB.1.raw
  modified_base (85)..(85): a, c, t, g, unknown or other
  misc_feature (85)..(85): n is a, c, g, or t
  modified_base (123)..(123): a, c, t, g, unknown or other
  misc_feature (123)..(123): n is a, c, g, or t
  modified_base (137)..(137): a, c, t, g, unknown or other
  misc_feature (137)..(137): n is a, c, g, or t
  modified_base (161)..(161): a, c, t, g, unknown or other
  misc_feature (161)..(161): n is a, c, g, or t
  modified_base (165)..(165): a, c, t, g, unknown or other
  misc_feature (165)..(165): n is a, c, g, or t
  modified_base (172)..(172): a, c, t, g, unknown or other
  misc_feature (172)..(172): n is a, c, g, or t
  modified_base (180)..(180): a, c, t, g, unknown or other
  misc_feature (180)..(180): n is a, c, g, or t
  modified_base (192)..(192): a, c, t, g, unknown or other
  misc_feature (192)..(192): n is a, c, g, or t
  modified_base (235)..(235): a, c, t, g, unknown or other
  misc_feature (235)..(235): n is a, c, g, or t
  modified_base (274)..(274): a, c, t, g, unknown or other
  misc_feature (274)..(274): n is a, c, g, or t
  modified_base (287)..(287): a, c, t, g, unknown or other
  misc_feature (287)..(287): n is a, c, g, or t
  modified_base (306)..(306): a, c, t, g, unknown or other
  misc_feature (306)..(306): n is a, c, g, or t
tcagatagagtactcacgaccggtgctcgatttagtgtgagtagtttgggtttgggggcgcctggggtacgggccgggggggtcnctgagactctcctgagcggcctgcgaagtagttgatcntgcatgactggccnagcacgaggaggctggagtggtcncggntagtagngctgtggnggcctatatatnttagccgacgaaggacctccctggaacgggtccgttcaacctnttaccgagatacaagttcgaaaagcagttctatattccnggaaccaaagggnggacagtccgagacgtccncgacgtaccgtcggcttattacgtttgtacgtaggaacgcgacgtacgtaggaacgggtacccgggcccggaccgtagtacgaccggtaggaccgggacggacgggttcgcggtcggaccctacgtacctcccgtacaccgtacccacccgaccggaccgttcccgtaccggttcccgtaccccctccggagtaccccctacccggtacctaacgaaggtaccctacgttacccggttacgggtccgacacggtacgcccggttccgtccggtaacggtcctacccggttccgtaaccggtccgggtttaaaccctaccggtttaacccgtacggtacgttaccccgagtaacccgtcggtaccgggacggtcggagtacggacggtacggacgacgtacgtcgtcgtcg

SEQ ID NO: 53548 - DNA, 790 bp, Homo sapiens
  misc_feature: GYAE6OF01DQRBS.29.78.H01.1.454.CMB.1.raw
  modified_base (787)..(787): a, c, t, g, unknown or other
  misc_feature (787)..(787): n is a, c, g, or t
  modified_base (790)..(790): a, c, t, g, unknown or other
  misc_feature (790)..(790): n is a, c, g, or t
tcagatagagtactcacgaccggtgctcgatttagtgtgagtagtttgggtttgggggcgcctggggtacggccgggggggtcgctgagactctcctgtgcgggcctcgtggaattaagttttaggagtcatgccatgaactgggtccgccaggctccgaggggaaggggctggagtgggtctcggcttattaggtggcagtggtggcgctatattattatgcaggaccgccctggaagggccggttacacctatttccagaagacaattcgaagaaacacgcgtatatctgaacaaagtggagacgcctagacgtactacggaccgaccgaccggtccgttacttatttacgtttggttaaggttaaaggcgtagtcggtaaggtaacggtaacccgggggacccgggacccgtacgtacgaaccgtcgggtcgggggaccggtacggggaccgtcggtcggtccacccggttcctcccgtacgaccgtccccgtacccgaacccgaacccgggtcccgtacggttccccggttcccccgtttccccccggtccggtacccccttacccccgttaccccgaaacccgtaacggaccgtacccgtaccccgtaccggggttaccgggggaccaacccggcgacccggtacccgcccgggttcgggtcccgtcgggtcccgttacgggtaccgtaaaccggttaccttaacccgtacccgttaaccgtaccttacgttacgtcggttacggcggtccggggacgtagggaccgtagggaccacgtagngcn

SEQ ID NO: 53549 - DNA, 620 bp, Homo sapiens
  misc_feature: GYAE6OF01DFWKH.29.78.H01.1.454.CMB.1.raw
  modified_base (387)..(387): a, c, t, g, unknown or other
  misc_feature (387)..(387): n is a, c, g, or t
  modified_base (616)..(616): a, c, t, g, unknown or other
  misc_feature (616)..(616): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggaagagcctgagactcgacgacacggccgtctattattgtagttaaaggcgagctaggaacgtacggggacccgggccgacgttgaccaacgtggggccaggggacncgtggtcaccgtctcctcacgccctccaaccgaacgggcccagtccggtccttcccccgtgggcccacccctcctaccgaagacgccaccgtcgtcggggcacgagccacgcccgtagggcctcggtccgtggtacctaaggtacctaaccgttccgaacgttaccttccgtaacgttccgtaggacgggtcccgggcgttacgggaccgtaaacgggccgacagtagngacg

SEQ ID NO: 53550 - DNA, 667 bp, Homo sapiens
  misc_feature: GYAE6OF01A7FFP.29.78.H01.1.454.CMB.1.raw
  modified_base (502)..(502): a, c, t, g, unknown or other
  misc_feature (502)..(502): n is a, c, g, or t
  modified_base (666)..(666): a, c, t, g, unknown or other
  misc_feature (666)..(666): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagaccgccctggaagggccgttcacctatttccagagacaattcgaagaacacgctgtatctgacaaatggagagcctgagactcgacgacacggccgtctattattgtagttaaaggcgagctagggaagtaccggggacccgggcccgtattcggaacctacggtcggggacccgtagggggaccgcgtcgggtccaacccgttctcccgtcgaacgtccctacccaaccgaacggccccagtccggtccttcccccgtcggtccctacccctcctaccaacgacncctaccgtcggtcgggaccacgacgaccgacgcccgtagggcctaccggtcccgttacggtaccgtaacggtaccgttaaccttacccgaacgttacttacctaacgttccgtgggaccgggtccgggtccgtacgggaccgaacgggccgtacgtacgtgacng

SEQ ID NO: 53551 - DNA, 674 bp, Homo sapiens
  misc_feature: GYAE6OF01C3JGX.29.78.H01.1.454.CMB.1.raw
  modified_base (222)..(222): a, c, t, g, unknown or other
  misc_feature (222)..(222): n is a, c, g, or t
  modified_base (246)..(246): a, c, t, g, unknown or other
  misc_feature (246)..(246): n is a, c, g, or t
  modified_base (280)..(280): a, c, t, g, unknown or other
  misc_feature (280)..(280): n is a, c, g, or t
  modified_base (300)..(300): a, c, t, g, unknown or other
  misc_feature (300)..(300): n is a, c, g, or t
  modified_base (319)..(319): a, c, t, g, unknown or other
  misc_feature (319)..(319): n is a, c, g, or t
  modified_base (324)..(324): a, c, t, g, unknown or other
  misc_feature (324)..(324): n is a, c, g, or t
  modified_base (335)..(335): a, c, t, g, unknown or other
  misc_feature (335)..(335): n is a, c, g, or t
  modified_base (342)..(342): a, c, t, g, unknown or other
  misc_feature (342)..(342): n is a, c, g, or t
  modified_base (346)..(346): a, c, t, g, unknown or other
  misc_feature (346)..(346): n is a, c, g, or t
  modified_base (356)..(356): a, c, t, g, unknown or other
  misc_feature (356)..(356): n is a, c, g, or t
tcagatagagtactcacgaccggtgctcgatttagtgtgagtagtttgggtttggggtctgagagaggagtcccacccctgggatcttcaggtgttttcatttggtgatcaggacggaacagagagaactcaccatggagtttgggctgagcgtgtcgttttctaggtggctaagtttaaaaggtgtccagtgtgacgtgcagttggtggagtcgtggggcnccgtgggtaccggccggggggtcncgtgagctctctgtgcgctgtggatttagttagntcatgcatgtactcggtccncgaggctcggagggacggntaggngtggtctcggnttatggngcgngtggtggctnttagtattattagtagctagtacccgtccgtaggtaaccgggtccgttacccacttacttccgaagtacacgtacgttacgaaacgaccgacgtcgttagtactctagaacgtaaagtcggacgaacgtcgtaagacgtactccggaacgtaccgtaccgggtcccttattagttagtttacgttacgggtaaccgtagaacggttccgggtaaagggtaaccgggtaccccggggggaccccggtaccgtaccggttaccggaacccggtacgggtacggggtacccggacggggaccttccgggacggttaccccg

SEQ ID NO: 53552 - DNA, 692 bp, Homo sapiens
  misc_feature: GYAE6OF01BJ0S8.29.78.H01.1.454.CMB.1.raw
  modified_base (688)..(688): a, c, t, g, unknown or other
  misc_feature (688)..(688): n is a, c, g, or t
tcagatagagtactcacgaccggtgctcgatttagtgtgagtagtttgggtttggtggtctctctcccagcctgtgctgactcaatcgccctctgcctctgccctccctgggaggctcggtcaaggtcacctgtactctgagcagtggacacagcagctacgccatcgcttggcatcagcagaggccagacacgggcctcgttactgatgacagtcaacaatgatggcagtcacgaggacgaagggggacggatcccgtgactcgcttctcacgtcctccagcctcgtcgggcctggacgccgctaccctacaacaactccgtcccggcctccgagtctggaggatggacggtctagacttacgtttactggtaccacggtaccggtggggacctacggtggtccttaacgtttcggacggggtttacccgttaccgggggaacccggggtaacccgtaaagggttccccgaaccgggtttccgggtaccgggtaccgaaccggtacccccggaaacggaccccctaaacccccgtaccgtttcggtacccgtaaccttccccgttaccgtttacccccccaacccttcccgttaccgtaacgttaacccttcctaacgttccgtacgggtaaccggcccggggtacgtacgggacccgaacggggtcccgtaacgtaagtacggcgntcgg

SEQ ID NO: 53553 - DNA, 604 bp, Homo sapiens
  misc_feature: GYAE6OF01EODMP.29.78.H01.1.454.CMB.1.raw
  modified_base (600)..(600): a, c, t, g, unknown or other
  misc_feature (600)..(600): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtagttaaaggcgagcgtaggaagtacgggacccggggcccgacgttcgaccacgtggggccagggggaccgcgtggtccaccgtctcctcagccctccaccaacgggcccacgtccggtccttcccccgtcggccctacccctcctaccaacgacgccacctcgtcggggccacacgcacgcccgtagggcctcgccgtcggtacaacggaccttaccgttaccacgttacctactacgtcgtaggacggccgggctgggaccgaacgggccgacagtagntacg

SEQ ID NO: 53554 - DNA, 663 bp, Homo sapiens
  misc_feature: GYAE6OF01DDBND.29.78.H01.1.454.CMB.1.raw
  modified_base (182)..(182): a, c, t, g, unknown or other
  misc_feature (182)..(182): n is a, c, g, or t
  modified_base (196)..(196): a, c, t, g, unknown or other
  misc_feature (196)..(196): n is a, c, g, or t
  modified_base (244)..(244): a, c, t, g, unknown or other
  misc_feature (244)..(244): n is a, c, g, or t
  modified_base (269)..(269): a, c, t, g, unknown or other
  misc_feature (269)..(269): n is a, c, g, or t
  modified_base (292)..(292): a, c, t, g, unknown or other
  misc_feature (292)..(292): n is a, c, g, or t
  modified_base (305)..(305): a, c, t, g, unknown or other
  misc_feature (305)..(305): n is a, c, g, or t
  modified_base (328)..(328): a, c, t, g, unknown or other
  misc_feature (328)..(328): n is a, c, g, or t
  modified_base (338)..(338): a, c, t, g, unknown or other
  misc_feature (338)..(338): n is a, c, g, or t
  modified_base (347)..(347): a, c, t, g, unknown or other
  misc_feature (347)..(347): n is a, c, g, or t
  modified_base (352)..(352): a, c, t, g, unknown or other
  misc_feature (352)..(352): n is a, c, g, or t
  modified_base (368)..(368): a, c, t, g, unknown or other
  misc_feature (368)..(368): n is a, c, g, or t
tcagatagagtactcacgaccggtgctcgatttagtgtgagtagtttgggtttggggtctgagagaggagtccacccctgggatcttcaggttgttttcatttggtgatcaggacggaacagagagaactcaccatggagtttgggctgagcgtgtgtttctaggtgctaatttaaaaggtntcagtgtgacgtgnagttggtggagtcgtgggggcgccgtggggtacgggccgggggggtcncgtggagactctcctgtgcggcctntggtatttaagtttaggatcatncatgaactggccncgtaggctcgagggagggctggnggtggctggntagtgtggntaggnggtgctatatattatncgacgacgacgtccgtaggacgggtccgttacacgtacgttacagacgaactaacgtacgaaacgacacgtatagtactctacgaataaggtaggaacgtgtaccgtagacgtaccgtacggaaccgaccggtacggttccgtactttaagtttaggttaacggttaggtaacggcgtacggttacgtaacggggtaaacccgggtaaccggggggaccccggggtaccttaaccgttaccgggaccggtacggggtacgggaccggggacgggtaccggtcggtcggtacccgg

SEQ ID NO: 53555 - DNA, 763 bp, Homo sapiens
  misc_feature: GYAE6OF01D3O1A.29.78.H01.1.454.CMB.1.raw
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccgaggggaaggggctggagtgggtctcggctattagtggcagtggtggcgctatatattatgcagacgccctgaacggggtccgttcacctatttccagacgaacaattcgaaagaacacgctgtatctgacaaatcggagagcctgagactcgacgacgaccggccgtcttattagttggtaggttaaaaggcgtaaggcttagggaaacgtaccgggggacccggggacccgtacgttcggaacccgacggtcgggggacccgtaagggggacgcgtgggtaccctaccggtccttacccgtcgaccgtcccgtacccgaaccggtaaccgggcccctaacggttcccggttcccttccccccgtcgggtacccctacccccgtaccctacccgaaacggaccgtacccgtacccgttcgggtccggggaccaacgacgccgaccgtccccgggtcgggtccgtccgggtacccggttacgggtaacccgtaacggggtaacccttacccggtttacccgtaacggttacccttaccgttaacgtccgtaggtaccggggcccggtacggtacgggtaaccggaccggtacgacccgtacgtagcgtg

SEQ ID NO: 53556 - DNA, 632 bp, Homo sapiens
  misc_feature: GYAE6OF01DUUUQ.29.78.H01.1.454.CMB.1.raw
  modified_base (630)..(630): a, c, t, g, unknown or other
  misc_feature (630)..(630): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtagttaaggcgagctggaagtacgggaccggggccgacttggaccacgtcggggccaggggcgcgtcggtcaccgtctcctcacgcctccaccgaacgggcccacgtccggtccttcccccgtcggtcccacccctccctaccaacgacgaccacccgtccgtcgggggcctacgacgccgacgtcccgtcgggccgtcggtcccgtcgggttaccgaacggtaccgttaacccgttccctacgttaccgttacttacgttcgttacggacgggtccgggaccgtcgggacggaacgggccgacacgtgtncg

SEQ ID NO: 53557 - DNA, 775 bp, Homo sapiens
  misc_feature: GYAE6OF01D0WHQ.29.78.H01.1.454.CMB.1.raw
  modified_base (236)..(236): a, c, t, g, unknown or other
  misc_feature (236)..(236): n is a, c, g, or t
tcagatagagtactcacgaccggtgctcgatttagtgtgagtagtttgggtttggggtccgagccatggtgcagactcccagagctctcctcctcctccactgcacagggtctctctcccagcctgtgctgactcaatccgccctctgcctctcgccctccgtgggaggctcggtacaaggtccaccttgtactctgagcaggtcggaacacagcagctacgccatcgcttggcancagcaggacgccaagacgaccgggtccctagttacttgatacgaactagtaacaaactaagtgagtcggacagtacacgaacggacgggaacggggggtaccggacttcccgtaggtaactccgtcgttctacgtacgtcctacccgtagtccgtcggtacgggtccgtaggtacgccgtaccttaccgacctaactaaccgttccgtaccccgggtcccttaccggtacggttaaccgtgggaaaggtacgttacggaacggtacgttaacgttaacttaacgtttacgtcggtaacccggaaggtttacccgggacggggtaacctacgggtcgggttaaacctacgggttttacccggtaacggggttaccggggttaacccggggaaaacccggggtacccgggttaaaaacgggttcccccggttaaccgggttcccgggtacgtacccggaaaccggacccccggtaaacccggaacccctaaccccgttacgtcgtttaaccccgaaccgtttccgttacccggttcccccg

SEQ ID NO: 53558 - DNA, 626 bp, Homo sapiens
  misc_feature: GYAE6OF01A6BDV.29.78.H01.1.454.CMB.1.raw
  modified_base (536)..(536): a, c, t, g, unknown or other
  misc_feature (536)..(536): n is a, c, g, or t
  modified_base (622)..(622): a, c, t, g, unknown or other
  misc_feature (622)..(622): n is a, c, g, or t
  modified_base (626)..(626): a, c, t, g, unknown or other
  misc_feature (626)..(626): n is a, c, g, or t
tcagatagagtactcacgaccggtgctcgatttagtgtgagtagtttgggtttggtggtctctctcccagcctgtgctgactcaatcgccctctgcctctgcctccctgggaggctcggtcaaggtcacctgtactctgagcagtggacacagcagctacgccatcgcttggcatcagcagaggccagacaccgggccctcgttacttgatgacagtcaacaatgatggcagtcacaggacgaagggggacggactcccgtgactcgcttctcagtcctccagcctcgtgggcctgacgcgctacctcacactccgtccggcctcgagtctggagtatggaggtctagacttacttacgtgtacgaacgcccggtggggcctaggtggacctagttcggacggttacccggttaccggggaacccggggtaactacgggtccgtacccgggtcggtacccggtcaccggaccccgaaccgggtcccccaaaccccgttcgtcggtacccaccgttcccgttcccggtttacccccncccttcctaccgtacgttaccctacttacgttcggacggtaccgggcgggtccgtacgggactaacggggccttagaacggtacgncgtn

SEQ ID NO: 53559 - DNA, 678 bp, Homo sapiens
  misc_feature: GYAE6OF01DQISW.29.78.H01.1.454.CMB.1.raw
  modified_base (211)..(211): a, c, t, g, unknown or other
  misc_feature (211)..(211): n is a, c, g, or t
  modified_base (657)..(678): a, c, t, g, unknown or other
  misc_feature (657)..(678): n is a, c, g, or t
tcagatagagtactcacgaccggtgctcgatttagtgtgagtagtttgggtttgggaggctcggtcaaggtcacctgtactctgagcagtggacacagcagctacaccatcgcttggcatcagcagaggccagacacgggccctcgttacttgatgacagtcaacaatgatggcagtcacagcgaagggggacggatccctgatcgcttcncacgtctccagtctcgtgggcctgacgccgctacctacaactaactccgtccggccttccgagttcgaggacggtatggaacggtcctagtaacctttagttacctgttaccgaacggtacccggtgggggacctacggttggaccttacgtttccggtaacgggtttcccggttacccggggaaaccccgggggtaacctaaacggggttcccgtaaacccggggtttccgggtaccgggtaccaacccggggtaaccccccgaaaacccggggtaccccctaaacccccgtacgtttccggtaaccccttacccgtttaccggtttccccgtttccccccgtacccctttaccccgttaacgtaaccggtttacccttccgttaacgttcccgggtacgggttaccggccggggtcctacgggaccgaacggccgacagtacgnnnnnnnnnnnnnnnnnnnnnn

SEQ ID NO: 53560 - DNA, 662 bp, Homo sapiens
  misc_feature: GYAE6OF01CECRR.29.78.H01.1.454.CMB.1.raw
  modified_base (653)..(653): a, c, t, g, unknown or other
  misc_feature (653)..(653): n is a, c, g, or t
  modified_base (660)..(660): a, c, t, g, unknown or other
  misc_feature (660)..(660): n is a, c, g, or t
tcagatagagtactcacgaccggtgctcgatttagtgtgagtagtttgggtttgggggcgcctgggtacgggccgggggggtcgctgagactctcctgtgcggcctctggattaagttttaggagtcatgccatgaactgggtccgccaggctccgagggaaggggctggagtgggtctcggctattagtggcagtggtggcgctatatattatgcagacgccctgaagggccggttcaccatttccagagacaattcgaagaacacgctgtatctgacaaatggagagcctgagactcgacgacacggccgtctattattgtagttaaaggcgagcgtaggaaagtacggggacccggggcccgacgttcgaccacggtcgggggccgaagggggacgcgtcgggtccaccgtcctcccgtcacggccctcccgaacccgtaacggggcccctaacgtccgggttcccctttccccccgtcggcccctacccccttcccgtacccaaacggacgacccacccgtccggtcgggggaccacgacgccgacgcccgtgggccgtcgtcccgtggtaccgaacggaccttaccgttccgaacgttaccgtaccttacgtccgtaggaccggcgggaccgtggacgaacgggcganacgtagngc

SEQ ID NO: 53561 - DNA, 723 bp, Homo sapiens
  misc_feature: GYAE6OF01CUIJO.29.78.H01.1.454.CMB.1.raw
  modified_base (721)..(721): a, c, t, g, unknown or other
  misc_feature (721)..(721): n is a, c, g, or t
tcagatagagtactcacgaccggtgctcgatttagtgtgagtagtttgggtttgggggcgcctgggtacggccgggggggtcgctgagactctcctgtgcggcctctggattaaagttttaggagtcatgccatgaactgggtccgccaggctccgagggaaggggctggagtgggtctcggctattagtggcagtggtgcgctatatattatgcagacgccctgaagggtcggttcaccatttccagagacaattcgaaagaacacgctgtaatctgacaaagtggagagcctgagactgacgacacggccgtctattattgtagttaaaaggcgagtcgtaggaaacgtaccggggaccccggggcccgtaacgttcggaacccacggtcgggggacccgaggggggaccgcgttcggtccgaacccgttccgtccctcgtacgcccctacccaaccgaacggggacccctaacggttccggtttcccccttcccccccgtcgggccccctacccccgtaccctaccccaaacggacgtacccgacccgttcggtacggggcccaaccgacgccgaccggtccccgtcgggggtcccttacgggcccgttcgggtacccaaacggggtacccttaaccgttacccgtaacgttaccttacttacgtccgttagggacggtccggggcgttcgggaccgtaagggccgacctaaggtgtncg

SEQ ID NO: 53562 - DNA, 659 bp, Homo sapiens
  misc_feature: GYAE6OF01CDG8G.29.78.H01.1.454.CMB.1.raw
  modified_base (656)..(656): a, c, t, g, unknown or other
  misc_feature (656)..(656): n is a, c, g, or t
tcagatagagtactcacgaccggtgctcgatttagtgtgagtagtttgggtttgggggcgcctgggtacggccgggggggtcgctgagactctcctgtgcggcctctggatttaagttttaggagtcatgccatgaactgggtccgccaggctccgagggaaggggctggagtgggtctcggctattagtggcagtggtggcgctatatattatgcagacgccctggaagggccggttcaccatttccagagacaattcgaagaacacgctgtatctgacaaaatggagagcctgagactcgacgacacggccgtctattattgtagttaaaggcgagctaggaaagtacggggacccgggcccgtacttcggaccgacgtcgggggccgaagggggacgcgtcgggtccaccgtctcctcacgtccctccaacccgaacgggccccacgttcccggtacctttcccccccgtcgggtcccctacccccgttccctacccgaaacgaccgaccctacccgtccggtacgggggccaaccgacgaccgacgcccgtacgggcctcggtcccgtcggtacgaacggtacctacgttccacgttaccttctacgtcgtagacggtcgggcctcgggacgtaacgggacgcgtaagtggnacg

SEQ ID NO: 53563 - DNA, 896 bp, Homo sapiens
  misc_feature: GYAE6OF01DKJOY.29.78.H01.1.454.CMB.1.raw
  modified_base (218)..(218): a, c, t, g, unknown or other
  misc_feature (218)..(218): n is a, c, g, or t
  modified_base (243)..(243): a, c, t, g, unknown or other
  misc_feature (243)..(243): n is a, c, g, or t
tcagatagagtactcacgaccggtgctcgatttagtgtgagtagtttgggtttgggggagagaggagtcccacccctgggatcttcaggttgttttcatttggtgatcaggacggaacagagagaactcaccatggagtttgggctgagctggtcttttctgtggctaattttaaaaggtgtccagtgtgacgtgcagttggtggagtcgtgggggcnccgtggggtacgggccggggggtcncgtgagactctccgtgtgccggtcctcgtggtatttaaaggttttaggagttcatcggacctaatcgaacgtcggggtcccgacgaggccgtaccggaagggggaacgggggtcgtagggacggtcggggttcctccgggtacttaagttagggtcggacgtaggttgggtcggtccgtattaagtaattagtttaacgcgacgaacgacccggtacccgtagggaaaccgggggttcccgttacctaaccgtaacgttttaccccggaaaggtaacgtaaaccgtaaacggtttaccggaaaaacgtaaaccgtaaccggtaccgtttagttaaacgttacgtaacggtaaaccgtaaaaggtacgggaacggtaaccggtacccgttaggaaccggtaacccgttaaccggaacccgtaaccgggtaccccgggtacccgttacgtttaaccgttttagtttaacgggttaacgggtttaaaacgggaccggtaacgttcggtaaggggtaaaacccgggtaacccgggggtaacccccgggggtaccccgtaaccgttaaccgggtaacccccggtacgggtcccgggggaaacccgggtacgggggtaccccgtacggttaccgggtcccggaacccggtttcccccgg

SEQ ID NO: 53564 - DNA, 793 bp, Homo sapiens
  misc_feature: GYAE6OF01EZG64.29.78.H01.1.454.CMB.1.raw
  modified_base (789)..(789): a, c, t, g, unknown or other
  misc_feature (789)..(789): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagactaattcgaagaacacgctgtatctgacaaagtggagacgcctagacgacgtcggacgaccgaccggtccgtctatttagttggtaggttaaacggcgaggtacgtaggaaacggtaaccggggaccccggggaccccgtacgttacgacccgtaccggtcggggacccggaagggggaccgcggttcggtacccgacccgtcctccccgtcgtaaccgcccttaccccgaacccgtaaccgggcccctaaccggttcccggttccccgtttccccccgtccgggtaccccctacccccgttcccgtaacccgaaaccggacccgaccccgtaacccgttccgggtaccgggggacccaaccgaccggtacccgacccggtccccggtacgggcccgttccgggtacccggttacggtacccgtaaccgggttaccccttaaccgtacccgtacgttacccgttaccgttacgtaccgttcgggtacggtcccgggtaccggtacgggtaccggaaccgggtacgtaccgtacgtacgngtcg

SEQ ID NO: 53565 - DNA, 681 bp, Homo sapiens
  misc_feature: GYAE6OF01EYIZR.29.78.H01.1.454.CMB.1.raw
  modified_base (677)..(677): a, c, t, g, unknown or other
  misc_feature (677)..(677): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaacgggccggttcacctatttccagagacaattcgaaagaacacgctgtatctgacaaagtggagacgcctgacgactcgacgacgacggccgtactattagtttgtaggttaaggcgagtcgtaggaacggtaccggggacccggggcccgtacgttcgaccgacggtcggggaccgacgggggaccgcgtcggtccgacccgtctccgcgacgccctacccaccgaccggccacgttcccggtccctccccgtcgaccctaccctcctacgaacgcgcctaccgtccggtcggggaccacgacgccgacgtcccgtacggccgtacggtcccgtggtaaccgaacggttacctacccgttacctaacggttaccttacgttaacgttcgtacgggtaccgggtccgggtaccggttacgggaacgggtacgggtacccgaagttacgaggntacg

SEQ ID NO: 53566 - DNA, 617 bp, Homo sapiens
  misc_feature: GYAE6OF01AT3YI.29.78.H01.1.454.CMB.1.raw
  modified_base (251)..(251): a, c, t, g, unknown or other
  misc_feature (251)..(251): n is a, c, g, or t
  modified_base (267)..(267): a, c, t, g, unknown or other
  misc_feature (267)..(267): n is a, c, g, or t
  modified_base (323)..(323): a, c, t, g, unknown or other
  misc_feature (323)..(323): n is a, c, g, or t
  modified_base (531)..(531): a, c, t, g, unknown or other
  misc_feature (531)..(531): n is a, c, g, or t
  modified_base (611)..(611): a, c, t, g, unknown or other
  misc_feature (611)..(611): n is a, c, g, or t
  modified_base (614)..(614): a, c, t, g, unknown or other
  misc_feature (614)..(614): n is a, c, g, or t
tcagatagagtactcacgaccggtgctcgatttagtgtgagtagtttgggtttggtggtctctctcccagcctgtgctgactcaatcgccctctgcctctgcctccctgggaggctcggtcaaggtcacctgtactctgagcagtggacacagcagctacgccatcgcttggcatcagcagaggccagacacgggccctcgttacttgatgacagtcaacaatgatggcagtcacagcgaagggggacggntccctgactcgcttcncagtctccagctctgggcctgacgcactacctcacaactcctccggcctccagtcngacggatcggagctagacttacgttactgtacgacggtacccgtggggacctacgtgggtacctacgtttcgacggggttcccgtttaccggggaacccggggtaacctaacgggtcccgtaacccggttcggtaccggtccgaaccggaccccgaacggacccccaacccctcgtacggttaccccacttcccgttcccgttccccncccgttacccgtaccgtacgttacctccgtactccgtcggtaaccggcggtccgttacgggacctaacgggcacgatcgngtnacg

SEQ ID NO: 53567 - DNA, 679 bp, Homo sapiens
  misc_feature: GYAE6OF01DU926.29.78.H01.1.454.CMB.1.raw
  modified_base (324)..(324): a, c, t, g, unknown or other
  misc_feature (324)..(324): n is a, c, g, or t
tcagatagagtactcacgaccggtgctcgatttagtgtgagtagtttgggtttggggtctgagagaggagtccacccctgggatcttcaggtgttttcatttggtgatcaggacggaacagagagaactcaccatggaggtttgggctgagcgtgtcttttcttagtggctattttaaaaggtgtcagtgtgacgtgcagttggtggagtcgtgggggcgccgtggggtacgggccgggggggtccgtgagctctctgtgcgctcgtggattagtttagagtcatcgcatgacgtggccgcgagctccgagggagggcgagggnggtcggtcgtcggtctagttaggtggcgtaggtggtggcgctattatattagtgcgtagaccgccgtaggaacgggtcccgttacaccgttacttacccgagagactaacgttaacgaacgaacgtacgcgttagtaactcgtagaacgtaaagtgggaagacgtaccgtagacgaccgtcggaaccgaccgaccgggtccgttattaacgtttagttaggttacggttaaggcgtacggtacggtaagggaaccggtaccgggggtaccccggggacccgttaccggttaccggaaccccggtacgggttaccggggacccgtaacgggggtccgtcgggtccggttaccccgg

SEQ ID NO: 53568 - DNA, 789 bp, Homo sapiens
  misc_feature: GYAE6OF01B9ELD.29.78.H01.1.454.CMB.1.raw
  modified_base (210)..(210): a, c, t, g, unknown or other
  misc_feature (210)..(210): n is a, c, g, or t
  modified_base (217)..(217): a, c, t, g, unknown or other
  misc_feature (217)..(217): n is a, c, g, or t
tcagatagagtactcacgaccggtgctcgatttagtgtgagtagtttgggtttggggcgcctgggtacggccggggggtcgctgagactctcctgtgcggcctctggattaagttttaggagtcatgccatgaactgggtccgccaggctccgagggaagggctggagtgggtctcggctattagtggcagtggtggcgctatatattangcagacncccgtgaacggccgttcacctatttccagagacaattcgaaagaacacgctgtatctagacaaagtggaagagcctagacgactcgacgacaaccggtccgtatactttatgttagttaaaaggcgagctaggaaacgtaccggggacccgggcctacgttcgaaccaccggtggggaccagggggacgcgtggtacaacccggttcgtcctcgaacgtccctaccaaccgaacgggaccccgtaacgttccggttaccccgtttccccccggtacgggtacccctaccccgttacccgtacccgtaaacggacccgacccgtaaccccggtttaccggtaccggggggaaccctaacccggtaacggacccggtaacccggtacccccgggttcggggtacccgttacccgggtcccgtaccgggtttaaccggtaaaccgggtacccgtttaacccgtttacccggtaaacgttacccgtttaaccgttaccgtttaccgtacgggtacgggtacccggggtccgttaccgggaaccgaaccgggaccgttaacgaaccgttgggctacg

SEQ ID NO: 53569 - DNA, 588 bp, Homo sapiens
  misc_feature: GYAE6OF01B6L63.29.78.H01.1.454.CMB.1.raw
  modified_base (487)..(487): a, c, t, g, unknown or other
  misc_feature (487)..(487): n is a, c, g, or t
  modified_base (586)..(586): a, c, t, g, unknown or other
  misc_feature (586)..(586): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgacaaatggagagcctgagactcgacgacacggccgtctattattgtagttaaaggcgagcgtggaagtacgggacccgggcccgacttgaccacgtcggggccaggggacgcgtggtcaccgtctcctcagccctccaccgaacgggcccagtccggtccttcccccgtggcccaccctcctaccaagcgccacccgtcgtcggggccacgngccgacgcccgtgggctcgccgtggtacaacggtacctaccgttccgacgtacctactacgtcgtagacggccggcgtcggacgaacggcgacacgtgncg

SEQ ID NO: 53570 - DNA, 630 bp, Homo sapiens
  misc_feature: GYAE6OF01B75V7.29.78.H01.1.454.CMB.1.raw
  modified_base (387)..(387): a, c, t, g, unknown or other
  misc_feature (387)..(387): n is a, c, g, or t
  modified_base (625)..(625): a, c, t, g, unknown or other
  misc_feature (625)..(625): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtagttaaaggcgagctggaagtaccggggaccggggcccacgttcgaccacgtggggccagggggacncgtcggtccaccgtctcctcacgccctccaccgacgggcccatccggttcctcccccgtcgcccaccctccctccaacgacgccaccgtccgtcggggcaccgacgcgacgcccgtcgggcctcgtcccgtcggtacaacggtaccttaccttccgaacgttaccgtaccgttaacgttccgtacggtaacggtccggggtaccgtcgggaccggaacgggtcggacctacgtaacgngtacg

SEQ ID NO: 53571 - DNA, 606 bp, Homo sapiens
  misc_feature: GYAE6OF01A1HFN.29.78.H01.1.454.CMB.1.raw
tcagatagagtactcacgaccggtgctcgatttagtgtgagtagtttgggtttgggggcagggtgtacacctgtggttctcggggctgccctttggctttggagatggttttctcgatggggggctgggagggcttttgttggagaccttgcacttgtactccttgccattcagccagtcctggtgcagggacggtgaggacgctgaccacacggtacgtgctgttgtactgctcctcccgcggtctttgtcttggcattatgccacctccacgccgtccacgtaccagttgaacttgacctcaggtcttcgtggctcacgtccaccaccacgcatgtcgacctcgaggggtccgggagatcagtgagggtgttccgttggggtttgggggaaggagggaagacgtcgaccggtcccccgaggtacgttcgaggtgcgtgggcacgggtgggcagtggtgtggtagtttgtacacgtaagtagtttgggctctaactttcttcgtcctacgtttggtgtttgcgtggtcgttgtgtacttcgtacggttgacgaggtattggttaggttcggttcggggtacgtacccgaagtccgtggtaccggg

SEQ ID NO: 53572 - DNA, 564 bp, Homo sapiens
  misc_feature: GYAE6OF01C2QI2.29.78.H01.1.454.CMB.1.raw
  modified_base (232)..(232): a, c, t, g, unknown or other
  misc_feature (232)..(232): n is a, c, g, or t
  modified_base (300)..(300): a, c, t, g, unknown or other
  misc_feature (300)..(300): n is a, c, g, or t
  modified_base (320)..(320): a, c, t, g, unknown or other
  misc_feature (320)..(320): n is a, c, g, or t
  modified_base (348)..(348): a, c, t, g, unknown or other
  misc_feature (348)..(348): n is a, c, g, or t
  modified_base (455)..(455): a, c, t, g, unknown or other
  misc_feature (455)..(455): n is a, c, g, or t
  modified_base (559)..(559): a, c, t, g, unknown or other
  misc_feature (559)..(559): n is a, c, g, or t
tcagatagagtactcacgaccggtgctcgatttagtgtgagtagtttgggtttggtggtctctctcccagcctgtgctgactcaatcgccctctgcctctgcctccctgggaggctcggtcaaggtcacctgtactctgagcagtggacacagcagctacgccatcgcttggcatcagcagaggccagacacgggcctgttactgatgacagtcaacaatgatggcagtcanagcgaagggggcggatcccgtgactcgcttactcagtctcgagtctcgtgggacctgacgcgctaccncactactccgtccggcctcngtcgtgagatgagctagacttagttacncgtcacgtaccgtgggctacgtggtacacgtttcgacgggttccgtacggggacccgggactaaggtccgaaccggttcgacggtcacgcccgaagcccaacccgtntcgacctcgtccctaccgtcccctaccgtctacaacgttccttaccgtagttccgacggtacggcccgggtcctacgggtaacccgaggtcccgtacaagtcgngtagc

SEQ ID NO: 53573 - DNA, 819 bp, Homo sapiens
  misc_feature: GYAE6OF01C7VHE.29.78.H01.1.454.CMB.1.raw
  modified_base (249)..(249): a, c, t, g, unknown or other
  misc_feature (249)..(249): n is a, c, g, or t
tcagatagagtactcacgaccggtgctcgatttagtgtgagtagtttgggtttggggtctgagagaggagtccacccctgggatcttcaggtgttttcatttggtgatcaggacggaacagagagaactcaccatggagtttgggctgagctggtctttttctgtggcttaattttaaaaggtgtccagtgtgacgtgcaggttggtggagtcgtgggggcgccgtggggtaccgggccgggggggtcncgtgagacctctcctggtgccggcctcgtggtatttaaggtttaggtagtcaatcgccatgaactggggtccgccgaggcctaccggaggggaaggggctagggaggttgggtcgtcggtcttagttaggtggtcgtagggtgggtgggtcgtacttaattattaagtttaagttgacgaggaacccgtacccgtaggtaaaccggggtcccggtttaccaaccccgttattttacccgaaggtacgaaactaaacgttaccggaaaagaaaccgtaccgtacgttagttaactacgtagaccgtaaaagtagggaacgtacggtccgtaggaacgtacgtaccgggaacccgaaccggtacccggtacccggtttacttaaacgttttacgtttacggttagggttaaacgggtacggtaacgtaccggttaaggggtaaaccgggtaaacccgggggggaccccggggttacccccgggtaacggttacccgggtaaccccggtaccggggtaccgggggaccccggtaaacggggggtacccgggtccggttccggggttaccccgg

SEQ ID NO: 53574 - DNA, 655 bp, Homo sapiens
  misc_feature: GYAE6OF01A2W4O.29.78.H01.1.454.CMB.1.raw
  modified_base (410)..(410): a, c, t, g, unknown or other
  misc_feature (410)..(410): n is a, c, g, or t
  modified_base (651)..(651): a, c, t, g, unknown or other
  misc_feature (651)..(651): n is a, c, g, or t
tcagatagagtactcacgaccggtgctcgatttagtgtgagtagtttgggtttgggggcgcctgggtacggccggggggtcgctgagactctcctgtgcggcctctggatttaagttttaggagtcatgccatgaactgggtccgccaggctccagggaaggggctggagtgggtctcggctattagtggcagtggtggcgctatatattatgcagacgcctgaagggccgttcacatttccagagacaattcgaaagaacacgctagtatctgacaaagtggaagagcctgagactcgacgacgacggccgtacttattagttgtaggttaaaggcgagcgttagggaaacgtaccggggacccgggacccgtagttacggaccacggtgggggacccgagggggaccncgtagggtccacccggttctccctacgacggtccctacccgaaccgaacgggcccctaacgtccggttcccttcccccgtggccccaccctccctaccaacgaccgccacccgtcgtcggggaccacgacgccacgcccgtacgggcctcgtccgtacggacaacggtaccttaccgttccacgttacctcttacgtcgtaggacggtcgggaccgtggaccggtaacggcgacgacgtgngtcg

SEQ ID NO: 53575 - DNA, 720 bp, Homo sapiens
  misc_feature: GYAE6OF01CVX68.29.78.H01.1.454.CMB.1.raw
  modified_base (100)..(100): a, c, t, g, unknown or other
  misc_feature (100)..(100): n is a, c, g, or t
  modified_base (716)..(716): a, c, t, g, unknown or other
  misc_feature (716)..(716): n is a, c, g, or t
tcagatagagtactcacgaccggtgctcgatttagtgtgagtagtttgggtttgggggcgcctgggtacggccgggggggtcgctgagactctcctgtgnggcctctggatttaagttttaggagtcatgccatgaactggggtccgccaggctccagggaaggggctggagtgggtctcggctattagtggcagtggtggcgctatatattatgcagacgccctggaacgggccggttcacctatttccagagacaattcgaagacacgctgtatctgacaaagtggagagcctgagactcgacgacacggccgtctattattgtagtaaaggcgaagctaggaacgtaccgggggccgggcccgacttacggaacccacggtcggggggacccaggggggaccgcgtgggtccacccggttctccctacgacgtcccctaccgaacccgaacgggccctacgtccggttccccttcccccgtcgggacccctaccctccctacccgaacgtcgacccgtacccgttccggtcgggggacctaccgacggaccgtacggccccggtaggggccctaccgggtcccgttacgggtaacccgaacgggtaccctttaacccgttacccgtaacggttacccttaccgttacgtaccgttagggacgggtcccggggtcgttacgggacccgtaaacggggccgaccgtacggtacgngtcg

SEQ ID NO: 53576 - DNA, 668 bp, Homo sapiens
  misc_feature: GYAE6OF01AHWC7.29.78.H01.1.454.CMB.1.raw
  modified_base (664)..(664): a, c, t, g, unknown or other
  misc_feature (664)..(664): n is a, c, g, or t
  modified_base (666)..(666): a, c, t, g, unknown or other
  misc_feature (666)..(666): n is a, c, g, or t
  modified_base (668)..(668): a, c, t, g, unknown or other
  misc_feature (668)..(668): n is a, c, g, or t
tcagatagagtactcacgaccggtgctcgatttagtgtgagtagtttgggtttgggggcgcctgggtacggccgggggggtcgctgagactctcctgtgcggcctctggatttaagttttaggagtcatgccatgaactgggtccgccaggctccgaggggaaggggctggagtgggtctcggctattagtggcagtggtggcgctatatattatgcagacgccctaggaacgggccgttcacctatttccagagacaattacgaagaacacgctagtatctgacaagtggagagcctgagacctacgaccgacgaccggcgtactattagttgtagttaaggcgagtcgtaggaacggtaccggggacccggggacccgtacgttacggacctacggtcggggaccgaggggacgcgtcggtccgacccgtcctcctcacgccctccgaacccgaacgggcccacgttcccggttccccgttacccccgtcggacccctacccctaccctaccgaacgacgtaccctaccgtcgggtacggggccacggtacgcccgacgtcccggtacgggcctccggtccgtcggtacgaaccggtacttacctaccgacgttacctccttacgtcgtcggacgggccggtcgtacggcgaacggtcacangngn

SEQ ID NO: 53577 - DNA, 721 bp, Homo sapiens
  misc_feature: GYAE6OF01C4TEQ.29.78.H01.1.454.CMB.1.raw
tcagatagagtactcacgaccggtgctcgatttagtgtgagtagtttgggtttgggggcgcctgggtacggccgggggggtcgctgagactctcctgtgcggcctctggatttaagttttaggagtcatgccatgaactgggtccgccaggctccgagggaagggctggagtgggtctcggctattagtggcagtggtggcgctatattattatgcagaccgccctaggaacggggtcccggttcaaccgtatttcccagagacaattcgaaagaacacgctgtatctgacaaaagtggagacgcctagacgtacgtacgaaccgaccgaccggtccgtacttaattagtttaggttaaggttaaaggcggtaacgcgttaacgggaaacggtaccggggaccccggggtcccgtaacgttcgacccgtacggtacggggaccgaggggacgtcgtacggtaccgaccgtccgtccgtacgacgtccctacccaaccgaacggccctacgtcccggttacccttccccgcggacccctaccctacctaccgacgacgaccgtaccgtcggtacggggacacgcgcgacgccgtggacctcgtcgtcggtaactaacgggtacccttaccgttaccgtacgttaccttacgttaacgttcggaggtacgggtcccgggtaccgtacgggaccgaaacgggtcccgaactaaggtcgagtccg

SEQ ID NO: 53578 - DNA, 671 bp, Homo sapiens
  misc_feature: GYAE6OF01BD1HU.29.78.H01.1.454.CMB.1.raw
  modified_base (403)..(403): a, c, t, g, unknown or other
  misc_feature (403)..(403): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaaagaacacgctgtatctgcaaatggagagcctggacgactcgaacgaccacggccgtcttattattgttaggttaaaggcgagcgtagggaagtaaccggggaccggggcccgacgttcgaccacggtggggccgagggggaccncgtcggtcacccgttctccctcacgccctaccaccgaacgggcccgactccggttccttcccccgtcggccccaccctccctacctaacgaccgtacctacccgtcggtcggggaccacgacgccacggcccgtcgggtccgtcggtccgtacgggtaccgaacggtaccttaccgttacccgacgttaccctccttaacgttcgtacggtacgggtcccggggtaccgttcggggaacctaacggggacccgacgtaactgggatcg

SEQ ID NO: 53579 - DNA, 1009 bp, Homo sapiens
  misc_feature: GYAE6OF01AMYDC.29.78.H01.1.454.CMB.1.raw
tcagatagagtactcacgaccggtgctcgatttagtgtgagtagtttgggtttggggcgcctgggtacggccggggggtcgctgagactctcctgtgcggcctctggatttaagttttaggagtcatcgccatgaacgtcgggtccgccgaggctccgaggggaggggcgtgggaggtgggtcgtcggcttagttaggtggcgaggtgggtggcgtactattattattagtgacacgaccgtcccgtaggaacggggtccgttacaccgtactttccgaagacgactaagttacgaaacgtaaccgacgtcgttagttactcgtcgaacgtaaagtggaagacgtccgtagaacgacgtaccgacgaaccgaccggtccgttacgtttaatttagtttacggttaacggtttaaagggaccggtacggtaccggttaaggggtaaaaccggggttaaccccggggggaacccccgggggtacccccggttaaccggttttacccgggtaaaccccggtaaaccggggttccggggggaacccggggtaacggggggtaacccggttccgggtttcccgggttaacccggttacccccggtttcccgttaccccggttacccgaacccggtccccccgtttaacccccgaaacccggggtaaaccccgggggacccccttaacccggggtttcccccggttttaccccccgtttaccccccgggttaccccgggtaaccccccttaccccccgttacccccgtaaacccgtaaaccggaacccgtccccgtaacccggttcccggggtacgggtacccgtaacgaaccggaccctacccgggccccggttcgggtcccggtccggtacccgggtttacggtaaccggtaacgtaccccgtttaccttacccggttacttacccgttccgttaacgtccggtaagggtcccggggtcccgggttaccggtcggaacccgggtaccggtccggaaacgtaacgtcggagtcg

SEQ ID NO: 53580 - DNA, 618 bp, Homo sapiens
  misc_feature: GYAE6OF01A6JDT.29.78.H01.1.454.CMB.1.raw
  modified_base (250)..(250): a, c, t, g, unknown or other
  misc_feature (250)..(250): n is a, c, g, or t
tcagatagagtactcacgaccggtgctcgatttagtgtgagtagtttgggtttgggggaagaggaagactgacggtccacccctgggatcttcaggtgttttcatttggtgatcaggacggaacagagagaactcaccatggagtttgggctgagctggtctttttcttgtggctattttaaaaggtgtccagtgtgacgtgcagttggtggagtcgtgggggcgccgtggggtacggccgggggggtcncgtgagactctcctgtgcggcctcgtggtattaagttttaggagtcatgccatgaactggtccgcaggctccgaggggaaggggctggagtgggtctcggctattaggtggcaggtggtggcgctatatattatgcagcgtcctaggaacgggcccgttacaccgtatttccgagtaagactaattacgaagaacacgtctaggtaatcgtgactaaagtggaagagccctagacgacgtcgaacgacgacggtcgtacttattagtgttacgtaaggcgtagcgtagggaacgtaccggggacccgggtcccgacgttacggacccgtacggtacggggaccgagggggacctcggttggtaccccg

SEQ ID NO: 53581 - DNA, 588 bp, Homo sapiens
  misc_feature: GYAE6OF01BZF64.29.78.H01.1.454.CMB.1.raw
  modified_base (385)..(385): a, c, t, g, unknown or other
  misc_feature (385)..(385): n is a, c, g, or t
  modified_base (582)..(582): a, c, t, g, unknown or other
  misc_feature (582)..(582): n is a, c, g, or t
  modified_base (587)..(588): a, c, t, g, unknown or other
  misc_feature (587)..(588): n is a, c, g, or t
tcagatagagtactcacgaccggtgctcgatttagtgtgagtagtttgggttggggcgcctgggtacggccgggggggtcgctgagactctcctgtgcggcctctggattaagttttaggagtcatgccatgaactgggtccgccaggctccagggaaggggctggagtgggtctcggctattagtggcagtgggtggcgctatatattatgcagacgccctgaagggccggttcaccatttccagagacaattcgaagaacacgctgtatctgcaaatggagagcctgagactcgacgacacggccgtcttattattgtgttaaaggcgagctaggaatacgggaccggggcccacttgaccacgtcgggggccagggggaccncgtggtccaccgtcctcctcagccctaccaaccgaacggggccccagttccggtccttccccccgtgggccctaccccgtcctacccgaacgacgccacccgtcgtcgggggccacacgcgacgcccgtcgggctcgccgtggtcgaaggactacctccgagtactctagtctgacggcggctggacgtacggcganactgnn

SEQ ID NO: 53582 - DNA, 575 bp, Homo sapiens
  misc_feature: GYAE6OF01BHH8H.29.78.H01.1.454.CMB.1.raw
  modified_base (277)..(277): a, c, t, g, unknown or other
  misc_feature (277)..(277): n is a, c, g, or t
  modified_base (290)..(290): a, c, t, g, unknown or other
  misc_feature (290)..(290): n is a, c, g, or t
  modified_base (397)..(397): a, c, t, g, unknown or other
  misc_feature (397)..(397): n is a, c, g, or t
  modified_base (411)..(411): a, c, t, g, unknown or other
  misc_feature (411)..(411): n is a, c, g, or t
  modified_base (415)..(415): a, c, t, g, unknown or other
  misc_feature (415)..(415): n is a, c, g, or t
  modified_base (462)..(462): a, c, t, g, unknown or other
  misc_feature (462)..(462): n is a, c, g, or t
  modified_base (470)..(470): a, c, t, g, unknown or other
  misc_feature (470)..(470): n is a, c, g, or t
  modified_base (487)..(487): a, c, t, g, unknown or other
  misc_feature (487)..(487): n is a, c, g, or t
  modified_base (573)..(574): a, c, t, g, unknown or other
  misc_feature (573)..(574): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatagttatgcagacgccctggaagggccggttcacctatttccagagacaattcgaaagaacacgctgatcngacaaagtggaangcctgagtacctcgacgacgacggtcctacgtattagtgtaaggttaaaggcgaagcgtagaagtaccggggaccgggcctagtcgaccacgtggggaccaggggcncgtggtccacgtcnccancgcctaccacgacggccacgtcgtctccccgtgcaccctctcagacncacgtcgngggcacagcacgcccgnggtccgtcgctacggtacaacgggactacgtacgtacgtactacgtacgtgtggaggcgggactcggacgtaacggcgatacgtgnng

SEQ ID NO: 53583 - DNA, 166 bp, Homo sapiens; identical to SEQ ID NO: 53192
  misc_feature: GYAE6OF01BERU5.29.78.H01.1.454.CMB.1.raw
  modified_base (166)..(166): a, c, t, g, unknown or other
  misc_feature (166)..(166): n is a, c, g, or t

SEQ ID NO: 53584 - DNA, 658 bp, Homo sapiens
  misc_feature: GYAE6OF01AWT76.29.78.H01.1.454.CMB.1.raw
  modified_base (410)..(410): a, c, t, g, unknown or other
  misc_feature (410)..(410): n is a, c, g, or t
tcagatagagtactcacgaccggtgctcgatttagtgtgagtagtttgggttgggggcgccgtgggtacggccggggggtcgctgagactctcctgtgcggcctctggattaacgttttagggacgtcatgccaactgaactggggtcccgccaggctccaggaagggctggagtgggtctcggctattagtggcagtggtggcgctagtatattatggcagacgccctgaagggccggttcaccatttccagagacaattcgaagaacacgctgtatctgcaaatggagagcctgagactcgaccgacacggccgtctattatgtaggtaagcgagctggaagtacgggacccggggcccgtacgttgaccgacgtggggccgaggggaccgctcggtcaccgtctccncgacgccctcaccgaaggcccagtccggtccttcccccgtgggcccaccccgtcctaccgaacgtacgaccgtacccgtcgtacgggggccacgacgaccgacgcccgtcgggccgttacggtcccgtaggttaccgaaccgggtacttaacccgtaccgtacgttaaccgtaccttaacgttccgacgggtacggaccggggtccgttacgggaccgtaaaccggggcgtacgaacgttaggctacg

SEQ ID NO: 53585 - DNA, 681 bp, Homo sapiens
  misc_feature: GYAE6OF01C8M44.29.78.H01.1.454.CMB.1.raw
  modified_base (277)..(277): a, c, t, g, unknown or other
  misc_feature (277)..(277): n is a, c, g, or t
  modified_base (675)..(675): a, c, t, g, unknown or other
  misc_feature (675)..(675): n is a, c, g, or t
tcagatagagtactcacgaccggtgctcgatttagtgtgagtagtttgggtttggtggtctctctcccagcctgtgctgactcaatcgccctctgcctctgcctcccgtggggaggctcggtcaaggtcacctgtactctgagcagtggacacagcagctacgccatcgcttggcatcagcagaggccagacgaccgggcccttcgttactgatgacagtacaaacaatgatggcagtcacgaggcggaaagggggcggactccgtgactcgcttcncacgtctccagtcctcgtcgggcctggacgccgtcctacctaccaactaacgttcccgtaccggccctcgtacggtcgtaggacgtagtcggacggtactagtacttactacgtcgtaccgacggtccggtcggggactacgtcggtacttacgtttcggaacgggttcccgttaccgggggaacccgggaaccgtaacgggttccgtaccgggtccgtacgggacctaacccggaccccgaaaccggccccctaaaccgtcgttaccgtacccgtaccgttcccttacccggttcccccctacccttcccgtacgtaaccgtttaccttccgtacgtccggtacgggacccgggtcggggtaccggaccgggcgtaaggggtccctaagaggtacgntcgacg

SEQ ID NO: 53586 - DNA, 626 bp, Homo sapiens
  misc_feature: GYAE6OF01C8KZX.29.78.H01.1.454.CMB.1.raw
tcagatagagtactcacgaccggtgctcgatttagtgtgagtagtttgggtttgggtgcgcctgggtacggcccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctatttatgtagttaaaggcgagctggaatacggggaccggggcccgacttcgaccgacgtgggggacccagggggacgcgtggtcaccgtctcctcagcctccaccgaaggcccagtccggtcttcccccgtggccaccctcctccaacgacgccacctcgtcgggggcacgacgcacgcccgtagggccgtcgcccgtggtaccgaacggtaccttaccttacccgtaacgttacccttacgtaacgttcgttacgggtacggccgggggtccttacggggtaccgtaaacggggccgaccctaggtaggacg

SEQ ID NO: 53587 - DNA, 630 bp, Homo sapiens
  misc_feature: GYAE6OF01DRL4A.29.78.H01.1.454.CMB.1.raw
  modified_base (627)..(627): a, c, t, g, unknown or other
  misc_feature (627)..(627): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtagttaaaggcgagcgtaggaaacgtacggggaccggggtcccgacgttcgaccacgtcggggccgaggggacgcgtggtccaccggtctcctcacgcctacccgaccgaacggggcccctacgtccggttcccttcccccgtggcccaccctccctaccaacgacgctaaccctcgtcggggccacgagccacgcccgtgggccgtcgccgtcggtacaacgggtacctaccgttccacggtaccttctaccgttcgtaggacgggtccgggtcgtacgggaccgtaacgggccaccgtaagtaggngac

SEQ ID NO: 53588 - DNA, 579 bp, Homo sapiens
  misc_feature: GYAE6OF01DGBUP.29.78.H01.1.454.CMB.1.raw
  modified_base (189)..(189): a, c, t, g, unknown or other
  misc_feature (189)..(189): n is a, c, g, or t
  modified_base (204)..(204): a, c, t, g, unknown or other
  misc_feature (204)..(204): n is a, c, g, or t
  modified_base (214)..(214): a, c, t, g, unknown or other
  misc_feature (214)..(214): n is a, c, g, or t
  modified_base (240)..(240): a, c, t, g, unknown or other
  misc_feature (240)..(240): n is a, c, g, or t
  modified_base (246)..(246): a, c, t, g, unknown or other
  misc_feature (246)..(246): n is a, c, g, or t
  modified_base (264)..(264): a, c, t, g, unknown or other
  misc_feature (264)..(264): n is a, c, g, or t
  modified_base (271)..(272): a, c, t, g, unknown or other
  misc_feature (271)..(272): n is a, c, g, or t
  modified_base (274)..(274): a, c, t, g, unknown or other
  misc_feature (274)..(274): n is a, c, g, or t
  modified_base (277)..(277): a, c, t, g, unknown or other
  misc_feature (277)..(277): n is a, c, g, or t
  modified_base (299)..(299): a, c, t, g, unknown or other
  misc_feature (299)..(299): n is a, c, g, or t
  modified_base (301)..(301): a, c, t, g, unknown or other
  misc_feature (301)..(301): n is a, c, g, or t
  modified_base (305)..(305): a, c, t, g, unknown or other
  misc_feature (305)..(305): n is a, c, g, or t
  modified_base (318)..(318): a, c, t, g, unknown or other
  misc_feature (318)..(318): n is a, c, g, or t
  modified_base (320)..(320): a, c, t, g, unknown or other
  misc_feature (320)..(320): n is a, c, g, or t
  modified_base (322)..(322): a, c, t, g, unknown or other
  misc_feature (322)..(322): n is a, c, g, or t
  modified_base (326)..(326): a, c, t, g, unknown or other
  misc_feature (326)..(326): n is a, c, g, or t
  modified_base (331)..(331): a, c, t, g, unknown or other
  misc_feature (331)..(331): n is a, c, g, or t
  modified_base (333)..(333): a, c, t, g, unknown or other
  misc_feature (333)..(333): n is a, c, g, or t
tcagatagagtactcacgaccggtgctcgatttagtgtgagtagtttgggtttgggtctgagagaggagtcccaccccgtggatcttcgaggttgttttctagtttggtgatcgaaggacggaacagagagaactcaccagtggtaggtttggctgagcggtcgtgttctaggcgctaagtttaaaggngtcagtgtgagtgangtgtgagtgnggcgcgtggcggcgggcagtgagctntcgtgngcgctgtggattagttgngttacgnngnagngagtcgcgcgcgcgcgaggagngngtgngtgtcgtgtgtgngngngtgngcgtntntatagtgtgcgacgacgcgtacgacgtcgtacgtacgtactacgtacgagtacgtaagtacgaacgaacgacgacgtagtacgtagagtaagtaagtagacgacgtcgtacgtagacgtacgacgacgaccgtaccgtacgtagttagttacgtacgtaacgtacgtacgtacgtacggtaaccggtaccggtacccggacccggtcgtacgtaccgacgtacggacggacggtcgtcgtcgtacg

SEQ ID NO: 53589 - DNA, 703 bp, Homo sapiens
  misc_feature: GYAE6OF01DKN81.29.78.H01.1.454.CMB.1.raw
  modified_base (698)..(698): a, c, t, g, unknown or other
  misc_feature (698)..(698): n is a, c, g, or t
  modified_base (703)..(703): a, c, t, g, unknown or other
  misc_feature (703)..(703): n is a, c, g, or t
tcagatagagtactcacgaccggtgctcgatttagtgtgagtagtttgggtttggtggtctctctcccagcctgtgctgactcaatcgccctctgcctctgcctccgtgggagctcggtcaaggtcacctgtactctgagcagtggacacagcagctacgccatcgcttggcatcagcagagccagaccgacggcccttgttactgatgacagtcaacatgatggcagtcacagcgaaagggggcgatccctgactcgtcttctacgagtccaccagtccttcggagggtcctggacgccgtacctacctaccaatacgtccgtacccggccctactaggttcctagggaggtaagtggacggtccttaggtaacgtttaacttcgtcgtacgaacggttcccggtaggggacctaaccggttggaccttaacgtttccgggtaacgggtttaccccggttaccggggaaacccggggtaacctaacgggttcccctaaccgggttccggtccggtaaccaccgggaccccgaacggtaccccctaaacccgtatttccggtaaccctccgtttccgtttccccgggtttaccccctcccgttaccgtaccgttaaccgttaccttcccttagtcccggtagggaacccggtcgggtacccttaggggaccctaacgggtcccgtaaacttaggacgngtcgn

SEQ ID NO: 53590 - DNA, 669 bp, Homo sapiens
  misc_feature: GYAE6OF01D0UAU.29.78.H01.1.454.CMB.1.raw
  modified_base (195)..(195): a, c, t, g, unknown or other
  misc_feature (195)..(195): n is a, c, g, or t
  modified_base (375)..(375): a, c, t, g, unknown or other
  misc_feature (375)..(375): n is a, c, g, or t
tcagatagagtactcacgaccggtgctcgatttagtgtgagtagtttgggtttggggtccgagccatggtgcagactccccagagctctcctcctcctccactgcacagggtctctctcccagcctgtgctgactcaatcgccctctgcctctgcctcccgtgggaggctcggtcaaggtcacctgtactctgancagtggacacagcagctacgccatcgcttggcatcagcagaggccagaccaccgggtcctcgttacttgatcgacagtacaaacaatgacgtggacagtccaacgaggacggaaggggggacggatcccgtgacttcgcttctcacgtctccagtcctcgtcgggcctgacgcgctaccncaactactccgtccggccttacgagtcctaggtaggacgtggacggtcttaggtaacttagtttacgtcgtaccgacggtaccggttggggaccctacgttcgggacctagtttaccggtaacgggttcccggttaccgggggaacccgggtaaccgtaacgggttcccgtaacccggttcccgggtaccgggttaccccgaacgggtaccccccgtaaaccgggaccccccgaaacccccgtacggttacccgttaccctaacgttccccggtttaacccgttcccccccggg

SEQ ID NO: 53591 - DNA, 814 bp, Homo sapiens
  misc_feature: GYAE6OF01CK2YU.29.78.H01.1.454.CMB.1.raw
tcagatagagtactcacgaccggtgctcgatttagtgtgagtagtttgggtttgggggcgcctggggtacggccgggggggtcgctgagactctcctgtgcggcctctggattaagtttaggagtcatgccatgaactgggtccgccaggctccgagggaagggctggagtgggtctcggctattagtggcagtggtggcgctatatatatgcagaccgcctaggaacgggtccgttcacctatttccaagagaactaagttacgaagaacacgcttagtatctgacaaagtggagacgccgtagacgactaccgacgacgaccgggtccgtacgttaatttagttggtaaggttaaacggcgtacgtacgtagggaaacgttaccgggggacccgggtacccgtacgttacggacccgaacgggtcggggaccggacgggggaccgtcgtacgggtccctaaccggttcccgtacccgtacgacgccccttacccgaacccggaaccggggtccccaacggtttcccgggttccccttaccccccggtagggtacccccttaaccccgtcccgttaacccgaacggtaccgtacccgtacccgtccggggtaccggggaccaaccggtacgcccgtaacccgggtccccgttacggggcccttacccgggccgtttaccgggtaaccgtaaccgggttaacccttaccgttacccgtaacgtttaccttaccgttacgttccgggtacgggtaacggtcccgggtacggtaaccgggtacggaaccgggtaccgtaaccgaggttacggcgtg

SEQ ID NO: 53592 - DNA, 652 bp, Homo sapiens
  misc_feature: GYAE6OF01DMQAL.29.78.H01.1.454.CMB.1.raw
  modified_base (347)..(347): a, c, t, g, unknown or other
  misc_feature (347)..(347): n is a, c, g, or t
tcagatagagtactcacgaccggtgctcgatttagtgtgagtagtttgggtttggagtctgcaccatggctcggaccccactcctcttcctcaccctcctcctccactgcacagggtctctctcccagcctgtgctgactcaatccgccctctcgcctctcgccctcccgtgggaggctcggtcaaggtcacctgtactctgagcagtggacacagcagctacgccatcgcttggcatcagcagacgcagaccgaccggcccttgttactagatgaacagtacaacatgagtggacagtcacgagggacggaagggggaccggactcccgtaggacttccgctttcncgacgtcctcgacgtcgtccggtggcctggcgtccgtcctaccgtacaacgtacgtcccgtccccggtacttccgaggttcgtacggaagggtactacggaggtcctaacgtactttacgtacgtacgtacccgtaggtacccggtgggcctaacggttcggtaccttacggttcggtacgttaccgggtacccggggaaacccggtccgtaacggttccgacccgggttcggtacccgggacgaaccggaccccgtaaccggacccctacccgttagtacccgttcacccgtttccgtccccgg

SEQ ID NO: 53593 - DNA, 599 bp, Homo sapiens
  misc_feature: GYAE6OF01A5VQR.29.78.H01.1.454.CMB.1.raw
  modified_base (597)..(597): a, c, t, g, unknown or other
  misc_feature (597)..(597): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacggggaccggggcccgacttgaccacgtggggccaggggacgctggtcaccgtctcctcagcctccaccaacgggcccactcggtccttccccccgtggcccaccctccctccaacgacgccaccctccgtcgggggccacgacgccacggccccgtggggcctggcccgtcgggtccaacgggacctaccgttcccacgttacctaccttactccgtaggacggccgggcttcgggaccgaacgggcgacacgtgncg

SEQ ID NO: 53594 - DNA, 644 bp, Homo sapiens
  misc_feature: GYAE6OF01BTPWS.29.78.H01.1.454.CMB.1.raw
  modified_base (640)..(640): a, c, t, g, unknown or other
  misc_feature (640)..(640): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgacaaatggagagcctgagactcgacgacacggccgtctattattgtagttaaaggcgagctggaagtacggggaccgggcccgacgttcgaccacgtcggggaccagggggacgcgtcggtcaccgtctcctacacgccctccaccgacgggcccagtccggtcccttcccccgtcggcccaccccgtcctaccaacgacgaccctaaccgtcgtacgggggccaccgacgccgacgtccccgtcgggtccgtccggtcccgttacggtaccgaacggtaccttaccgttaccgtaaccgttacctacgttacgttaccgtacgacgggtccgggacttcgggacgtaacgggccgaccgaatgngacg

SEQ ID NO: 53595 - DNA, 612 bp, Homo sapiens
  misc_feature: GYAE6OF01ERYZ5.29.78.H01.1.454.CMB.1.raw
  modified_base (395)..(395): a, c, t, g, unknown or other
  misc_feature (395)..(395): n is a, c, g, or t
  modified_base (608)..(608): a, c, t, g, unknown or other
  misc_feature (608)..(608): n is a, c, g, or t
tcagatagagtactcacgaccggtgctcgatttagtgtgagtagtttgggtttgggggcgcctgggtacggccggggggtcgctgagactctcctacgtgcggcctctggattaagttttaggagtcatgccatgaactgggtccgccaggctccgagggaaggggctggagtgggtctacggctattagtggcagtggtggcgcgtatatattatgcagacgcctagaaggccgttcgaccatttccagagacaattcgaagaacacgtctgtatctagacaaatggagagcctagagactcgacgacgacggcctcgtatttattcgtagttaaaggcgagcgtaggaagtacgggaccgggaccgacttgaccacgtcggggcgaggggacncgtcggtccaccggtctaccacacgccctacaccgaacgggcccacgtccgtccttacccccgtaggacccacccgtcctaccgaagacgctaacctcggtcgggcacagcacgccgtggctcgtccgtaggtacaacggtactactaccgtaacgttccgtactacgtccgtaggacggccgggacgtggaccgaagggccgacgtaagtgngacg

SEQ ID NO: 53596 - DNA, 786 bp, Homo sapiens
  misc_feature: GYAE6OF01AWDAS.29.78.H01.1.454.CMB.1.raw
tcagatagagtactcacgaccggtgctcgatttagtgtgagtagtttgggtttgggggcgcctagggtacggccgggggtcgctgagactctcctacgtgcggcctctggattaagttttaggagtcatgccatcgaactgggtccgccaggctccgagggagggctggagtgggtctcgggctacttagtcggcgagtggtggcgcgtatatattatggcagacgcctaggaagggccgttcgacctatttccgagagacaattcgaagaacacgtctagtatctagcctaaatggagagcctggagactcggacgacgaccgggccgtctattagtcgtaggttaaaggcgagcgtagggaacgtaccggggacccgggcccgtagttcggaccaacggtcggggaccgtagggggacctccgtcgggtccacccggttccgtacccgtcgaaccgtcccctacccgaacccgaaccggggcccctacgttccccggttacccttaccccccggtacgggacccctaaccccgttaccctacccgtaaacggacggtacccgtacccggtaccgggtacgggggacctaccggtacggacccgtaccggccccggtaggggtcccgtaccgggtcccggttacggttaccggtaaacggttaccgttaacccgttaccggtaaccggtttaccgttacccgttaaacgttccggtacgggtaacgggtcccggggaccgttacggggacccgtaacgggtcccggtaccgtaggtacgtggcgg

SEQ ID NO: 53597 - DNA, 618 bp, Homo sapiens
  misc_feature: GYAE6OF01ED3XN.29.78.H01.1.454.CMB.1.raw
tcagatagagtactcacgaccggtgctcgatttagtgtgagtagtttgggtttgggggcagggtgtacacctgtggttctcggggctgccctttggccttggagatggttttctcgatgggggctgggagggcttttgttggagaccttgcacttgtactccttgccattcagccagtcctggtgcaggacggtgaggacgctgaccacacggtacgtgctgttgtactgctccgtccgcggtctttgcttggcattatgcacctccacgccgtccacgtaccagtgaacttgacctcaggtcttcgtggctcaccgtccaccaccacgcatgtcgacctcgaggggtccggagatcatgaggtgtccgttggtttgggggaagaggagacgtgacggtcccccaggagttcgaggtgcgtgggcgacggtgggctagtgtggttgtagttttggtcacgtaaggtacgttttgggccttacgtaacgttttcgttacgttcccgttaccgtttggttcgtttgtcgttgggtctttgtggtatttccggtacgttcgtagacgttagttggttagggttccggttggggtacgacccgtaacggtcgttggtacggg

SEQ ID NO: 53598 - DNA, 655 bp, Homo sapiens
  misc_feature: GYAE6OF01BZFMS.29.78.H01.1.454.CMB.1.raw
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtgcgctatatattatgcagacgccctgaagggccggttcaccatttccagagacaattcgaagaacacgctgtatctgcaaatggagagcctgagactcgacgacacggccgtctattatgtagttaaggcgagctggaatacgggacccggggaccacgttcgacctacgtggggaccagggggacgcgtcggtcaccgtctcctacacgccctccaaccgacggcccacgtccggtccttccccctggccctacccctcctaccgaacgaccgaccgtacccgtcggtcgggggacctaacgacgaccgaaccggtccccggtgggtcctcgggtcccgtacgggtacccgaacggtaccttaccgttacccgtaacgttaccttaccgttacgtccgttacggacgggtcccggggtcgtacgggaccgaacgggtaccgacgtaagtacgtgacg

SEQ ID NO: 53599 - DNA, 752 bp, Homo sapiens
  misc_feature: GYAE6OF01CG9KB.29.78.H01.1.454.CMB.1.raw
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgacaaatggagagcctgagactcgacgacacggcctctattatgtagttaaaggcgagctaggaacgtacggggacccggggcccgacgttcgaacccgacgtcgggggcccgagggggaccgcgtgggtccaccgttctcccgtcacgccctcccaaccgaacgggccccacgttccggttccccttccccccgtcgggcccctacccccttcccgtacccgaacggacgaccctacccgtccgggtacggggggacccaaccgacggacccgaccggtcccccggtacggggtcccgttccgggccccgtttacggggttaacccgtaaacggggtaccctttaacccgtttccccgtaaaccgggtttaacccttacccgttaccgttacccggttacgggtaaccgggtcccgggggtaccgttaccggggacccggaaacggggacccgtaccggtaacgttaacgggcgtcg

SEQ ID NO: 53600 - DNA, 706 bp, Homo sapiens
  misc_feature: GYAE6OF01CILPZ.29.78.H01.1.454.CMB.1.raw
  modified_base (184)..(184): a, c, t, g, unknown or other
  misc_feature (184)..(184): n is a, c, g, or t
  modified_base (210)..(210): a, c, t, g, unknown or other
  misc_feature (210)..(210): n is a, c, g, or t
  modified_base (248)..(248): a, c, t, g, unknown or other
  misc_feature (248)..(248): n is a, c, g, or t
  modified_base (437)..(437): a, c, t, g, unknown or other
  misc_feature (437)..(437): n is a, c, g, or t
  modified_base (530)..(530): a, c, t, g, unknown or other
  misc_feature (530)..(530): n is a, c, g, or t
  modified_base (569)..(569): a, c, t, g, unknown or other
  misc_feature (569)..(569): n is a, c, g, or t
tcagatagagtactcacgaccggtgctcgatttagtgtgagtagtttgggtttgggtctgagagaggagtcccacccctgggatcttcaggttgttttcatttggtgatcaggacggaacagagagaactcaccatggagtttgggctgagcgtgtcgttttctaggtggctaattttaaaggngtcagtgtgacgtgcaggttggtggngtcgtggggccgccgtggggtaccgggccggggggtcncgtgacgactctccgtggtcgccggcctcgtaggtattttaaggtttaggattcagtcgaccaagtagtaaacgtcgggtccaccgaggtcgtccggaaggggaacggggtcgtagggaggtttcggggtcgtcggtacgtttaacttaggtggaacgaggttcggtggacgtcgttaatagttaattntgaccgtaacgccggacccgtaggaacgggtccgtacgaccgtactttaccgagtaacgactaagttacgaaagaacacgcgtagtactgtanaacaaggtgtaagcgacgtgaactacgtacgaacgaccncggtacccgtattactttagtaggttaagtaacggtaccgtagacgtagggaacggtaccggggtacccgggaccgtacggttaccgaacccgacgggtaacgggccggaaacggggtctaaccgggtgtaccccgg

SEQ ID NO: 53601 - DNA, 606 bp, Homo sapiens
  misc_feature: GYAE6OF01BD0KS.29.78.H01.1.454.CMB.1.raw
  modified_base (399)..(399): a, c, t, g, unknown or other
  misc_feature (399)..(399): n is a, c, g, or t
  modified_base (511)..(511): a, c, t, g, unknown or other
  misc_feature (511)..(511): n is a, c, g, or t
  modified_base (599)..(599): a, c, t, g, unknown or other
  misc_feature (599)..(599): n is a, c, g, or t
  modified_base (606)..(606): a, c, t, g, unknown or other
  misc_feature (606)..(606): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccgaggggaaggggctggagtgggtctcggctattagtggcagtggtggcgctatatattatgcagacgccctgaagggccggttcaccatttccagagacaattcgaagaacacgctgtatctgacaaatggagagcctgagactcgacgacacggccgtctattattgtagttaaaggcgagctagggaaagtaccggggacccggggcccgacttcgaccgaacgtcgggggaccagggggacncgtggtccaccggtctcctcgacgccctccaccgaacgggcccacgtccggtccttcccccgtcggccctaccctcctaccgaacgacgccaccgtcgtcggggccacgacncgacgcccgtgggcctggccgtggtacaacgggaccttaccgtccagttcctactacttctgacggcggcgtagggcgaacgggcganactagcn

SEQ ID NO: 53602 - DNA, 755 bp, Homo sapiens
  misc_feature: GYAE6OF01CH00V.29.78.H01.1.454.CMB.1.raw
  modified_base (207)..(207): a, c, t, g, unknown or other
  misc_feature (207)..(207): n is a, c, g, or t
  modified_base (727)..(727): a, c, t, g, unknown or other
  misc_feature (727)..(727): n is a, c, g, or t
tcagatagagtactcacgaccggtgctcgatttagtgtgagtagtttgggtttggggtccgagccatggtgcagactccccagagctctcctcctcctccactgcacagggtctctctcccagcctgtgctgactcaatccgccctctgcctctcgccctcccgtgggagctcggtcaaggtcacctgtactctgagcagtggacanagcagctacgccatcgcgtggcatcgagcgagaggccaggaccgaccgggtccttcgttagtgatacgacctaagtacaaaacgtaattggactacgggtactaacggtaccaaccggaggaacggggaaacggggggtaccggtaacttccccggtagtaacgtcccgttactttacctacgtacgttccttaccgacgtccctttcggtaacccgggacgttacggacccgtacggtacccttaaccctccgtaaccgtaaccgttcccgtaacccggtcccttaccgtacggttacgacggaacggtagttacgggacggtaccttaggttaaccgtttaacttccgtacggtaccgacggtaccgggttcgggtaacctaccggtaggtaccgtttacgttaccgggttaccgggttaccgggttacccggggaacccggggtaaccgtccggtacggtacccggttaccggtaccgtaccggacccggtacccgacccggtaaccctaccccgtntcgtacctaccgtccgttcccgtacccc

SEQ ID NO: 53603 - DNA, 754 bp, Homo sapiens
  misc_feature: GYAE6OF01B6GS6.29.78.H01.1.454.CMB.1.raw
tcagatagagtactcacgaccggtgctcgatttagtgtgagtagtttgggtttggggtctgagagaggagtccaccctgggatcttcaggtgttttcatttggtgatcaggacggaacagagagaactcaccatggagtttgggctgagctggtctttttcttgtggctaattttaaaaggtgtccagtgtgacgtgcagttggtggagtcgtgggggcgccgtggggtaccgggccgggggggtcgcgtgagactctcctgtgcggcctcgtggtattaagttttaggagtcatgccatgaacgtcgggtccgccaggcctaccgaggggaagggggctagggtaggtcggggtctcgggtacttagttaggtgggcaggttgggtcggcgcgttaatattaattagtcgcgacggaccgcccgtaggaacggggtccggttacaaccgtacgtttcccgaaggaacggtaacctaagtttaccggaaaagaaccgacggtacttaggtaacttccgttacggaactaaaaggttcgggaagaccggtacctaggaacgtaaccgtacggaccgaaccgaccgggtaccgttattaagtttgttaggttaagtttaaaacggggcgtaaggtcgtaacggggtaacggttaacccggggggaaccccgggtacccgttaacgggttcggaaaccccggacgggttcgggggaccccggaaaggggggtaccgtcccggtttggggtacccccg

SEQ ID NO: 53604 - DNA, 666 bp, Homo sapiens
  misc_feature: GYAE6OF01DF1LU.29.78.H01.1.454.CMB.1.raw
  modified_base (662)..(662): a, c, t, g, unknown or other
  misc_feature (662)..(662): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaagggctggagtgggtctcggctattagtggcagtggtggcgctatatattatgcagacgccctgaagggccggttcaccatttccagagacaattcgaagaacacgctgtatctgacaaatggagagcctgagactcgacgacacggccgtctattattgtagttaaaggcgagctaggaatacgggacccggggcccgacgttcgaccacgtcggggccgaaggggacgcgtggtccaccgtctcctcacgcctccaaccgacgggacccactccggttcccttccccccgtacgggcccctaccccgttccctacccgaacgtacgaccctacccgttccgtcgggggaccacgacggaccgacggccccgtggggaccctcggcccgttgggtaccgaacgggtacctaaccgtttaccccgtaagttacccgttcctacgttccgtaggacggtccgggaccgttcgggaccgtaacgggacccgtacgtaacgtaggntacg

SEQ ID NO: 53605 - DNA, 732 bp, Homo sapiens
  misc_feature: GYAE6OF01C6SI6.29.78.H01.1.454.CMB.1.raw
tcagatagagtactcacgaccggtgctcgatttagtgtgagtagtttgggtttggggggaagaggaagactgacggtccacccctgggatcttcaggtgttttcatttggtgatcaggacggaacagagagaactcaccatggagtttgggctgagctggtctttttcttgtggcttaattttaaaaggtgtccagtgtgacgtgcagttggtggagtcgtgggggcgccgtggggtaccgggccgggggggtccgtggagactctcctggtgccggcctgtggtatttaaggtttaggagtcatgaccatgaacgtcgggtccgccgaggcctaccggagggggaaggggcgtgggaggtgggtcgtcggtcttagttaggtggcgtaggtgggtacggcgtctaagttattattagtgacgacgaccgcccgtagggaaccgggtcccggtttaccaaccgtacttttaccgaggtaacgaactaacgttacgaaacgaacgaccgtcgttagtactcgtagactaagtaggagacgcctagaacgtcgtacgaccgacgaccggtaccgttactaacgtttagtttacggttaggttaaacggcgtaacggtacggttaagggaaaccgggttaccggggggaccccggggtaacccggtcggttacccggtaaccggaccgggttaccggggaccgggagggggtacccgtcgggtcggtaaccccgg

SEQ ID NO: 53606 - DNA, 791 bp, Homo sapiens
  misc_feature: GYAE6OF01DTCHW.29.78.H01.1.454.CMB.1.raw
  modified_base (788)..(788): a, c, t, g, unknown or other
  misc_feature (788)..(788): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccgagggaaggggctggagtgggtctcggctattagtggcaggtggtggcgctatatattatgcagacgccctggaacgggccggttccacctatttccagagacaattcgaaagaacacgctgtatctgacaaagtggagacgccgtagagactccggacgaccgaccggccgttctaatttgttagtaggttaacggcgagcgtaggaacgtaccgggggaccgggcccgtacgttacgaccgacggtcgggggaccgaacgggggacgtcgtcggtaccgacccgttcctaccgtccacgtcccctacccgaaccggaaccgggccccgtaacgttcccgggtttccccctttccccccggtccgggaccccctaacccccgttccccgtaacccgaaaccggtaccgaccccgtaccccggtcgggttacccggggggcccaaaccggcggacccggacggtccccggttcggggtccggtaccggttcccggttaacggggttaccggtaaaccgggttaccccttaacccgtttacccgtaaccggttacccgttacgttaacgttccggttacgggaccgggtccggggtaccgtacggggtaaccgacggggtacccgagtaacgtgngtc

SEQ ID NO: 53607 - DNA, 677 bp, Homo sapiens
  misc_feature: GYAE6OF01BMQ1J.29.78.H01.1.454.CMB.1.raw
  modified_base (668)..(668): a, c, t, g, unknown or other
  misc_feature (668)..(668): n is a, c, g, or t
  modified_base (673)..(674): a, c, t, g, unknown or other
  misc_feature (673)..(674): n is a, c, g, or t
tcagatagagtactcacgaccggtgctcgatttagtgtgagtagtttgggtttggtggtctctctcccagcctgtgctgactcaatccgccctctgccctctcgccctcccgtggggaggctcggtcaaggtcacctgtactctgagcagtggacacagcagctacgccatcgcgttggcatcagcaggacggccaggaccgaccgggtcccttacgttacttgatggacacgtacaaacaagtgagtggactagtccaacgaggacgggaaagggggtacggtactccgtgacttccgtcttctcgacgttcctacgagtcctcggtcggtcctaggaccgtcctacctacctacctactacctcccgtacccggcctccgagttcgtaggaggtatacgtacggtactacgtaactttaacgtcgtacgtgacggtacggtcgggacctagtcggtactacgttcggacggttccggtacccggggaacggtacgacggtcccgtaccggttcggtacgaccaccggaccgtaacgaacccccaacgtcctaccgtaccctaccgttccgttacccccgtcctaaccccttctccgtaaccgttcccttacgtacctccgggtcggacgggtcccggtactccgggaacgacgggtcctacggaanccggnngtc

SEQ ID NO: 53608 - DNA, 603 bp, Homo sapiens
  misc_feature: GYAE6OF01EEVLM.29.78.H01.1.454.CMB.1.raw
  modified_base (601)..(601): a, c, t, g, unknown or other
  misc_feature (601)..(601): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggtccgtctattattgtagttaaaggcgagctaggaagtacgggaccggggcccgacttcgaccacgtggggccaggggacgcgtggtcaccgtctcctcagcctccaccaagggcccacgtcgtccttccccctcggcccaccctcctaccgaacgacgacctacctcgtcggggaccacgacgacgacgccccgtgggtcctcgacccgtcggtacgaacggtacctacctcctaacgtactccttatccgtagacggtccgggcgtcgggaccgtaaagggccggacacgtagncg

SEQ ID NO: 53609 - DNA, 662 bp, Homo sapiens
  misc_feature: GYAE6OF01ET57P.29.78.H01.1.454.CMB.1.raw
  modified_base (660)..(661): a, c, t, g, unknown or other
  misc_feature (660)..(661): n is a, c, g, or t
tcagatagagtactcacgaccggtgctcgatttagtgtgagtagtttgggtttgggggcgcctgggtacggccgggggggtcgctgagactctcctgtgcggcctctggatttaagttttaggagtcatgccatgaactggggtccgccaggctccaggggaaggggctggagtgggtctcggctattagtggcagtggtggcgctatatattatgcagaccgccctgaagggtcggttcaccatttccagagacaaattcgaagaacacgctgtatctgcaaatggagagcctgagactcgacgacacggccgtctatttatttgtagttaaaggcgagcgtaggaacgtacggggacccggggcccgtacttcgaccgacgtggggccgaggggacgcgtggtccaccgtctccctcacgccctccgaccgaacggggccccacgttccggtcccttcccccgtcggcccctacccctaccctacccaaacggacgaccctacccgttcgtacgggggccaacgaccgtccgaccggccccgtggggtccctcggtcccgttcgggtaccaacggtaccttacccgttccctaacgttacctccttacgttccgtggtacggtcgggtacgtcgggacgtaacgggccgacgagtagnng

SEQ ID NO: 53610 - DNA, 655 bp, Homo sapiens
  misc_feature: GYAE6OF01APE24.29.78.H01.1.454.CMB.1.raw
  modified_base (273)..(273): a, c, t, g, unknown or other
  misc_feature (273)..(273): n is a, c, g, or t
  modified_base (513)..(513): a, c, t, g, unknown or other
  misc_feature (513)..(513): n is a, c, g, or t
  modified_base (528)..(528): a, c, t, g, unknown or other
  misc_feature (528)..(528): n is a, c, g, or t
  modified_base (533)..(533): a, c, t, g, unknown or other
  misc_feature (533)..(533): n is a, c, g, or t
  modified_base (653)..(653): a, c, t, g, unknown or other
  misc_feature (653)..(653): n is a, c, g, or t
tcagatagagtactcacgaccggtgctcgatttagtgtgagtagtttgggtttgggggcgcctgggtacggccgggggggtcgctgagactctcctgtgcggcctctggatttaagttttaggagtcatgcaatgaactgggtccgccaggctccgagggaagggctggagtgggtctcggctattagtggcaggtggtggcgctatatattatgcagaccgccgtggaacgggccgttacacctatttccagagaactaattacgaagaacncgtctgtatctagacaaagtggagacgcctagacgtactcgaacgaccgacggtccgtacttagttagttgtaaggttaaggcgagtacgtagggaaacgtaccgggggacccgggtacccgtaacgttcgaaccgacggtcgggggaacccggaggggaccgtcggttacggtaccctaaccgtccgtccctacgacgtcccctacgaaccgtacgggccctacgtccgtcctccccgngcccacctcacagcncacgnggtcggcacgcgacgacgtccgtggacctcggtccgtaggactaacggtacctacgtaccgagtacctcgtactcggtggacggtccggcgtacggacgaacggtcgaaccgtagtacgngc

SEQ ID NO: 53611 - DNA, 608 bp, Homo sapiens
  misc_feature: GYAE6OF01EYP2Q.29.78.H01.1.454.CMB.1.raw
  modified_base (601)..(601): a, c, t, g, unknown or other
  misc_feature (601)..(601): n is a, c, g, or t
  modified_base (606)..(607): a, c, t, g, unknown or other
  misc_feature (606)..(607): n is a, c, g, or t
tcagatagagtactcacgaccggtgctcgatttagtgtgagtagtttgggtttgggggcgcctgggtacggccgggggggtcgctgagactctcctgtgcggcctctggatttaagttttaggagtcatgccatgaactgggtccgccaggctccgaggggaaggggctggagtgggtctcggctattagtggcagtggtggcgctatatattatgcagacgccctgaagggccggttcaccatttccagagacaattcgaagaacacgctgtatctgacaaatggagagcctgagactcgacgacacggccgtctatttattgtagttaaaggcgagcgtaggaagtacggggacccggggcccgacgttcgaccacgtcggggccgaggggacgcgtggtccaccgtctcctcgacgccctcccaccgaacgggcccacgttccggtcccttcccccgtcggcccaccccgtccctacccaacgacgccacccgtcgtcggggccacgacgcacgcccgtgggcctcgccgtcggtacaacggtacctaccttccacttacctcttacgtcgtggacggcgggcgtcggacgacggcanatagnng

SEQ ID NO: 53612 - DNA, 611 bp, Homo sapiens
  misc_feature: GYAE6OF01D0BD1.29.78.H01.1.454.CMB.1.raw
  modified_base (406)..(406): a, c, t, g, unknown or other
  misc_feature (406)..(406): n is a, c, g, or t
  modified_base (601)..(601): a, c, t, g, unknown or other
  misc_feature (601)..(601): n is a, c, g, or t
  modified_base (607)..(607): a, c, t, g, unknown or other
  misc_feature (607)..(607): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgacaaatggagagcctgagactcgacgacacggccgtctaattattgtaggttaaaggcgagcgtaggaagtaccggggaccggggcccgacttcgaccacgtcggggccaggggacgcgtggtcaccgtcncctcacgccctccaccgacgggcccacgtccgtccttccccctcggccctaccctccctaccgaacgacgccacctccgtcggggccacgacgcacgcccgtcgggcgtcgtccgtcggtacgaacggtacctaaccgttccgacgttacctacgttacgtcgtaggtacggcgggtcgtcgggacgacggcganacgtgngacg

SEQ ID NO: 53613 - DNA, 793 bp, Homo sapiens
  misc_feature: GYAE6OF01CBX52.29.78.H01.1.454.CMB.1.raw
  modified_base (790)..(790): a, c, t, g, unknown or other
  misc_feature (790)..(790): n is a, c, g, or t
tcagatagagtactcacgaccggtgctcgatttagtgtgagtagtttgggtttgggggcgcctgggtacggccgggggggtcgctgagactctcctgtgcggcctctggatttaagttttaggagtcatgccatgaactgggtccgccaggctccgagggaaggggctgggaggtgggtctcggctagttagtggcaggtggtggcgactatatattatgcagacgcctgaacgggccgttacactattccagagactaatcgaagaacacgtctgtatctagacaaagtggaagacgtccgtagacgaccgtcgaacgacgaccgggacctattaattagttggtagttaaaggcgagcgtacggaaaggtacccgggggaccccgggaccgacttggaaccgacggtcggggaaccgaggggaccgcgtagggtcccaaccgttcccgtaccgtaccgacgacccccgtaccgaaccggaccgggaccccgtacgttccccggttccccgtttacccccccggtacggacccctaacccccgtttccccgaaacccggtaacgacccggtaccccgtacccgtaccgggtaccggggaccctaaccgacgggtacccaccgggtccccgtaggggcccgttaccggtacccgtaccgggttaaccgtaaacgggtccctttaaaccgttcccggttaacgtaaacccgtttctaaccggtttcggtacgggacccggggtcgggtcccggtacgggaccgggtaacggtcccgtaaggtacgtacggngcg

SEQ ID NO: 53614 - DNA, 590 bp, Homo sapiens
  misc_feature: GYAE6OF01DJ5MO.29.78.H01.1.454.CMB.1.raw
  modified_base (580)..(580): a, c, t, g, unknown or other
  misc_feature (580)..(580): n is a, c, g, or t
  modified_base (588)..(588): a, c, t, g, unknown or other
  misc_feature (588)..(588): n is a, c, g, or t
tcagatagagtactcacgaccggtgctcgatttagtgtgagtagtttgggtttgggggcgcctgggtacggccgggggggtcgctgagactctcctgtgcggcctctggatttaagttttaggagtcatgccatgaactggggtccgccaggctccagggaaggggctggagtgggtctcggctattagtggcagtggtggcgctatatattatgcagacgccctgaagggccggttcaccatttccagagacaattcgaagaacacgctgtatctgacaaatggagagcctgagactcgacgacacggccgtctattattgtagttaaaggcgagcgtaggaagtacggggaccgggccgacttgaccacgtggggccaggggacgctggtccaccgtctcctcacgccctccaccgacgggccacgtccggtccttcccccgtcggccctaccctccctaccaacgacgctaccctcggtcggggcacgcgcgacgcccgtcggctcgcctcggtacaaggtacctacttccagtacctactactctaggacggcgggtcgtcggacgaacgggacgngacgtagnag

SEQ ID NO: 53615 - DNA, 792 bp, Homo sapiens
  misc_feature: GYAE6OF01DXO77.29.78.H01.1.454.CMB.1.raw
  modified_base (247)..(247): a, c, t, g, unknown or other
  misc_feature (247)..(247): n is a, c, g, or t
  modified_base (284)..(284): a, c, t, g, unknown or other
  misc_feature (284)..(284): n is a, c, g, or t
tcagatagagtactcacgaccggtgctcgatttagtgtgagtagtttgggtttgggggagagaggagtcccacccctgggatcttcaggtgttttcatttggtgatcaggacggaacagagagaactcaccatggagtttgggctgagctggtctttttctgtggcttaattttaaaaggtgttccagtgtgacgtgctagttggtggagtcgtgggggccgccgtggggtacgggccggggggtcnctgacgctctctgtgcgcctctggtattaagtttagngtcatgccagtagaacgtcgggtccgcgaggcctaccggaaggggagggcgtggtaggtcgggtcgtcggtcttagttaggtcggacgaggttgggtgggccgtacgttaatagttattagtcgacgacgacccggtcccgttagggaaacccggggtcccgttacccgaacccgtatttacccgaaggtaacgtaacctaaacgtttaaccgaaaacggtaacccgtacgtaccgtttaacggttacttacgtaacggaaaccgtaaaaggtacgggtaaggaccgtcccgtaggacccgtaactcccggaacgacccgtaacccgggtccgttactttaagtttagtttaacggttaacggttaaacgggccgtaacggtacggtaacgggtaaaccgggttacccgggggaccccggggtacccgtacggtttacggaacccgtacggggtaccggggacccggtaacggggacccgtccgggtacggttcccgccggttccccg

SEQ ID NO: 53616 - DNA, 724 bp, Homo sapiens
  misc_feature: GYAE6OF01ALTT2.29.78.H01.1.454.CMB.1.raw
  modified_base (721)..(721): a, c, t, g, unknown or other
  misc_feature (721)..(721): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccgagggaaggggctggagtgggtctcggctattagtggcagtggtggcgctatatattatgcagacgccctgaacgggccggttcaccatttccagagacaattcgaagaacacgctgtatctgacaaaagtggagagcccgaagacgtcgaccgacacggccgtctattattgtagttaaaggcgagcgtaggaagtacggggaccgggtcccgacgttcgaccacgtacggggaccgagggggacgtcgtcggtccacccggtctccctcgacgtcctcccaaccgaacgggccctacgtccggtcccttcccccgtcggccctacccctcccgtacccgtaacgacgaccctacccgtccggtacgggggaccaccgacggccgaaccggtccccggtacgggtcccgtaccggtccccgttaccgggtaaccgtaaacggtaacccgttaacccgttacccgtaaaccggttacccttaccgttaaacgttcccgttacgggtaccgggacccggggttccggttacggggacccgtaacgggtacccggacgtaacgtgacgngac

SEQ ID NO: 53617 - DNA, 707 bp, Homo sapiens
  misc_feature: GYAE6OF01DZRHN.29.78.H01.1.454.CMB.1.raw
  modified_base (707)..(707): a, c, t, g, unknown or other
  misc_feature (707)..(707): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccgagggaaggggctggagtgggtctcggctattagtggcagtggtggcgctatatattatgcagaccgcccgtgaagggccgttcaccatttccagagactaattacgaaagaacacgctgtatctgacaaagtggagacgcctgacgactcggacgacgaccggccgtctatttagttggtaggttaaaggcgacgtcgtaggtaacggtacccgggggacccggggtcccgacgttcggaccgtaacggtcgggggaccgacgggggccgtcgtcggtacctacccgttctccctaccgacgtcccgtaccccgaaccgtacgggcccctacgttcccggttcccccgtttcccccgtcggtacccctacccccgtccgtacccgaaacgccgccctacccgtcgggtcggggaccacgacgaccgcgtcccgtacgggcctcgggtccgttccgggtacgtaacggtacccttaccgttaccgtaacgttacccttacttacgttcgttggaccgggtccggcgtcgggaacgtacggcgacgtagtgcgn

SEQ ID NO: 53618 - DNA, 633 bp, Homo sapiens
  misc_feature: GYAE6OF01AD5GN.29.78.H01.1.454.CMB.1.raw
  modified_base (412)..(412): a, c, t, g, unknown or other
  misc_feature (412)..(412): n is a, c, g, or t
  modified_base (458)..(458): a, c, t, g, unknown or other
  misc_feature (458)..(458): n is a, c, g, or t
  modified_base (473)..(473): a, c, t, g, unknown or other
  misc_feature (473)..(473): n is a, c, g, or t
  modified_base (484)..(484): a, c, t, g, unknown or other
  misc_feature (484)..(484): n is a, c, g, or t
  modified_base (491)..(491): a, c, t, g, unknown or other
  misc_feature (491)..(491): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgccaggctccagggaaggggctggagtgggtctcggctattagtggcaggtggtggcgctatatattatgcagacgccctggaagggtccggttcacctatttccagagacaattcgaagaacacgctagtatctgacaaatggagacgctgagactcgacgacgacggccgtctattattgtagtaaggcgagctaggaagtaccggggaccgggccgtactcgaccacggtcggggaccgaggggacgcgtggtcctaccgtctccncacgcctaccaccgacgggccctagtccgtcccttccccgtgcccnccctacacgaagccncctacgtcggngggaccncgacgacgacgcccgtagggtcctacggtccgttaggaccgaacggtacccttaaccgtacctacgttaccgtacttacggtcgacgggacgggtcccgggtacgtacggggaccgtaaccggggccaacgtcggtagcgcg

SEQ ID NO: 53619 - DNA, 825 bp, Homo sapiens
  misc_feature: GYAE6OF01C6X0C.29.78.H01.1.454.CMB.1.raw
  modified_base (457)..(457): a, c, t, g, unknown or other
  misc_feature (457)..(457): n is a, c, g, or t
  modified_base (463)..(463): a, c, t, g, unknown or other
  misc_feature (463)..(463): n is a, c, g, or t
tcagatagagtactcacgaccggtgctcgatttagtgtgagtagtttgggtttgggggcgcctgggtacggccgggggggtcgctgagactctcctgtgcggcctctggatttaagttttaggagtcatgccatgaactgggtccgccaggctccgagggaaggggctggagtgggtctcggctagttagtggcaggtggtggcgctatattattatgcagacgccctggaacgggccgttcactattccagagacaagttacgaaagaacacgctagtatctagacaaagtggagagcctagagaccgtacgaacgaccgaccggtccgtacttaagtttagttagtaggttaaggcgagcggtagggaacggtaccggggaccgggtaccgtacgtcgaccgtaacggtcgggggaccgaggggtaccgcgtcggtacccgtaccgtccttcccnccgacnccccgtaccgaacccgtaaccggggcccctacgttcccggttacccccgtttcccccgccgggtacccctacccccgtccctaaccgtaacggacccgtcccgtaacccgtcggggtaccggggacccaccggacgtacccggaccggttaccccggtcggggtcccgttcgggtaccccggttcgggtaaacccggtaaaccgggttacccgtttaccccggtttaacccgaacgggttttaaccccttacgttaacccgttcccgggtaagggtacccggggttcccggggggtacccgttaacgggggaaacccccgggtaaacggggggcccctaacgggttaaccggttaggtggcg

SEQ ID NO: 53620 - DNA, 874 bp, Homo sapiens
  misc_feature: GYAE6OF01D63E5.29.78.H01.1.454.CMB.1.raw
tcagatagagtactcacgaccggtgctcgatttagtgtgagtagtttgggtttgggggcgcctgggtacggccgggggggtcgctgagactctcctgtgcggcctctggattaagtttaggagtcatgccatgaacgtgggtccgccaggcctccgaggggaaggggctggaggtgggtctcggcttattaggtggcaggtggtggcgctaatattattatgcaagaccgccccgtaggaacggggtcccggttccaaccctacttttcccgaaggaacgaactaagttaccgaaagaaccacgctgtatctagacaaagtggagacgcctagacgactcgaaccgaccgaccggtccgtacttatttagttggtaggttaaacggcgaggcgtaggaaacggtaccggggacccggggacccgtacgttcggaaccgtacggtcggggaccgaacgggggaccgcgttacggtcctacccggtcctccctacgaccgtcccctacccgaaacccggaaccggggtcccctaacggtttcccccggggttcccccctttacccccccgggtcggggtccccccgtacccccggtacgtaccccgttaccccgggaacgggtacccgtacccccgtaaccccggtacccggaacggtaacccggacccccgaaccggtacccggggtaccccccgggtccccggttccgggggtacccgtttccgggaccccgggtttacgggtaacccgtaaaccgggttaccccttaaacccgttacccgtaacggttaaccctttcgtaaacgttccggtacgggtaccgggccgggtaccgtacggggtaacccggaaacggggccctaccgtaagtaggc

SEQ ID NO: 53621 - DNA, 952 bp, Homo sapiens
  misc_feature: GYAE6OF01E1J0F.29.78.H01.1.454.CMB.1.raw
  modified_base (671)..(671): a, c, t, g, unknown or other
  misc_feature (671)..(671): n is a, c, g, or t
tcagatagagtactcacgaccggtgctcgatttagtgtgagtagtttgggtttggggtccgagccatggtgcagactccccagagcctctcctcctcctccactgcacagggtctctctcccagcctgtgctgactcaatccgccctctgcctctgccctcccgtggggagctcggtacaaggtccacctgtactctgagcaggtcggacacagcagcctaccgccagtcgcttggctatcaggcaggacggccacggaccgaccgggtcccttgttaacgtgactagaccaagtacaaacttaacggtaggtacgtactacggtaccgaacgggtacggtaccggtaaccgggggtaccggggtaaacgggttaccccgggttacggttacccgttaccggttaccgtttacccggttacccgttaaccggttacccgttacccggttacccgggttaccccggttaccgggttaccggggttaccccggttacccggggtacccggttaacccgggtaaccccggttaaccccgttaccccgttaaccccgtaacccgttaaccccgttaaccccggttaccccgttaccccgggtacccggttacccggttacgggttaaccgggttaacgggtaacgggtaaccggttacggtaaccggttaaccgnttaaccgttaaccggttaccggttaaccggttaccgggtaaccgggtaccgggtaacccggtaccgggttaccggttaaccggtttaccggtttacccgggttaaccgggtttacccgggtacccggggtaacccgggttaacccgggtaacccggggtaaccccgggtacccgggttacccggtacccgggtacccggtaccccggtaaccccggtaacccggtaccccgtaaccccgtacccgttaccccgttacccgttaccccgttcccgttacccg

SEQ ID NO: 53622 - DNA, 661 bp, Homo sapiens
  misc_feature: GYAE6OF01EZHL1.29.78.H01.1.454.CMB.1.raw
  modified_base (259)..(259): a, c, t, g, unknown or other
  misc_feature (259)..(259): n is a, c, g, or t
  modified_base (442)..(442): a, c, t, g, unknown or other
  misc_feature (442)..(442): n is a, c, g, or t
  modified_base (447)..(447): a, c, t, g, unknown or other
  misc_feature (447)..(447): n is a, c, g, or t
  modified_base (659)..(659): a, c, t, g, unknown or other
  misc_feature (659)..(659): n is a, c, g, or t
tcagatagagtactcacgaccggtgctcgatttagtgtgagtagtttgggtttgggggcgcctgggtacggccgggggggtcgctgagactctcctgtgcggcctctggatttaagttttaggagtcatgccatgaactgggtccgccaggctccgaggggaaggggctggaggtgggtctcggctattaggtggcaggtggtggcgctatatattatgcagacgccctaggaacgggccggttcacctatttccaganactaattcgaagaacacgctgtatctgacaagtggagagcctagagacgtaccgacgaccgaccggtccgtactatttagttggtaggttaaacggcgagcgtaggaacgtaccgggggacccggccgtactcggaccgacggtcggggacgtacggggcgtcgtcggtcctaccgtctaccncgacncccgtacccgaaccgaccggccctacgttcccggtccccttccccgcggtacccctaccccttccgtaccgaacggaccgcccgtaccgtccgggacggggaccacgtacgcgaccggccgtcggcctcgtccgtaggtaccaacggtactacctcgtacgtacctctacgtcgaggaccggcggtaccgtggacgtacggcgacgacgtgnag

SEQ ID NO: 53623 - DNA, 841 bp, Homo sapiens
  misc_feature: GYAE6OF01EAC40.29.78.H01.1.454.CMB.1.raw
  modified_base (144)..(144): a, c, t, g, unknown or other
  misc_feature (144)..(144): n is a, c, g, or t
tcagatagagtactcacgaccggtgctcgatttagtgtgagtagtttgggtttgggggcgcctgggtacggccgggggggtcgctgagactctcctgtgcggcctctggattaagtttaggagtcatgccatgaactgggtccnccaggctccgaggggaagggctggagtgggtctcggctattagtggcaggtggtggcgctatatattatgcagaccgcccgtaggaacggggtccgttacacctatttccgagagactaattcgaaagaacacgtctagtactctagactaaagtggagacgtcctagagtactacggacgacgaccggtccgtattatttagtggtaggttaaaggcgtagtcgtaggaacggtaccgggggacccgggtacccgtacgttacggacccgtacggtcgggggaccggacgggggtaccgtcggttcggtacccgtacccggttcctacccgtaccgtaccgtcccctacccgaacccggtaaccggggtcccctacggttccccggttcccccgtttccccccggtaccgggtcccccttacccccgtacccgtaacccgaacggtacccgtaccctaccccggttcggggtaccggggaccctaaccggaccggtacccggtaacccggtcccccgggtacggggtccccttaccgggtacccggttacggggttaacccgtaaaccgggttaccctttaaccccggttacccgtaacgggttacccttaaccgtttaccggttccggtacggggtaccgggtcccggggtacggtacgggaacccggtacgggacccgtagtaacggtgcgtac

SEQ ID NO: 53624 - DNA, 479 bp, Homo sapiens
  misc_feature: GYAE6OF01E5KTW.29.78.H01.1.454.CMB.1.raw
  modified_base (249)..(249): a, c, t, g, unknown or other
  misc_feature (249)..(249): n is a, c, g, or t
  modified_base (277)..(277): a, c, t, g, unknown or other
  misc_feature (277)..(277): n is a, c, g, or t
  modified_base (455)..(455): a, c, t, g, unknown or other
  misc_feature (455)..(455): n is a, c, g, or t
  modified_base (458)..(479): a, c, t, g, unknown or other
  misc_feature (458)..(479): n is a, c, g, or t
tcagatagagtactcacgaccggtgctcgatttagtgtgagtagtttgggtttgggaggctcggtcaaggtcacctgtactctgagcagtggacacagcagctacgccatcgcttggcatcagcagaggccagacacgggccctcgttacttgatgacagtcaacaatgatggcagtcacaggcgaaaggggggacggatccctgatcgcttctcagtcctccagctcgtgggcctgagccgcctaccncacaactcctccggcctccagtctgagntgaggctgactattactgtcaggaccgtggggcacgtggctattcgaggttcgtaccgggaccgggacaaggtcacgtcgtccgcacgccccaggccccaacccgatcgtcactcctcgttcccaccctcctcacgtactctactcgtagacggcggcgtggacacggcgacagtagntgnnnnnnnnnnnnnnnnnnnnnn

SEQ ID NO: 53625 - DNA, 753 bp, Homo sapiens
  misc_feature: GYAE6OF01BUZVB.29.78.H01.1.454.CMB.1.raw
  modified_base (420)..(420): a, c, t, g, unknown or other
  misc_feature (420)..(420): n is a, c, g, or t
tcagatagagtactcacgaccggtgctcgatttagtgtgagtagtttgggtttgggggcgcctgggtacggccgggggggtcgctgagactctcctgtgcggcctctggatttaagttttaggagtcatgccatgaactgggtccgccaggctccgagggaagggctggagtgggtctcggctattagtggcaggtggtggcgctatatattatgcagaccgccctggaacgggccggttcacctatttccagagactaattacgaagaacacgctagtatctgacaaagtggagacgcctgagacgtcgacgacgacggccgtactattacgttgtagttaaaggcgtagctagggaacgtacggggaccccggggtccctagttcggacctacggtggggggcccgtaagggggaccncgtcggcctaacccgtccgtccctacgacgcccgttacccgaccggtaacgggcccctacgtccgggttaccccttcccccgtcgggtaccccaccccgttcccgaccctaacggcgtacccgccgtaccggtcgggggaccaacgacgaccgaccgtccccggtcgggtccgttccgggcccgttacgggtaacccgtaacggggttaccccttaacgtttaccccgtaacggtttaacccttaccgttaaaccgttccgttaccgggaacgggtccgggggtaccgtaaccggggaccgtaaccggggacccggtacacggttaggctacg

SEQ ID NO: 53626 - DNA, 694 bp, Homo sapiens
  misc_feature: GYAE6OF01BIBEP.29.78.H01.1.454.CMB.1.raw
  modified_base (252)..(252): a, c, t, g, unknown or other
  misc_feature (252)..(252): n is a, c, g, or t
tcagatagagtactcacgaccggtgctcgatttagtgtgagtagtttgggtttgggggaagaggaagactgacggtccacccctgggatcttcaggtgttttcatttggtgatcaggacggaacagagagaactcaccatggagtttgggctgagcgtggtcgttttcttaggtggctaattttaaaaggtgtccagtgtgacgtgcagttggtggagtcgtggggcgccgtggggtacgggccggggggtncgtgagactctcctgtgcggcctcgtggattaagttttaggagtcatgccagtgaacgtgggtccgccaggcctccgaggggacgggcgtgggagtgggtcgtcggactagttggtggctaggtggtggcgtactatagttattagtgacgagacccgtcccgtaaggacggggtccggtttaccaacctacgtttaccgagtaacgactaacgttacggaaacaaccgacgtcttagtactaccgttgaactaaaggtggacgaacgtcgtacggagtaacctacggaacgaacccgaccggtccgttacgttatttacgttagtaaggttaaaggcgaagtcggtaaagggtaacggtacccggggacccgggtacccgtacggttaccggaacccgtacgggtccggggtaccggacggggcggttcgtcggtaccccg

SEQ ID NO: 53627 - DNA, 620 bp, Homo sapiens
  misc_feature: GYAE6OF01C3AY4.29.78.H01.1.454.CMB.1.raw
  modified_base (146)..(146): a, c, t, g, unknown or other
  misc_feature (146)..(146): n is a, c, g, or t
  modified_base (329)..(329): a, c, t, g, unknown or other
  misc_feature (329)..(329): n is a, c, g, or t
tcagatagagtactcacgaccggtgctcgatttagtgtgagtagtttgggtttggggtccgagccatggtgcagactccccagagctctcctcctcctccactgcacagggtctctctcccagcctgtgctgactcaatcgccctntgcctctgcctcctgggagctcggtacaaggtcacctgtactctgagcagtggacacagcagctacgccatcgctggcatcagcagagcagacgaccggcctcgttactgatgacagtacaaactatgatggactagtcaacgaggacgaacgggggacgactcctaggactccgtcttaccncgtacgttcctacagtcgttacgtcgggcctacggacgtctaccttaacctccaacttacgtcccgtacccggccttacgtaacgtctaggacgactcggacgtctagacttagtacgtgtcgtaacgtaccgtagggcctaaggtcggtactagtttccggacggtttaccggtaccgggaaccggtaacctaacggtccgtacccggttcggcggttacacccggtacccaaacccggtaccccaacccgtacttaccgtacctaaccgttccgttcccggtacccccg

SEQ ID NO: 53628 - DNA, 787 bp, Homo sapiens
  misc_feature: GYAE6OF01B6VN1.29.78.H01.1.454.CMB.1.raw
  modified_base (782)..(782): a, c, t, g, unknown or other
  misc_feature (782)..(782): n is a, c, g, or t
tcagatagagtactcacgaccggtgctcgatttagtgtgagtagtttggggtttgggggcgcctggggtacgggccggggggggtcgctgagactctcctgtgcggcctctggattaagttttaggagtcatgccatgaactggggtccgccaggctccgaggggaaggggctggaggtgggtctcggctattagtggcagtggtggcgctatatattatgcagaccgccctggaacgggccggttcacctattccagacgacaattcgaaagaacacgctagtatccgtgacaaagtggagacgtcctagacgtaccgtacgacgaccgacggtccgtactacttagttagtaggttaaaggcgagcgtacggaacggtaccggggacccggggacccgtacgttacgaccgacggtacgggggaccgacgggggacgcggtcggtccaccggtcctccgtcaccgtccctacccgaaccggaccgggtaccctacgttaccggttcccctttccccccgcgggtacccctaccccgttaccaaccgtaacggaccgacccgtaacccgtccgggtacggggccaacccgtacggccgtaacccgtccccgggtcgggtaccgtccgggtacccgttacgggtaccgtaaaccgggttaccttaacccgttacccgtaaacggtttacccttaagttaaccgtacgggtttaccgggaacggggttcccggggtaaccggtaccggggaaccgtaacggggtaccgtaacgtaacgtgggntacgg

SEQ ID NO: 53629 - DNA, 655 bp, Homo sapiens
  misc_feature: GYAE6OF01DZWA7.29.78.H01.1.454.CMB.1.raw
tcagatagagtactcacgaccggtgctcgatttagtgtgagtagtttgggtttgggggcgcctgggtacggccgggggggtcgctgagactctcctgtgcggcctctggatttaagttttaggagtcatgccatgaactgggtccgccaggctccgaggggaaggggctggagtgggtctcggctattagtggcagtggtggcgctatatattatgcagacgcctgaacgggtcgttcaccatttccagagacaattacgaagaacacgctgtatctgacaaatggagagcctgagactcgacgacacggccgtctatttagttagtagttaaaggcgagcgtgggaaacgtaccggggacccggggcccgtacttcgaccgacggtcggggccgagggggaccgtcgtacggtccgaccgtccgtccctcgacgtccctcccgaaaccgaacgggtcccacgtccggttcccttccccgtcggaccctacccgtacctacccgaacgaccgacctacccggtcggtcggggaccacgacgacgaccggcccgtgggctcggtctccgggtacgaacgtaccttaccgtaccgtacgttactcttagttccgaggacggtcggaccggtggaccggaacgggcgagtacgtgtgc

SEQ ID NO: 53630 - DNA, 726 bp, Homo sapiens
  misc_feature: GYAE6OF01ER2EK.29.78.H01.1.454.CMB.1.raw
  modified_base (235)..(235): a, c, t, g, unknown or other
  misc_feature (235)..(235): n is a, c, g, or t
tcagatagagtactcacgaccggtgctcgatttagtgtgagtagtttgggtttggggtccgagccatggtgcagactccccagagctctcctcctcctccactgcacagggtctctctcccagcctgtgctgactcaatcgccctctgcctctgcctcctgggaggctcggtcaaggtcacctgtactctgagcaggtggacacgagcagctacgcatcgcttggcatcagcagnggccagacacgggcctcgttactgatgacagtcaacaatgatggcaggtcacgagcgaagggggaccgatccgagatcgcttctcagtctccagtctcgtcggcctggacgcgacctaccctacaacgtaacgtccgtccccggaccttacccgtaggttccgtagggaacggtacgtcgggtaacgggtccttaacgggttaactttacgtttaacccgttcggttaccggtaaccggtacccgggttaggggtaccgaacggtttaccggggacttaacggttttacccgggtacgggtttacccggttacccggggggaaacccggggtaaaccccggttaacggggtacccgtacccggggttacccggttaccgggtaacccggacccggtaacccccggaaacccgggtaaacccccgaaaccccccggtaccgtttacccggaaccccgttaccgttccccggttaacccgtttaacccccccg

SEQ ID NO: 53631 - DNA, 638 bp, Homo sapiens
  misc_feature: GYAE6OF01CDT8N.29.78.H01.1.454.CMB.1.raw
  modified_base (324)..(324): a, c, t, g, unknown or other
  misc_feature (324)..(324): n is a, c, g, or t
  modified_base (349)..(349): a, c, t, g, unknown or other
  misc_feature (349)..(349): n is a, c, g, or t
  modified_base (416)..(416): a, c, t, g, unknown or other
  misc_feature (416)..(416): n is a, c, g, or t
  modified_base (634)..(634): a, c, t, g, unknown or other
  misc_feature (634)..(634): n is a, c, g, or t
  modified_base (636)..(636): a, c, t, g, unknown or other
  misc_feature (636)..(636): n is a, c, g, or t
tcagatagagtactcacgaccggtgctcgatttagtgtgagtagtttgggtttgggggcgcctgggtacggccgggggggtcgctgagactctcctgtgcggcctctggtatttaagttttaggagtcatcgccatgaacgtgggtccgccaggctccgagggaagggctggaggtgggtctcggcttagttagtggcaggtgggtggcgctatatattatgcagaccgcccgtaggaacggccgttaccactattccgagagacaattcgaaagaacacgctgtatctgacaaagtggagacgccgtgaacgactcgacgacncggctctattatgttaggttaaggngagcgtaggaagtaccgggggacccggggcccgtacgttcgaaccgtggtcggggaccgaggggacncggttacggccacccggtctccgcgacgtccctaccgaaccgacgggccctacgttcccggttccttcccccgtggcccctacccgtcctaccgaagcgcctaccgtcggtcgggccaacgcgcaccgccgtcggtctcgccgttcggacgaacggtaccctactccgtaagtcctactcgtcgttagaccggcggtacgcggacgacgggcataagngngc

SEQ ID NO: 53632 - DNA, 604 bp, Homo sapiens
  misc_feature: GYAE6OF01CC327.29.78.H01.1.454.CMB.1.raw
  modified_base (283)..(283): a, c, t, g, unknown or other
  misc_feature (283)..(283): n is a, c, g, or t
  modified_base (336)..(336): a, c, t, g, unknown or other
  misc_feature (336)..(336): n is a, c, g, or t
  modified_base (435)..(435): a, c, t, g, unknown or other
  misc_feature (435)..(435): n is a, c, g, or t
tcagatagagtactcacgaccggtgctcgatttagtgtgagtagtttgggtttggggtccgagccatggtgcagactccccagagctctcctcctcctccactgcacagggtctctctcccagcctgtgctgactcaatccgccctctgcctctcgccctcccgtggggagctcggtcaaggtcacctgtactctgagcagtggacacagcagctacgcatcgcttggcatcagcgagacggccaggaccgacgggtcccttagttactgatgacagtacaanatgatggcagtacacgaggcgggaaggggacgtatcccgtgacgtcgtcttcncgacgtctacgagtccttcgcgggcctagacgctacctactcactactccgccgcctcgagtcgaggacgtatcggacgtctagtaacttacgttacgngtacgacggtaccgtggacctaacggtgacttagttaccggcggttaccggtaccgggaaccggtaaccgtacggtcccgtaaccggttcggtaccggtacgaccgtaccccggaaccgggaccctaaccccgtagttccgacctaccgttcccgttcccgttaccccg

SEQ ID NO: 53633 - DNA, 687 bp, Homo sapiens
  misc_feature: GYAE6OF01BGY8P.29.78.H01.1.454.CMB.1.raw
  modified_base (439)..(439): a, c, t, g, unknown or other
  misc_feature (439)..(439): n is a, c, g, or t
  modified_base (683)..(683): a, c, t, g, unknown or other
  misc_feature (683)..(683): n is a, c, g, or t
tcagatagagtactcacgaccggtgctcgatttagtgtgagtagtttgggtttgggggcgcctgggtacggccgggggggtcgctgagactctcctgtgcggcctctggatttaagttttaggagtcatgccatgaactgggtccgccaggctccagggaaggggctggagtgggtctcggctattagtggcagtggtggcgctatatattatgcagacgccctggaagggccggttcaccatttccagagacaattcgaaagaacacggctgtatctgacaaagtggagagcctagacgactcgaacacgacggccgtctaattacttgtaggttaaggcgagacgtaggaacgtaccggggacccggggacccgacgttacgaccgacgtcgggggccgagggggacgcgtcggtaccgtacccggtcctcccgtcncgtcccctacccgacccgaacgggccctacgttcccggtcccttaccccccgtcggacccctacccctcccgtaccaacgccgaccgtacctccggcggggccacgacgccgacgccccgtgggtcctcgtcccggtcggtacgaaccggtacttacccgttaccgtaacgtttccctacgttaacgtcgttaggacgggccgggtacgtacggggaccgtaacgggacccggacctaagtggntacg

SEQ ID NO: 53634 - DNA, 678 bp, Homo sapiens
  misc_feature: GYAE6OF01DXKRU.29.78.H01.1.454.CMB.1.raw
  modified_base (180)..(180): a, c, t, g, unknown or other
  misc_feature (180)..(180): n is a, c, g, or t
  modified_base (215)..(215): a, c, t, g, unknown or other
  misc_feature (215)..(215): n is a, c, g, or t
  modified_base (238)..(238): a, c, t, g, unknown or other
  misc_feature (238)..(238): n is a, c, g, or t
  modified_base (271)..(271): a, c, t, g, unknown or other
  misc_feature (271)..(271): n is a, c, g, or t
  modified_base (273)..(273): a, c, t, g, unknown or other
  misc_feature (273)..(273): n is a, c, g, or t
  modified_base (277)..(277): a, c, t, g, unknown or other
  misc_feature (277)..(277): n is a, c, g, or t
  modified_base (296)..(296): a, c, t, g, unknown or other
  misc_feature (296)..(296): n is a, c, g, or t
  modified_base (311)..(311): a, c, t, g, unknown or other
  misc_feature (311)..(311): n is a, c, g, or t
tcagatagagtactcacgaccggtgctcgatttagtgtgagtagtttgggtttggggggagagaggagtccacccctgggatcttcaggtgttttcatttggtgatcaggacggaacagagagaactcaccatggagtttgggctgagcggtcgtgtttctaggtggctaatttaaaggngtcagtgtgagtgctagttggtggagtctggggcnccgtgggtacggcgggggggtcngtgagctctcgtgtgcgctgtgtatttagttgntnatcncatagacgtcggtccgcgngcgtcgagggagggnggtggtggtggtcgtcgtacgtagttgtggtgtggtggtcggtcgtctatatattagtgacgacgaccgtacgtacggtacggtccgtacgtactacgttacgtacgtaacgtaacgtacgtacgtaacgaacgtacgtacgtagttactacgtacgtaacgtaacgtaggacgtacgtacgtacggtacgtacgtacggaccgtacgtaccggtacgttacgttacgtttacgttaggttaggttaacggtacggtacgtacggtacgggtaccgggtaccggggtacccgggtaccggtacgtacggtaccggtacgggtacgggaccgggtacgggtacggtacggtaccggtccgtccgtccg

SEQ ID NO: 53635 - DNA, 716 bp, Homo sapiens
  misc_feature: GYAE6OF01B9TV6.29.78.H01.1.454.CMB.1.raw
tcagatagagtactcacgaccggtgctcgatttagtgtgagtagtttgggtttggggtctgagagaggagtccacccctgggatcttcaggtgttttcatttggtgatcaggacggaacagagagaactcaccatggagtttgggctgagcgtggtctttttcttgtggcttaatttttaaaaggtgtccagtgtgacgtgcagttggtggagtcgtgggggcgccgtggggtaccgggccgggggggtcgcgtgagactctcctgtcgcggcctctggtatttaagttttaggagtcatgccatgaacgtgggtcccgccgaggcctccgaggggaacggggcgtgggaggttggggtcgtcggcttagtttaggtggcgtagggttgggtcgggcgtacttaattattaatttatgacgtacggacccgcccgttaaggaacggggtccccggtttaccaacctacgtttccgaaggaacgaacctaagttacggaaacgaaccacgtcttagtaacttcgtagactaaagtggagacgtccgtagacgtacgtcgaaccgaccgaccggtccgttacttaagtttagtttcggtaggttaaaacggccggtaagtaccgtaggggtaaacgtacccgggggaccccgggtacccgtacgttaccggaacccgtacgggtccggggaccgaagggggccgtcggtcgggtcccg

SEQ ID NO: 53636 - DNA, 620 bp, Homo sapiens
  misc_feature: GYAE6OF01BWJXD.29.78.H01.1.454.CMB.1.raw
  modified_base (619)..(620): a, c, t, g, unknown or other
  misc_feature (619)..(620): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtagttaaaggcgagctggaagtacggggaccggggcccgacgttgaccgacgtcggggccgagggggacgcgtggtcaccgtctccctcacgccctccaccgaacgggcccacgttccggtcccttccccccgtcggcccctaccccgtccctacccaacgaccgcctacccgtcggtcgggggccaccgacgccgacgccccgtcgggcctcgcccgttcggtaccgaagggtacctaccgttccgtaacgttacctcttacgtcgtggacggcgggcgtcggcgaacggcgacagtgnn

SEQ ID NO: 53637 - DNA, 708 bp, Homo sapiens
  misc_feature: GYAE6OF01E3WQ8.29.78.H01.1.454.CMB.1.raw
  modified_base (368)..(368): a, c, t, g, unknown or other
  misc_feature (368)..(368): n is a, c, g, or t
tcagatagagtactcacgaccggtgctcgatttagtgtgagtagtttgggggtttggggagagctctggggagtctgcaccatggctcggaccccactcctcttcctcaccctcctcctccactgcacagggtctctctcccagcctgtgctgactcaatcgccctctgcctctcgcctcccgtggggagctcggtcaaggtcacctgtactctgagcaggtggacacagcagctacgccatcgcttggcatcagcaggacggccagaccgaccggggtccctcgttacttgatagacagtacaaacaatgagtggacacgtacacgaggacggaagggggacggtactcccgtgacgtcgtccttcnctacgtcctacgacgtcgtcggtcgggcctggacgtccgtacctaccgtctaaccgtaccttccgtacccggtcccgtacgtacggtcgtagggaacggtagtacgggacggtaccttacgtaacctttacgttaccgttcggtaccgtaaccggggttaaccggttcggggaccctacggtccgggtaccttacggttccgggtacgggttaccccgggttaccggggaaccccggggttacctaaaccgggggttccccgtacccgggtttaccgggtcccgggtaaccctacccgggaaccccctaaccgggacccccgtaaaccccccgttaacgg

SEQ ID NO: 53638 - DNA, 864 bp, Homo sapiens
  misc_feature: GYAE6OF01CJVSU.29.78.H01.1.454.CMB.1.raw
  modified_base (245)..(245): a, c, t, g, unknown or other
  misc_feature (245)..(245): n is a, c, g, or t
  modified_base (330)..(330): a, c, t, g, unknown or other
  misc_feature (330)..(330): n is a, c, g, or t
  modified_base (821)..(821): a, c, t, g, unknown or other
  misc_feature (821)..(821): n is a, c, g, or t
tcagatagagtactcacgaccggtgctcgatttagtgtgagtagtttgggtttggggggagagaggagtccacccctgggatcttcaggtgttttcatttggtgatcaggacggaacagagagaactcaccatggagtttgggctgagcgtggtctttttctgtggcttaatttaaaaggtgtcagtgtgacgtgcaggttggtggagtcgtgggggcgccgtggggtacgggccgggggggtcncgtggacgactctcctggtcgccggcctgtaggtatttaaggttttaggacgtcagtcgcctaagtcgtaaacgtcggggtcccnccgtagggtcctaccggaagggggagggggtctaggggacggttggggtcctcgggtacttagttaggtggctagggtgggtgcgtattatattattgtgacacggccgcccgttagggaacgggtcccgtttacaacccttagtttcccgaaaggacgtaaaccgtaacgtttaaccgggaaaactaaccggaacgtcgttaaggttaacctttcgacgggtaaacaaaaggttcgggaaacgtaacggtcccgtaaggaacgtaccggtaccgaaccggaaccggtaacccgggtcctttagttaaacttttcggttagggttaaacgggttaaaggcccggtaaagttacccggttaagggggaaaaccccgggggtttacccgggggggaaaccccccggggggtttacccctaaacccgggttttacgggaaacccccgtacgggggttcccggggggaaaacccgggacgggggggttaaacccncccgggttttaaacggggtcccccgttaaccccggtttcccgg

SEQ ID NO: 53639 - DNA, 728 bp, Homo sapiens
  misc_feature: GYAE6OF01B2BH0.29.78.H01.1.454.CMB.1.raw
  modified_base (722)..(722): a, c, t, g, unknown or other
  misc_feature (722)..(722): n is a, c, g, or t
  modified_base (725)..(725): a, c, t, g, unknown or other
  misc_feature (725)..(725): n is a, c, g, or t
tcagatagagtactcacgaccggtgctcgatttagtgtgagtagtttggggtttgggggcgcctgggtacggccgggggggtcgctgagactctcctgtgcggcctctggatttaagttttaggagtcatgccatgaactgggtccgccaggctccgagggaaggggctggagtgggtctcggctattagtggcagtggtggcgctatatattatgcagacgccctaggacggtccgtcacctattccagagaactaagttacggaaagaacacgtctagtactcgtgactaaaagtggaagacgccgtagacgtacgtacgacgacgaccggtccgttactatttagttgttaggttaaaggcgagtcgtaggtaaacggtaccggggacccggggtacctacgttacgaccgtacggtcggggaccgacggggaccgtacgtcggtacctaccgtcctcccgtacacgtcccctaccgaaccggaacgggacccctacgtcccggttacccctttcccccgagggtccccctaaccccgttccaaccggaacgcctacccgtacccgtcggggtaccgggacaacgtccggaccgccggtaccccggtggtcccttcggcccggttagggtaacctaaaccgggttcctttaacccgtcgtaacgtcctacgtacgttcggtacgcgggttccgacgtcggaacgacggaccaagtacgngtnacg

SEQ ID NO: 53640 - DNA, 596 bp, Homo sapiens
  misc_feature: GYAE6OF01DLAD9.29.78.H01.1.454.CMB.1.raw
  modified_base (591)..(591): a, c, t, g, unknown or other
  misc_feature (591)..(591): n is a, c, g, or t
  modified_base (595)..(596): a, c, t, g, unknown or other
  misc_feature (595)..(596): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggcctctattattgtagttaaaggcgagctaggaagtaccggggaccgggcccgacgttcgaccacgtgggccgaggggacgcgtacggtcaccgtctcctcacgccctcccaccgaacgggcccagtccggtcccttcccccctcggccctacccctccctaccaacgacgccaccctcgtcggggccacgcgcgacgccctgggcctcggcctggtaccaacggtactaccttcctagtacctctactcgtagcggccgggctgggaccgaagggaccgcgtaanagtnn

SEQ ID NO: 53641 - DNA, 676 bp, Homo sapiens
  misc_feature: GYAE6OF01AKYE0.29.78.H01.1.454.CMB.1.raw
  modified_base (672)..(672): a, c, t, g, unknown or other
  misc_feature (672)..(672): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccgttcaccatttccagagacaattcgaagaacacgctgtatctgcaaatggagagcctgagactcgacgacacggccgtctattattgtagttaaaggcgagctagggaacgtaccggggacccggggcccgacttcgaccgacgtcgggggccagggggaccgcgtcggtccaccgtctccctcacgccctaccaccgaacgggccccagtccggtcccttccccccgtcgggtccccaccccgttccctacccgaaacgaccgcccgaacccgttccggtcgggggaccctaccgacgcccgaacggtccccgtcggggtccgtcggtcccgttgggtacccgaacgggtacccttaccgttcccgtaagttacccttacgtacgttccgtaggaccggtccgggaccgttgggacccgtaacgggccgacgacgtaggntacg

SEQ ID NO: 53642 - DNA, 584 bp, Homo sapiens
  misc_feature: GYAE6OF01EVALC.29.78.H01.1.454.CMB.1.raw
  modified_base (263)..(263): a, c, t, g, unknown or other
  misc_feature (263)..(263): n is a, c, g, or t
  modified_base (305)..(305): a, c, t, g, unknown or other
  misc_feature (305)..(305): n is a, c, g, or t
  modified_base (557)..(557): a, c, t, g, unknown or other
  misc_feature (557)..(557): n is a, c, g, or t
  modified_base (559)..(559): a, c, t, g, unknown or other
  misc_feature (559)..(559): n is a, c, g, or t
  modified_base (563)..(584): a, c, t, g, unknown or other
  misc_feature (563)..(584): n is a, c, g, or t
tcagatagagtactcacgaccggtgctcgatttagtgtgagtagtttgggtttgggaggctcggtcaaggtcacctgtactctgagcagtggacacagcagctacgccatcgcttggcatcagcagaggccagacacgggccctcgttacttgatgacagtcaacaatgatggcagtcacaggcgaaggggggacgggatcccgtgatcgcttctcagtcctccagcctcgtggggcctggacgccgcctacctcacaatccncccggcctccagtctgaggatggaggctgacttatttaccgngtaccacggtaccggtggggacaccgttgggactagtttccggacggttccgttacccggggaacccggggaacctaagggtccacccggttcggtccggtcaacggccccgaaacgggacccccaaccccgacgttcgtacctacccttccttccggttcccccgccccgttccctaccgtaccgttactccttacgtccgtacggtacggtccgggacggtcgggacgaacgggaccacgtacgtagcgntncgannnnnnnnnnnnnnnnnnnnnn

SEQ ID NO: 53643 - DNA, 691 bp, Homo sapiens
  misc_feature: GYAE6OF01DFQCN.29.78.H01.1.454.CMB.1.raw
  modified_base (561)..(561): a, c, t, g, unknown or other
  misc_feature (561)..(561): n is a, c, g, or t
  modified_base (568)..(568): a, c, t, g, unknown or other
  misc_feature (568)..(568): n is a, c, g, or t
  modified_base (687)..(688): a, c, t, g, unknown or other
  misc_feature (687)..(688): n is a, c, g, or t
tcagatagagtactcacgaccggtgctcgatttagtgtgagtagtttgggtttgggggcgcctggggtacggccgggggggtcgctgagactctcctgtgcggcctctggattaagttttaggagtcatgccatgaactgggtccgccaggctccgagggaaggggctggaggtgggtctcggctattagtggcagtggtggcgctatatattatgcagaccgccctggaacgggccggttcacctatttccgagagacaattacgaagaacacgctgtactctagacaaagtggagacgccgtgagacgtacgacgaacgaccggccgtacttattagttgttaaggttaaaggcggagcgtaggaaacggtaccggggacccggggcccgtacgttacggacccgacggtcggggccggacggggacgcgtcggtccaccgtctccctacgcgccctccgaccgaacggcccctacgtccggttccccttcccccgtacggccccctaccccttccgtacccgaaagtacccgttaccgtcgggtaccggggacctacncggaccncggcccgtgggcctccggccgtaggtaccgaacggtaccttcctaccggtacttaccgtcttaacgtcggtggtaccgggcgggtcgttaccggggactaacgggccgactaaggtcgnngag

SEQ ID NO: 53644 - DNA, 659 bp, Homo sapiens
  misc_feature: GYAE6OF01DFFWA.29.78.H01.1.454.CMB.1.raw
  modified_base (242)..(242): a, c, t, g, unknown or other
  misc_feature (242)..(242): n is a, c, g, or t
tcagatagagtactcacgaccggtgctcgatttagtgtgagtagtttgggtttgggggagagaggagtccacccctgggatcttcaggtgttttcatttggtgatcaggacggaacagagagaactcaccatggagtttgggctgagctggctttttcttgtggctattttaaaaggtgtccagtgtgacgtgcagttggtggagtcgtgggggcgccgtggggtacgggccgggggggtcncgtgagactctcctgtgcggcctctggtatttaagttttaggagtcatgccatgaacgtcgggtccgcaggcctccgaggggagggctgggagtgggtctcggctagttaggtggcaggtggtggcgtctatattattagtgacaggaccgccgtaggaacggggtcccgttacacctacgtttccgaaggtacgtaactaagttacgaaacgaaccaacgtctagttacttgtacgactaaagtgggagacgacgtgacgacgtcgaacgacgaccggtccgtacttacttagttgttaagttaacgggcgacgtcgtaggtaacgggtaccggggacccggggtccctacgttcggacccgacgggtcggggacccggtagggggaccgtaccggtcggtcccgtcccgttcccg

SEQ ID NO: 53645 - DNA, 763 bp, Homo sapiens
  misc_feature: GYAE6OF01DH9IU.29.78.H01.1.454.CMB.1.raw
  modified_base (630)..(630): a, c, t, g, unknown or other
  misc_feature (630)..(630): n is a, c, g, or t
  modified_base (760)..(760): a, c, t, g, unknown or other
  misc_feature (760)..(760): n is a, c, g, or t
  modified_base (762)..(762): a, c, t, g, unknown or other
  misc_feature (762)..(762): n is a, c, g, or t
tcagatagagtactcacgaccggtgctcgatttagtgtgagtagtttgggttgggggcgccgtgggtacggccggggggtcgctgagactctcctgtgcggcctcgtggtatttaagttttaggagtcatgccatgaacgtcgggtcccgcgaggtctccgaaggggaacgggtctgggaggttcgggtctcggacttagttaggtggcgtaggtggtcggacgtacttatattattagtcgcacggaccgtcccgtaggaacgggtcccggttacaaccgttattccgaaggtacgaactaagttaccgaaagaccgacgcgttagtactcgtagacgtaagtggagacgccgtagacgtacgcggaacgacgtaccggtccgttcttaagtttagttcggtaaggttaaacggcgtacgtcgttaagggaaccggtaccgggggacccgggtaccgtacgttcgacccgtacggcggggaccgaggggacgtcgtcggtaccaccgttcgttcccacgacgtccctaaccgaccgtaacgggcccacgttccgtcccgtacccgtcggacccctacccgtacccgtacgaacgccgtaccgtaccgtcggtacggggcaacgcgaccncggtcccggtaggtccgtaccggttccggtaggtaccgaaacggtaccctaaccggtttcctaacggtaccttaccgttacgttaccggtacggcgggttaccggcgttacggacgacggactacgatgngng

SEQ ID NO: 53646 - DNA, 640 bp, Homo sapiens
  misc_feature: GYAE6OF01C4DLE.29.78.H01.1.454.CMB.1.raw
  modified_base (389)..(389): a, c, t, g, unknown or other
  misc_feature (389)..(389): n is a, c, g, or t
  modified_base (638)..(638): a, c, t, g, unknown or other
  misc_feature (638)..(638): n is a, c, g, or t
tcagatagagtactcacgaccggtgctcgatttagtgtgagtagtttgggtttgggggcgcctgggtacggccgggggggtcgctgagactctcctgtgcggcctctggatttaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgacaaatagagagcctgagactcgacgacacggccgtctattattgtagttaaaggcgagctaggaagtaccggggacccggggcccgacttgaccacgtggggccaggggacncgtggtcaccgtctcctcacgccctccaccacgggcccagtccggtccttccccctggcccacccctccctacccaacgacgccacccgttcggtcgggggacctaacgacgtccgacgccccgttacggggcctcggtcccttagggtaccgaaacggtaccttaaccgttacccgtacgttaacctccttaacgttccgtagggacggtccggggaccgtacgggacgaaacgggccgactaagtgncg

SEQ ID NO: 53647 - DNA, 731 bp, Homo sapiens
  misc_feature: GYAE6OF01CC524.29.78.H01.1.454.CMB.1.raw
  modified_base (728)..(728): a, c, t, g, unknown or other
  misc_feature (728)..(728): n is a, c, g, or t
tcagatagagtactcacgaccggtgctcgatttagtgtgagtagtttgggtttgggggcgcctgggtacggccgggggggtcgctgagactctcctgtgcggcctctggatttaagttttaggagtcatgccatgaactgggtccgccaggctccagggaaggggctggagtgggtctcggctattagtggcagtggtggcgctatatattatgcagacgccctagaagggccggttcacctatttccagagacaattcgaagaacacgctgtatctgacaaatggagacgcctagagacgtcgacgacgacggtccgtacttattagttggtagtttaaaggcgagacgtagggaaacggtaaccgggggaccccggggacccgtacgttacggaaccgtaccggtacgggggccgaacggggggacgtacggttcggtccgacccggttcctccctacgaccgtcccctacccgaacccggacgggccccgtaacgttcccggttcccttcccccgtcggcccctaccccgttccctacccgaacgaccgacccgtacccgtcggtcggggaccacgacgtccgacggtccccgtagggtcccgtcggtacccgttgggtaccgaaaccggtacccttaccgttacctaaccgttaccgttaccttacgtccggtaggtaacggtcggggaccgtacgggtaccgacgggtaccgagtagtacggnacg

SEQ ID NO: 53648 - DNA, 622 bp, Homo sapiens
  misc_feature: GYAE6OF01DYTCP.29.78.H01.1.454.CMB.1.raw
  modified_base (487)..(487): a, c, t, g, unknown or other
  misc_feature (487)..(487): n is a, c, g, or t
  modified_base (620)..(620): a, c, t, g, unknown or other
  misc_feature (620)..(620): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgacaaatggagagcctgagactcgacgacacggccgtctattattgtgttaaaggcgagctaggaaatacggggaccggggcccgacttgacccacgtggggccgaggggacgctggtccaccgtcctcctcacgccctccaaccgaacgggccccacgttccggttcctttcccccccgtcgggtccctacccctccctacccaaacggacnccgaaccctcggtcgggggcccaacgagccgacgtccccgtgggcctcggcccgtggtccgtaacggaccttaccgttccaacgttacctcttactcctggaggccgggcgtacgggcgaacggcgacagtgntg

SEQ ID NO: 53649 - DNA, 594 bp, Homo sapiens
  misc_feature: GYAE6OF01ET2EX.29.78.H01.1.454.CMB.1.raw
  modified_base (384)..(384): a, c, t, g, unknown or other
  misc_feature (384)..(384): n is a, c, g, or t
  modified_base (588)..(588): a, c, t, g, unknown or other
  misc_feature (588)..(588): n is a, c, g, or t
  modified_base (591)..(591): a, c, t, g, unknown or other
  misc_feature (591)..(591): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccgatttccagagacaattcgaagaacacgctgtatctgcaaatggagagcctgagactcgacgacacggccgtctattactgtagttaaaggcgagactggaatacgggaccgggccgacgttgaccacgtggggccagggggacncgtggtccaccgtctcctcacgcctcaccgaacgggcccagtccggtaccttcccccgtcgggcctacccgtcctaccgaacgacgtccaccgtcgtcggggcctacgacgcgacgcccgtcgggccgtcgccgtggtaccgaacgtacctacctaccacgtacctccgtagtcgtgacggcgggtctggactacggcgacganagnacg

SEQ ID NO: 53650 - DNA, 651 bp, Homo sapiens
  misc_feature: GYAE6OF01AQXMH.29.78.H01.1.454.CMB.1.raw
tcagatagagtactcacgaccggtgctcgatttagtgtgagtagtttgggtttggggtctgagagaggagtccacccctgggatcttcaggtgttttcatttggtgatcaggacggaacagagagaactcaccatggagtttgggctgagctggctttttcttgtggctattttaaaaggtgtccagtgtgacgtgcagttggtggagtcgtgggggcgccgtggggtaccgggccgggggggtcgcgtgagactctcctgtcgcggcctcgtggattaagttttaggagtcatgccatgaacgtcgggtcccgccacggcctaccgaggggaacggggcgtgggaggtgggtcgtcggcttagttaggtggcaggtgggtggcgtctatattattatgcgagaccgtcccgtaggacggggtcccgttcacctactttccgaagacaactaagtacgaaagaacacgctagtactctgaacaaagtggagacgcctaggaacacgtcggaaccgacgaccggtccttactatttagttggttaagtaaacgggcgtagtaccggtaggaaacggtacccgggggacccgggacccgtacgttccggaccgacgggtcgggggacccgaggggccgtcgtcgggtaccccg

SEQ ID NO: 53651 - DNA, 766 bp, Homo sapiens
  misc_feature: GYAE6OF01BNGTH.29.78.H01.1.454.CMB.1.raw
  modified_base (764)..(764): a, c, t, g, unknown or other
  misc_feature (764)..(764): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaacgtgggtccgccaggctccgagggaaggggctggagtgggtctcggctattagtggcaggtggtggcgctatatattatgcagaccgccctggaacgggtccgttcacctatttccagagacaattcgaaagaacacgctgtatctgacaaagtggaagacgcctgagactacggaccgaacgccggaccgtacttaattagttggtaagttaaaggccggagtcgtaggaaacggtaccgggggaccgggaccccgtaacgttcgaacccgtacggtccgggggaccgaacgggggaccgtcggttacggtccgtacccgtccgtacccgtccgaccgtaccccctacccgaaccggtaacgggccccctaacgttcccggttaccccttcccccccgtaggacccccttaccccgtaccccgtaaaccaaacgggacccgtaccgtaccccgttaccggggtaccgggggaccaacccgacgggacccaccgggtccccgtacgggtaccgtaccgggtcccgttagggacccgtaacgggtaccttaccccttacgtaactccgttacctaggtccgtaggaccggtcgggaccgttacgggaacgacgggtacgacgagtagtncg

SEQ ID NO: 53652 - DNA, 613 bp, Homo sapiens
  misc_feature: GYAE6OF01D1ZYS.29.78.H01.1.454.CMB.1.raw
  modified_base (607)..(607): a, c, t, g, unknown or other
  misc_feature (607)..(607): n is a, c, g, or t
  modified_base (611)..(611): a, c, t, g, unknown or other
  misc_feature (611)..(611): n is a, c, g, or t
  modified_base (613)..(613): a, c, t, g, unknown or other
  misc_feature (613)..(613): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaagggctggagtgggtctcggctattagtggcagtggtggcgctatatattatgcagacgccctgaagggccggttcaccatttccagagacaattcgaagaacacgctgtatctgacaaagtggagagcctgagactcgacgacacggccgtctattattgtgttaaaggcgagctggaactacggggaccgggcccgacttcgaccacgtcggggccagggggaccgcgtggtccacccggtctccctcacggccctaccgaaccgaacggggcccacgtccggttcccgttccccccgtcggccctacccctccctacccaacgacgccacccgtcgtcggggccacgacgccacgcccgtagggccgtcgcccgtggtaccaacggtaccttaccgttccacgttcctacttacgtcgtggacggccgggcgtggacgacggcgnatgngn

SEQ ID NO: 53653 - DNA, 661 bp, Homo sapiens
  misc_feature: GYAE6OF01ECWGT.29.78.H01.1.454.CMB.1.raw
  modified_base (82)..(82): a, c, t, g, unknown or other
  misc_feature (82)..(82): n is a, c, g, or t
  modified_base (184)..(184): a, c, t, g, unknown or other
  misc_feature (184)..(184): n is a, c, g, or t
  modified_base (194)..(194): a, c, t, g, unknown or other
  misc_feature (194)..(194): n is a, c, g, or t
  modified_base (198)..(198): a, c, t, g, unknown or other
  misc_feature (198)..(198): n is a, c, g, or t
  modified_base (207)..(207): a, c, t, g, unknown or other
  misc_feature (207)..(207): n is a, c, g, or t
  modified_base (270)..(270): a, c, t, g, unknown or other
  misc_feature (270)..(270): n is a, c, g, or t
  modified_base (297)..(297): a, c, t, g, unknown or other
  misc_feature (297)..(297): n is a, c, g, or t
  modified_base (536)..(536): a, c, t, g, unknown or other
  misc_feature (536)..(536): n is a, c, g, or t
  modified_base (658)..(658): a, c, t, g, unknown or other
  misc_feature (658)..(658): n is a, c, g, or t
  modified_base (660)..(660): a, c, t, g, unknown or other
  misc_feature (660)..(660): n is a, c, g, or t
tcagatagagtactcacgaccggtgctcgatttagtgtgagtagtttgggtttggggcgcctgggtacggccgggggggtcnctgagactctcctgtgcggcctctggatttaagtttaggagtcatgccatgaactgggtccgcagctccgagggaagggctggagtggtctcggctattagnggcaggtggngcgntatatatangcagaccgccgtaggacgggtccgttcaacttattccagacgaactaagttaccgaaagaacncgtctgtatctagacgtaaaagtgganacgcctaggacacctcggaacgacaccgggtccttattagtttagttagtaaggttaaaggcgagcgttagggaaaccggttaccggggacccggggtacctagttacgaaccgtcggtcggggaccgtaagggggctcgtcggtaccaccggtctcctacgacgtcccctacgaccggtaacgtcctacgttcccggttccctccccggtacgaccctaccctccgtaaccgacgacncccgtacgtccggacgggcacgacgccgacgcccgtggcctacgccgtacgacgtaacgacctacgtactatacctcgttactcgtggacggtcggtacgtcggaacgtcgggacagactgngng

SEQ ID NO: 53654 - DNA, 567 bp, Homo sapiens
  misc_feature: GYAE6OF01BGU6R.29.78.H01.1.454.CMB.1.raw
  modified_base (300)..(300): a, c, t, g, unknown or other
  misc_feature (300)..(300): n is a, c, g, or t
  modified_base (560)..(560): a, c, t, g, unknown or other
  misc_feature (560)..(560): n is a, c, g, or t
tcagatagagtactcacgaccggtgctcgatttagtgtgagtagtttgggtttggtggtctctctcccagcctgtgctgactcaatcgccctctgcctctgccctccctggggaggctcggtcaaggtcacctgtactctgagcagtggacacagcagctacgccatcgcttggcatcagcagaggccagacacgggccctgttacttgatgacagtcaacaatgatggcagtcacgagcgaaggggacggatccctgatcgcttctcagtctccagctcgtgggcctgagcgctacctnacaactccgtccggcctcagtctaggagagtggagctgacttatactgtacacggacgtgggcagtcggctacgtcgtacggtcgttacgggaccgggactaacggctaccggtcgtcggcgtaccgaccgaacggacccaaccctacgtcgtaccaccgttcctcccggttaccccaaccctcccgttacacgttaccgtaccttactaccgtacggtacggccgggtccgtggaacccgaagggtcccgtactaagcncgtcacg

SEQ ID NO: 53655 - DNA, 764 bp, Homo sapiens
  misc_feature: GYAE6OF01D77HS.29.78.H01.1.454.CMB.1.raw
  modified_base (759)..(759): a, c, t, g, unknown or other
  misc_feature (759)..(759): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaagggctggagtgggtctcggctattagtggcagtggtggcgctatatattatgcagacgccctgaagggccgttcacctatttccagagacaattcgaagaacacgctgtatctgacaaagtggagacgcctgacgactcgacgacacggtccgtctattagttgtagttaaaggcgagcgtaggaaacgtaccggggacccggggacccgtacgttcggaccctacggtcggggggacccaagggggtaccgcgttgggtaccctaacccggttccttcccgtacgaacggtcccctacccgaaacccgaaaccggggtcccctaacgttccccgggttcccctttaccccccgtccgggtacccctaaccccgttcccctacccgtaaacggtaccgacccgtaacccgtccggtacgggggtacccaccggtacgtacccgaaccggtccccgttcggggacccgtccgggtcccgtacgggttaaccgtaaacggtacccgttaaccgttacccgtacggttaaccttacccgttacgttccgtaggtacggtccgggtccgtacgggtaccgaacgggtccgaccgtagtacggngtacg

SEQ ID NO: 53656 - DNA, 728 bp, Homo sapiens
  misc_feature: GYAE6OF01B73UY.29.78.H01.1.454.CMB.1.raw
  modified_base (144)..(144): a, c, t, g, unknown or other
  misc_feature (144)..(144): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccnccaggctccagggaagggctggagtgggtctcggctattagtggcagtggtggcgctatatattatgcagacgccctgaagggccggttcaccatttccagagacaattcgaagaacacgctgtatctgacaaatggagagcctgagacctcgacgacacggccgtactattattgtagttaaagggctagctaggaaagtaccggggacccgggaccccgtaacgttcggacccaacggtcggggggacccacgggggcaccgttggtaccgaccggttcctccctacgacgcccctacccgaccgaaccgggtccctaacgttccggtaccccgttcccccgcgggcccctaaccccgtccctaacccgaaacgaccgtaccctaaccccgttccgggtacggggacccaacggacgtacccaaccggccccggtacgggcgttacccggtcccgtcgggttaaccgaaacgggttacccttaacccgttacccgtaacggttaacccttaagttaaccgtccgtacggaggtccccggggtcgttacgggacccgtaacgggacccgagtaagtacggcag

SEQ ID NO: 53657 - DNA, 602 bp, Homo sapiens
  misc_feature: GYAE6OF01CGRIN.29.78.H01.1.454.CMB.1.raw
  modified_base (600)..(601): a, c, t, g, unknown or other
  misc_feature (600)..(601): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgaccacggccgtctattattgtagttaaggcgagctggaactacggggaccggggcccgacgttgaccacgtgggggccgagggggaccgcgtgggtccaccgtctcctcgacgccctccaccgaacgggcccagtccggtccttcccccgcgtcccaccctccctccaacgaccgcctacctcgtcggggccacgacgccgacgcccgtcgggctcgccgtggtcgaacggtactaaccgttcctacgtacctacttactcgtggacggtcccgggcgtcggacaacgggcgacagtagnng

SEQ ID NO: 53658 - DNA, 773 bp, Homo sapiens
  misc_feature: GYAE6OF01BPPBN.29.78.H01.1.454.CMB.1.raw
tcagatagagtactcacgaccggtgctcgatttagtgtgagtagtttgggtttggggtccgagccatggtgcagactccccagagctctcctcctcctccactgcacagggtctctctcccagcctgtgctgactcaatcgccctctgcctctcgccctccgtgggagctcggtcaaggtcacctgtactctgagcagtggacacagcagctacgccatccgtcttaggccatcagcagacgccaaggacacgggtcccctgttacttgatcgacacgtcaaacatgatcggcagtcacgaggacggtaagggggcgactccgtggactcgcttctacacgtcctccgagtccttcggtcggggccctaaggcgtccgtccttaaacccttcaccgtaacgttccgtcccggtacccttccgtaggttccgtagggaacgggtacgtacggtacgggttaccgttacggttaaacctttaccttttaccggacgtacccgtaaccgggttaacccgggtcgggggtaccctacggtttacggggtaccttaacggttttccggtacggggtttaccccggtttaacccggggggtaaccccgggggaacccgttaaaccgggggttacccccggttaacccggggttacccgggttcccgggtaaccggtacccgggaacccccgaaacccggggtaacccccctaaaccccccggtacgttaccggttaaacccttcccccgtttccggttccccgtttaaccccccccggg

SEQ ID NO: 53659 - DNA, 617 bp, Homo sapiens
  misc_feature: GYAE6OF01EZTSB.29.78.H01.1.454.CMB.1.raw
  modified_base (414)..(414): a, c, t, g, unknown or other
  misc_feature (414)..(414): n is a, c, g, or t
  modified_base (614)..(614): a, c, t, g, unknown or other
  misc_feature (614)..(614): n is a, c, g, or t
  modified_base (616)..(616): a, c, t, g, unknown or other
  misc_feature (616)..(616): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccgttcaccatttccagagacaattcgaagaacacgctgtatctgacaaaagtggagagcctagagactcgacgacgaccggccgtctatttatgtagttaaaggcgagctaggaacgtacggggaccgggccccgagttcggaccacgtcggggccgaggggacgcgtggtcaccgtctccctnacgccctccaccgaacggcccatccgtcctcccccgtcggccctaccctccctaccaacgacgccctacctcggtcgggacacgacgccgacggcccgtcgggcctcggccgtacggtacgaacggtacctaccgttaccacgttcctattaccgtcgtagggacggtcgggcgtcgggacgaacgggcgagtacgtcgngng

SEQ ID NO: 53660 - DNA, 743 bp, Homo sapiens
  misc_feature: GYAE6OF01DY2Q8.29.78.H01.1.454.CMB.1.raw
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgacaaatggagagcctgagactcgacgacacggccgtctattattgtagttaaaggcgagctggaagtacgggacccgggcccgacgttcgacctacgtcggggccgagggggacgcgtcgggtccaccgtctccgtcacgccctacccgaaccgaacgggccctaacgtccggtccctttccccccgtcggcccctaccccgtccctacccgaacggaccgcctacccgtcgtcgggggacccaacgtaacggccgaaccggtccccggtacgggtcccgttaccgggtcccgttcggggtacccgtaaacgggtacccgttaacccgtttacccgtaaccggttaaacccgtttaccgttaacgtttcccggttaagggtaacccggggtcccgggggttaaccggttaccgggggaacccggtaaaacggggtccccggaaccgtttaaacggttacggaagtccg

SEQ ID NO: 53661 - DNA, 628 bp, Homo sapiens
  misc_feature: GYAE6OF01EM2KD.29.78.H01.1.454.CMB.1.raw
tcagatagagtactcacgaccggtgctcgatttagtgtgagtagtttggggtttgggggcgcctgggtacggccgggggggtcgctgagactctcctgtgcggcctctggattaagttttaggagtcatgccatgaactgggtccgccaggctccaggggaaggggctggagtgggtctcggctattagtggcagtggtggcgctatatattatgcagacgccctgaagggccgttcaccatttccagagacaattcgaagaacacgctgtatctgcaaatggagagcctgagactcgacacacggccgtctattatgtgttaaaggcgagctggaatacggggacccgggccgacttcggaccacgtggggccagggggacgcgtggtccaccgtctcctcgagccctccacccgtaagggcccacgtcgtccttccccctcggaccacccctcctaccaacgacgccaacctcgtcggggccacgacgcgacgcccgtacgggcctcggtaccgtcgggtacgaacggtaccttaccgttacccgaacgttacctaccttacgttccgttaggacgggccgggtcggtcgggacccgtaacgggaccggacgtacgtaagcgtacg

SEQ ID NO: 53662 - DNA, 615 bp, Homo sapiens
  misc_feature: GYAE6OF01BAI52.29.78.H01.1.454.CMB.1.raw
  modified_base (280)..(280): a, c, t, g, unknown or other
  misc_feature (280)..(280): n is a, c, g, or t
  modified_base (611)..(611): a, c, t, g, unknown or other
  misc_feature (611)..(611): n is a, c, g, or t
tcagatagagtactcacgaccggtgctcgatttagtgtgagtagtttgggtttggtggtctctctcccagccttgtgctgactccaagtccgccctctcgcctctgcctccctgggaggctcggtcaaggtcacctgtacctctgagcagtggacacagcagctacgccatcgcttggcatcagcgagagggccaggacaccgggccctcgttacttgatgacagtcaacaatgatggcagtcacagcgaaggggggacggatcccgtgatccgctttcncagtctccagctcgtgggcctgacgccgctacctcactactccgtccggcctccgagtctgaggtatggaggtctgtaacttattacgtgtacagaccggtgggaccacgtggacctagttcgagggttcctcggggaccgggtacaaggtccacggtcgtccggtcaccgcccgaacggccccaacccgtagtcgtaccctaccgtttccgttacccgttacccccacccttccctactaaccggttcccttacttaccggttccgtcgggtaccgggtccggggtaccttacggggacccgtaaaccggggtccgaaccgtagtacggntggc

SEQ ID NO: 53663 - DNA, 818 bp, Homo sapiens
  misc_feature: GYAE6OF01BBG6I.29.78.H01.1.454.CMB.1.raw
tcagatagagtactcacgaccggtgctcgatttagtgtgagtagtttgggtttggggcgcctgggtacggccggggggtcgctgagactcgtcctggtgcggcctctggattaagtttaggagtcatgccatgaactgggtccgccaggctccgagggaaggggctggagtgggtctcggctattagtggcagtggtggcgctatatattatgcagacgccctgaagggccgttcaccagtttccagagactaattcgaagaacacgctgtatctgacaaatggagagcctgagactcgacgacgacggccgtacgtattacgttaggttacggtttaaagggccgagtaccgtagggaaaccggtacgggggtaaccccgggggcccgtacgttacgaacccgacggttacgggggcccgtaagggggaccgcgttacgggtccaacccggttccgtcccgtaccgaccggccccttacccgaaccggtaaaccggggcccctaaggttcccgggttaccctttcccccccggtagggtaccccctaacccccgttcccgtaacccgaaacggaccggtacccgtaaccccgttccgggttacggggggacccaacccggtaacggccccgtaaaccgggtcccccggttacggggccgtttacccgggtacccgggtttcggtaacccggtaaacgggttacccgttaacccgtttcccgtaacgggttaccttaccgttaacgtccggttagggacggtcccgggggtacctacggggtacccaaagggggtccctaagtaggttacccggatcg

SEQ ID NO: 53664 - DNA, 643 bp, Homo sapiens
  misc_feature: GYAE6OF01CPJ9F.29.78.H01.1.454.CMB.1.raw
  modified_base (287)..(287): a, c, t, g, unknown or other
  misc_feature (287)..(287): n is a, c, g, or t
  modified_base (383)..(383): a, c, t, g, unknown or other
  misc_feature (383)..(383): n is a, c, g, or t
  modified_base (473)..(473): a, c, t, g, unknown or other
  misc_feature (473)..(473): n is a, c, g, or t
tcagatagagtactcacgaccggtgctcgatttagtgtgagtagtttgggtttggggtccgagccatggtgcagactcccagagctctcctcctcctccactgcacagggtctctctcccagcctgtgctgactcaatccgccctctgcctctcgccctcccgtgggaggctcggtcaaggtcacctgtacctctgacgcaggtggaccacagacaggcctacgcctagtcgcttggcatcagcagacgccagacgacggcctgttactgatcgactacgtacaaanatggatcggacagtacacgacggtacggaagggggaccgactcccgagactcgtcttcgtacgtacgtcctacagccgtcgtcgggcttaggaccnccgtaccttaccgtacactaacgtccgtcccggtacctccgacggtcgtacggaggtacgtggaccgtcgtacgttaacttacgtttacnggtaaccgacggtaccgggttcgggacctacggtcgacgtacgttcggacgggttcccgtacggggaaccggtacgtaacggtcccgtacgggtccgtacggtaccacggtaacccgaacccgtaccccgaccctacgtacgaccgtacccttccgtcccgttacccccg

SEQ ID NO: 53665 - DNA, 754 bp, Homo sapiens
  misc_feature: GYAE6OF01DFXQ3.29.78.H01.1.454.CMB.1.raw
  modified_base (181)..(181): a, c, t, g, unknown or other
  misc_feature (181)..(181): n is a, c, g, or t
  modified_base (243)..(243): a, c, t, g, unknown or other
  misc_feature (243)..(243): n is a, c, g, or t
  modified_base (271)..(271): a, c, t, g, unknown or other
  misc_feature (271)..(271): n is a, c, g, or t
  modified_base (343)..(343): a, c, t, g, unknown or other
  misc_feature (343)..(343): n is a, c, g, or t
  modified_base (350)..(350): a, c, t, g, unknown or other
  misc_feature (350)..(350): n is a, c, g, or t
  modified_base (352)..(353): a, c, t, g, unknown or other
  misc_feature (352)..(353): n is a, c, g, or t
  modified_base (373)..(373): a, c, t, g, unknown or other
  misc_feature (373)..(373): n is a, c, g, or t
tcagatagagtactcacgaccggtgctcgatttagtgtgagtagtttgggtttggggtctgagagaggattccacccctgggatcttcaggtgttttcatttggtgatcaggacggaacagagagaactcaccatggagtttgggctgagcgtgtgtttctaggtggctaattttaaaggntcagtgtgacgtgctagttggtgagtccgtggggcgtccgtaggggtcggccgggggggtcncgtgagactctccgtgtgccggccttgnggtatttaaggtttaggatcatcgccatgaacctggccgcaggctcgaggggaaggctggagtggctcggtntagtggngnnggtgcgctatagtatagtangacacgtccgaccgagggtaaccgggtcccgtacaaccgttacgttaccgaaggtaacgtaaccgttaaacgtaccggaaaacgtaacccgtaacgtacgttaacggttaacttacgttacggaacgttaaagggtacgggaacggacgtaccgtaaggaaccgttaacccgaaccgggaacccggtaaccggtaacccgggttacccgtttaatttaacggtttacgtttaaggttaacgggttaaacgggtcgtacgacccgggttaagggtaaaaccggggtaccccgggggtaccccggttaccggtaaccgtaccggaaccggttaccggggtcgggggaacccgtcccgggggtaacgtccggttcgggtacccc

SEQ ID NO: 53666 - DNA, 744 bp, Homo sapiens
  misc_feature: GYAE6OF01BHXGW.29.78.H01.1.454.CMB.1.raw
  modified_base (541)..(541): a, c, t, g, unknown or other
  misc_feature (541)..(541): n is a, c, g, or t
  modified_base (610)..(610): a, c, t, g, unknown or other
  misc_feature (610)..(610): n is a, c, g, or t
  modified_base (737)..(737): a, c, t, g, unknown or other
  misc_feature (737)..(737): n is a, c, g, or t
  modified_base (741)..(741): a, c, t, g, unknown or other
  misc_feature (741)..(741): n is a, c, g, or t
tcagatagagtactcacgaccggtgctcgatttagtgtgagtagtttgggtttgggggcgcctgggtacggccgggggggtcgctgagactctcctgtgcggcctctggatttaagttttaggagtcatgccatgaactgggtccgcgaggctccgaggggaagggctggagtgggtctcggctagttagtggcaggtggtggcgctatatattagtgacagacgtcccgtggaacgggtccgttacacctatttccagtagactaagttcgaaacgaacacggtctagtatcctagacaaagtggagagcctagacgactcggaacgacaccggtccgtacttatttacgtgtaggttaaacggcgagtcgttagggaaacgttaccgggggaccccgggtacctacgttaccggaccgtaacgggtccggggaccggtaaacgggggccgtacgttacgggtacccgtacccgttacgtccctaacgccgtacccgtaccaaccggaaccggccctacggtccgttccccttaccccgnggtacccctaccctacctaccgaagtaccgcctaccggtccggtagggacctaacgacccgacggtccncccggtaggcgtccgggtaccgttccgggtaacaccgggtaacctttacccggtcctaacgttacctacttacggtacggtggaccggtccgggacctagggaacccgacggggcctaacgtaacgngtanacg

SEQ ID NO: 53667 - DNA, 843 bp, Homo sapiens
  misc_feature: GYAE6OF01B39Y1.29.78.H01.1.454.CMB.1.raw
tcagatagagtactcacgaccggtgctcgatttagtgtgagtagtttggggtttggggtccgagccatggtgcagactccccagagctctcctcctcctccactgcacagggtctctctcccagcctgtgctgactcaatccgccctctcgcctctcgccctcccgtggggaggctcggtacaaggtccaccttgtactcgtgagcaggtggacacagcagctacgccatcgcttggcatcagcaggacgccagaccgccgggtcccttcgttacttgatgacagtacaatatgagtggcacgtcacgaggacggaacgggggacggtacctccgtagtacttccggtcctttcgtcgtaccgttccctacccgtacggtcccgtttccgggtcgggtacccgttacggggaaccgtccccgtttaccccgttaaaccccgtacctaaaacccgttaaccgtttcccccggtaccccccgggttaccccctttaccgggttaaaccgggtttcccggtaacggggaaacgggtttaggtaccgggtaaccgggttcccgtttaaacgtaaaccgttttaaccgtttacggtccggtttaaccgggaacccgggtttcccggggtacgggggtacctaaccgggttcgggactttacccggttacgggttaccggggttaccccgggttaacccggggggacccgggtaaaccttaccggggttaccccgtacggggtttacccggtccgggtaacccgacccggtaaacccccggaacccgaccccccgttaaccccgtgtttacccgccctttaccccgttcgttcccccgggttaaccccc

SEQ ID NO: 53668 - DNA, 586 bp, Homo sapiens
  misc_feature: GYAE6OF01BI2NZ.29.78.H01.1.454.CMB.1.raw
  modified_base (285)..(285): a, c, t, g, unknown or other
  misc_feature (285)..(285): n is a, c, g, or t
  modified_base (579)..(579): a, c, t, g, unknown or other
  misc_feature (579)..(579): n is a, c, g, or t
  modified_base (584)..(584): a, c, t, g, unknown or other
  misc_feature (584)..(584): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaaagaacacgctgtatctgcaaatgganagcctgagactcgacgacacggccgtctattatgtagttaaaggcgagactggaaatacggggaccggggcccgacgttcgaccacgtggggccagggggacgctggtcaccgtctcctcagcctccgacacggcccagtccggtcttcccccgtggccctaccctcctaccaacgacgcctacccgtcgtggggccaacgcgcacgcccgtagggcctcgcccgtcggtcaacgggtacctacttaccgactacctacttactcgtgacggcggcgtcggactaacgggcganatagncg

SEQ ID NO: 53669 - DNA, 626 bp, Homo sapiens
  misc_feature: GYAE6OF01AYXPB.29.78.H01.1.454.CMB.1.raw
  modified_base (362)..(362): a, c, t, g, unknown or other
  misc_feature (362)..(362): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattatgtagttaaaggcgagctggaatacggggaccgggccgactgaccncgtggggccagggggacgcgtggtccaccgtctccctcgacgcctccaccgaacgggcccacgtccggtcctttccccccgtcgggccccaccccttccctacccaacggaccgccacccgtccgtcgggggccaccgacggccacggcccctcggggcctggtcccgtgggtaccaacgggtaccttaccgtaccacggttacctcctacgtcctggacggtccgggcgtacgggaccgaaacgggtccgacacgtaggctag

SEQ ID NO: 53670 - DNA, 696 bp, Homo sapiens
  misc_feature: GYAE6OF01B9FCB.29.78.H01.1.454.CMB.1.raw
  modified_base (176)..(176): a, c, t, g, unknown or other
  misc_feature (176)..(176): n is a, c, g, or t
  modified_base (201)..(201): a, c, t, g, unknown or other
  misc_feature (201)..(201): n is a, c, g, or t
  modified_base (208)..(208): a, c, t, g, unknown or other
  misc_feature (208)..(208): n is a, c, g, or t
  modified_base (230)..(230): a, c, t, g, unknown or other
  misc_feature (230)..(230): n is a, c, g, or t
  modified_base (252)..(252): a, c, t, g, unknown or other
  misc_feature (252)..(252): n is a, c, g, or t
  modified_base (266)..(266): a, c, t, g, unknown or other
  misc_feature (266)..(266): n is a, c, g, or t
  modified_base (269)..(269): a, c, t, g, unknown or other
  misc_feature (269)..(269): n is a, c, g, or t
  modified_base (274)..(274): a, c, t, g, unknown or other
  misc_feature (274)..(274): n is a, c, g, or t
  modified_base (309)..(309): a, c, t, g, unknown or other
  misc_feature (309)..(309): n is a, c, g, or t
  modified_base (339)..(339): a, c, t, g, unknown or other
  misc_feature (339)..(339): n is a, c, g, or t
  modified_base (350)..(350): a, c, t, g, unknown or other
  misc_feature (350)..(350): n is a, c, g, or t
  modified_base (365)..(365): a, c, t, g, unknown or other
  misc_feature (365)..(365): n is a, c, g, or t
tcagatagagtactcacgaccggtgctcgatttagtgtgagtagtttgggtttggggggagagaggagtccacccctgggatcttcaggtgttttcatttggtgatcaggacggaacagagagaactcaccatggagtttgggctgagcggtgtgttctaggcgctatttaaaggntcagtgtgagtgcagttggtgcgtntggggcnccgtgggtcggccggggggtcngtgacgtctctcgtgcgcgctntagtagttagttgntcngcgcngtgtacgtcggccgcgcggcgtacggagggtaggngtggtcggtcggtcgtagtacttagtgtgngtggtcggcgngtattatatagtcgngacgacgccgtcgtaggaccggtctaccacgtactacgaaggaacgtaactaacgtacggaaacgaaccgtcgtactagtacctacggtaacaacgtaaacggtcggaacgttacgtcggacgtacggtaacccggtacgaacccgaccggttacccgtacgtttaacgttaagtttacggttaggtaaaccggttaacgggacggttacgtacgggtaacgggtaacccggggtaacccggggtacccggttaccggtaccgtaccggacccgggtaccgggaccggggtaacggtacgggtccgtacccggttcgccccgtcgtccccg

SEQ ID NO: 53671 - DNA, 617 bp, Homo sapiens
  misc_feature: GYAE6OF01ANK9W.29.78.H01.1.454.CMB.1.raw
  modified_base (505)..(505): a, c, t, g, unknown or other
  misc_feature (505)..(505): n is a, c, g, or t
  modified_base (613)..(613): a, c, t, g, unknown or other
  misc_feature (613)..(613): n is a, c, g, or t
  modified_base (616)..(617): a, c, t, g, unknown or other
  misc_feature (616)..(617): n is a, c, g, or t
tcagatagagtactcacgaccggtgctcgatttagtgtgagtagtttgggtttggtggtctctctcccagcctgtgctgactcaatcgccctctgcctctgcctccctgggaggctcggtcaaggtcacctgtactctgagcagtggacacagcagctacgccatcgcttggcatcagcagaggccagacacgggccctcgttacttgatgacagtcaaacaatgatggcagtcacgaggacggaaggggggacggactcccgtgactcgtcttctcacgtcctccagtcctcgtcgggcctggacgccgtacctacctcacaacgtcccgtcccggcctccgtagtctggaggtatggacggtctacgtacttacttacgtgtaccgacggtccggtgggacctacgtgctagttcgacggttccggtaccgggacccgggtaactacggtcccgtaccggtcgtcgggtaccaccggaccccgtaacggccccctaacccgtntaccgtacctccgtcccttcccgtaccccctaccctccgtaaccacggttacctctaccgtcgtcggtaccgggccggtcgtacgggaccgacggtaccgacaagtcngtnn

SEQ ID NO: 53672 - DNA, 582 bp, Homo sapiens
  misc_feature: GYAE6OF01CILW0.29.78.H01.1.454.CMB.1.raw
  modified_base (500)..(500): a, c, t, g, unknown or other
  misc_feature (500)..(500): n is a, c, g, or t
  modified_base (546)..(546): a, c, t, g, unknown or other
  misc_feature (546)..(546): n is a, c, g, or t
  modified_base (553)..(553): a, c, t, g, unknown or other
  misc_feature (553)..(553): n is a, c, g, or t
  modified_base (581)..(582): a, c, t, g, unknown or other
  misc_feature (581)..(582): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctaggaactacggggacccggggcccgacgttcggaccacgtcggggccagggggaccgcgtggtccaccggtcctcctcacgccctcccaccgaacgggcccacgtccggtcccttcccccgtcggcccaccctccctacccaacgacgccacctcgtcggggcacngcgacgccgtcggcctcgcctggtcaacggtcctacttccagtctntacgtcnggacggcggctggacgacggcgacatgnn

SEQ ID NO: 53673 - DNA, 647 bp, Homo sapiens
  misc_feature: GYAE6OF01C3FFU.29.78.H01.1.454.CMB.1.raw
  modified_base (630)..(630): a, c, t, g, unknown or other
  misc_feature (630)..(630): n is a, c, g, or t
tcagatagagtactcacgaccggtgctcgatttagtgtgagtagtttgggtttggggtccgagccatggtgcagactcccagagctctcctcctcctccactgcacagggtctctctcccagcctgtgctgactcaatccgccctctcgcctctcgccctcccgtgggaggcgtcggtacaaggtccacctgtactctgagcagtggacacagcagctacgccagtcgcgtggcatcagacgaggacggccaacgaccgaccgggcccttacgttacttggatcgacacgtacaaacaagtgaagtcggactacgtcaacgaggacggaaacgggggacggactccgtcgatcgtcttctacgtacgttcctccgacgtcgtacggtcggtaccgtgacgccgtacctacctacaacctaactcccgtccgtcccttacgagttcgtaggacggtaagtccggaaggtccgttaagtaacttagtttaccgcggtacgaacgtccggtacgggacctaacgtcgggacttacggttaccggagggtttcccggtaacggggacccggaactaaccggcgtaaccggtcggtcgacacggaccccgtaccggaccctacccgagttcaccncttccgtccggtccccc

SEQ ID NO: 53674 - DNA, 594 bp, Homo sapiens
  misc_feature: GYAE6OF01EDD9B.29.78.H01.1.454.CMB.1.raw
  modified_base (245)..(245): a, c, t, g, unknown or other
  misc_feature (245)..(245): n is a, c, g, or t
  modified_base (307)..(307): a, c, t, g, unknown or other
  misc_feature (307)..(307): n is a, c, g, or t
tcagatagagtactcacgaccggtgctcgatttagtgtgagtagtttgggtttggggggagagaggagtccacccctgggatcttcaggtgttttcatttggtgatcaggacggaacagagagaactcaccatggagtttgggctgagctggtctttttcttgtggcttattttaaaaggtgtccagtgtgacgtgcagttggtggagtcgtgggggcgccgtggggtacgggccgggggggtcnctgagactctcctgtgcggcctctggattaagttttaggagtcatgccatgaactgggtccnccaggctccgaggggaaggggctggagtgggtctcggctattaggtggcagtggtggcgctatatattatgcagacgccttaagggccggttcacctatttccagagactaattacgaagaacacgctagtatctgacaaatggagagcctgacgactcgacgacgacggtccgtactattattgtaggttaaaggcgagcgtaggaacgtaccggggacccgggcccgtacgtcggaccgacggtcggggaccgagggggaccgcgtagggtcctccggtctcccg

SEQ ID NO: 53675 - DNA, 844 bp, Homo sapiens
  misc_feature: GYAE6OF01DONN0.29.78.H01.1.454.CMB.1.raw
  modified_base (841)..(841): a, c, t, g, unknown or other
  misc_feature (841)..(841): n is a, c, g, or t
  modified_base (843)..(844): a, c, t, g, unknown or other
  misc_feature (843)..(844): n is a, c, g, or t
tcagatagagtactcacgaccggtgctcgatttagtgtgagtagtttgggtttgggggcgcccgtgggtacgggccgggggggtcgctgagactctcctgtgcggcctctggtatttaaagttttaggagtcatcgccatgaacgtcgggtcccgccgaggcctaccggaggggaagggcgtgggaggttgggtctcggacttagttaggtggcgtggtggtggctctatattattagtgcgagaccgccctaggaacgggtccgttaccaacctactttaccgaagaacgaactaaacgtttacgaaaacgaaacacggtacttagtaacttccgtagaaacctaaaaggttacgggaagaacgtaccgtagaacgtacctacggaaccgacgaccgggtcccttattaacgtttagttaggttaaggttaaacggcgtaggtacgtagggaaacggtaaccgggggccccgggtacccgtaagttccggaacctaaccggggtcgggaccgggtaacgggggaccgtcggttcggtacccgtaacccggttctacccgtacgaccgtcccgtaacccgaaaccgggaaccggtcccgtaaccggtttccccggtttccccttaccccccgggtaccggaccccctaccccgttacccgtaacccgtaaccgtacgtaccgtaccccgttcgggtcggggaccacggtaaccggtcgaccggtcccggtcgggtacctcggtaccgttcggaacgtaacggtccttaccttacgtaaccgttacctacttcgtacggttagcgggttccgggacctagggaaccgaacgccgattaacgngnn

SEQ ID NO: 53676 - DNA, 605 bp, Homo sapiens
  misc_feature: GYAE6OF01BAR8C.29.78.H01.1.454.CMB.1.raw
  modified_base (292)..(292): a, c, t, g, unknown or other
  misc_feature (292)..(292): n is a, c, g, or t
  modified_base (387)..(387): a, c, t, g, unknown or other
  misc_feature (387)..(387): n is a, c, g, or t
  modified_base (601)..(601): a, c, t, g, unknown or other
  misc_feature (601)..(601): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgccaggctccagggaaggggctggagtgggtctcgcctattagtggcagtggtggcgctatatattatgcagacgccctgaagggccgttcaccatttccagagacaattcgaagaacacgctgtatctgacaaatggagagcctaganactcgaacgacacggcctctattattgtagttaaaggcgagctaggaataccggggaccggggcccacgttcgaccacgtcggggctaggggacncgtcggtcaccgtctcctcgacgcctccaaccgacgggcccagttccggtccttcccccgtggcccaccctcctaccgaacgacgtccaaccgtcggtcggggtccaacgtacgccgacgcccgtagggctcgtaccgtcggtacgaacggtactacgtccgagttaccgtactacgtcgtagacggcgggtctggacgaacggcgaccagtgntacg

SEQ ID NO: 53677 - DNA, 814 bp, Homo sapiens
  misc_feature: GYAE6OF01AUX8B.29.78.H01.1.454.CMB.1.raw
  modified_base (144)..(144): a, c, t, g, unknown or other
  misc_feature (144)..(144): n is a, c, g, or t
  modified_base (808)..(808): a, c, t, g, unknown or other
  misc_feature (808)..(808): n is a, c, g, or t
  modified_base (813)..(813): a, c, t, g, unknown or other
  misc_feature (813)..(813): n is a, c, g, or t
tcagatagagtactcacgaccggtgctcgatttagtgtgagtagtttgggtttgggggcgcctgggtacggccggggggtcgctgagactctcctgtgcggcctctgattaagttttaggagtcatgccatgaacgtgggtccnccgaggctccgagggaagggctggagtggtctcggctattagtggcaggtggtggcgctatatattatgcagaccgcccgtaggaacgggtccggttaccaaccgtactttaccaaggtaacgaacctaaacgtttcggaaaacgaaaccacggtcttaggttaacttcgtagaacgtaaaggtaggagacgtccgtagacgaccgtaccggaaccgaccgaccggtccgtttacttagtttagttaggttaaggttaaacggcggtacggtacggtacggtaacggtacccggggtacccggtaccgtacggtaccgaccggtacggtacggggacggacggggaccgtcggtacggtacccgtacccgtcctccgtaccgtaccgtaccccgtacccgaacccggaccggtaccctacgttcccgttccccgttccccgtaccgtcccctaccccgttacccgaaccgtacgacccgtacccgtccggtaccgggtccggaccgaccgaccggaccgtcccggtccggtccgggtccggtaccggtccggttaccggtaaccgtaaccggttacccttaaccgtaccgtaccgttaccgttacgttacgtcgggtaggaccgggtccgggacggtacggaacggtaccggaccgtagtacgngtcgng

SEQ ID NO: 53678 - DNA, 714 bp, Homo sapiens
  misc_feature: GYAE6OF01CVYQV.29.78.H01.1.454.CMB.1.raw
tcagatagagtactcacgaccggtgctcgatttagtgtgagtagtttgggtttgggggcgcctgggtacggccggggggggtcgctgagactctcctgtgcggcctctggattaagttttaggagtcatgccatgaactgggtccgccaggctccgaggggaaggggctggagtgggtctcggctattagtggcagtggtggcgctatatattatgcagaccgccctaggaacggggccggttcacctatttccaagagaacaattacgaaagaaccacggctagtatctagacaaagtggaagagcctagagactcgacgacacggccgtctattatgtagttaaggcgagcgtaggaacgtaccgggggacccggggcccgtacttacggacccaacggtcgggggacccgaaggggggaccgtcgtacgggtacccgtacccgttcctccctacgacggtcccctcccgaaccgaaccgggaccctacgtccggttaccccttcccccgtcgggacccctacccctaccctacccgaagaccgaccctaccgtccggtcggggaccacgacgaccgacggtccccgaggggcctcggtcccgtacgggtacgtaaccggtaccttacccgttacctaacggttacccttacttacgttcgtaggacggccggggccgtacgggaccggaacgggaccgagacgttaggctg

SEQ ID NO: 53679 - DNA, 693 bp, Homo sapiens
  misc_feature: GYAE6OF01BD18F.29.78.H01.1.454.CMB.1.raw
  modified_base (317)..(317): a, c, t, g, unknown or other
  misc_feature (317)..(317): n is a, c, g, or t
  modified_base (688)..(688): a, c, t, g, unknown or other
  misc_feature (688)..(688): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgccaggctccgagggaaggggctggagtgggtctcggctattagtggcaggtggtggcgctatatattatgcagacgccctggaagggccggttcacctatttccagagacaattcgaagaacacgctgtatctgactaaagtggagagcctgagactcgacgacacggccgtntattattgtagttaaaggcgagctaggaagtaccggggacccggggccacgttcgaacccgtacggtcggggaccgagggggacgcgtcggtccaccggtcctcctcgaacgccctaccgacccgaacgggcccctacgttccggttcccttcccccgtcggcccctaccccttcctacccgaacgacgaccctacccgtcggtcgggggaccaccgacggcccgacggtcccgtacggggccgtccggtcccgttacgggtaccgaacggtacccgttaacccttaccgtaaccgttacctaccgttaacgtccgttaggacgggtcccgggtcggttacgggaacgtaacgggaccgacgtaacgtggngtacg

SEQ ID NO: 53680 - DNA, 588 bp, Homo sapiens
  misc_feature: GYAE6OF01DY3OA.29.78.H01.1.454.CMB.1.raw
  modified_base (290)..(290): a, c, t, g, unknown or other
  misc_feature (290)..(290): n is a, c, g, or t
  modified_base (399)..(399): a, c, t, g, unknown or other
  misc_feature (399)..(399): n is a, c, g, or t
  modified_base (437)..(437): a, c, t, g, unknown or other
  misc_feature (437)..(437): n is a, c, g, or t
  modified_base (580)..(580): a, c, t, g, unknown or other
  misc_feature (580)..(580): n is a, c, g, or t
  modified_base (586)..(587): a, c, t, g, unknown or other
  misc_feature (586)..(587): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctnagactcgacgacacggccgtctattattgtgttaaaaggcgagctaggaatacgggacccggggaccgacttagaccacgtcggggccaggggacgctggtcaccgtcncctcagccctccaccaagggcccagtcgtccttccccncggccacctccctccaagacgcaccctcgtcggggccacgagccagccccgtgggcctcggccgtcgggtcaacgggtaccttacttcccgtaacgtacctacttactcgtgacggccggggactgggacgaacgggcccganacgtgnng

SEQ ID NO: 53681 - DNA, 660 bp, Homo sapiens
  misc_feature: GYAE6OF01C0OWW.29.78.H01.1.454.CMB.1.raw
  modified_base (419)..(419): a, c, t, g, unknown or other
  misc_feature (419)..(419): n is a, c, g, or t
  modified_base (654)..(654): a, c, t, g, unknown or other
  misc_feature (654)..(654): n is a, c, g, or t
  modified_base (658)..(658): a, c, t, g, unknown or other
  misc_feature (658)..(658): n is a, c, g, or t
  modified_base (660)..(660): a, c, t, g, unknown or other
  misc_feature (660)..(660): n is a, c, g, or t
tcagatagagtactcacgaccggtgctcgatttagtgtgagtagtttgggtttgggggcgcctggggtacggccgggggggtcgctgagactctcctgtgcggcctctggatttaagttttaggagtcatgccatgaactgggtccgccaggctccgagggaagggctggagtggggtctcggctattagtggcagtggtggcgctatattattatgcagaccgccctaggaacgggtccgtacacctattccagagactaattcgaaagacacgctagtatctgacaaagtggagacgcctagacgacctacgacgacaccggtccgtactagtttattggtaagtaaacggcgagcgtaggaagtaccgggggacccgggcccgagttccgaccacggtcggggccgagggggaccncggtcggtccaccgtcctcctacacgtccctccaacccgacgggccctacgtcccggttccccttccccgcggtacccctacccctcctaccgaagaccgcctacccgtcgggtacggggcctacgacgaccgacgcccgtgggcctcggccgttacggacgaacgtctaaccttccgtagtcctactcgtcgtgggtacgggcggtacgcgggaaccggacggaccgagttacncggngn

SEQ ID NO: 53682 - DNA, 851 bp, Homo sapiens
  misc_feature: GYAE6OF01DH8QP.29.78.H01.1.454.CMB.1.raw
  modified_base (291)..(291): a, c, t, g, unknown or other
  misc_feature (291)..(291): n is a, c, g, or t
  modified_base (847)..(847): a, c, t, g, unknown or other
  misc_feature (847)..(847): n is a, c, g, or t
tcagatagagtactcacgaccggtgctcgatttagtgtgagtagtttgggtttgggggcgcctgggtacggccgggggggtcgctgagactctcctgtgcggcctctggatttaaagttttaggagtcatgccatgaactggggtccgccaggctccgagggaaggggctggagtgggtctcggctattagtggcagtggtggcgctatatattatgcagacgccctgaacgggccgttcaccatttccagagacaattcgaaagaacacgctgtatctgacaaagtgganagcctgagctcgacgcacggctactattattgtagttaaaggcgagcgtaggaagtaaccgggggaccccggggaccctaacgttcggaacccacggttcggggggacccgaaggggggacccgtccggttacgggttacccgaaccccggttcctccccgttacgaccggtccccttaccccgaaacccgtaaccggggtacccctaaccgttccccgggtttcccccgtttaccccccccggttacgggtacccccgtaaccccccgttacccccgttaaccccgaacggtacccgaccgtaacccccggttacccgggttcgggggggacccctaaccggacccggtacccgacccgggttaaccccgggttccgggggtaccggttcccggtacccgtttcgggtaacccggtaaaccgggtaacccgtttaacccgtttaccccgtaaacggttaccccttacctttaaccgttaccgttacgggtaaacggggcccggggttacgttacccggggaaccgtaaccgggaccggaccgtaaacggttaggngacg

SEQ ID NO: 53683 - DNA, 808 bp, Homo sapiens
  misc_feature: GYAE6OF01CI1D5.29.78.H01.1.454.CMB.1.raw
  modified_base (287)..(287): a, c, t, g, unknown or other
  misc_feature (287)..(287): n is a, c, g, or t
tcagatagagtactcacgaccggtgctcgatttagtgtgagtagtttgggtttgggggcgcctgggtacggccgggggggtcgctgagactctcctgtgcggcctctggattaagtttaggagtcatgccatgaactgggtccgccaggctccagggaaggggctggagtgggtctcggctattagtggcagtggtgcgctatatattatgcagacgccctgaacgggccggttcaccatttccagagacaattcgaagaacacgctgtatctgacaagtggagacncctgagactcgacgacgacgccgtactattattgtagttaagcgagtgtgtaagaccggggtaccgggcccgtacttcgaaccacggtcggggaccgtaggggaccgtcgtaggtccaccgtctcccgtacgccgtaccctcccgaaccggaaccgggtaccccgtaacgttccccggttaccccgtttcccccccgtaccgggtaccccctaacccccgttacccccgtaaccccggtaaacggtacccggtaccccgtaccccggttaacgggtcccgggggggaacccaaccggtacccgggaaccgacccgggttaacccccggttacccggggggttacccggttcccggttccccgggttaacccggggttaacccggtaaccggggttaaaccctttacccggtttaccgttaaccgttaaacccgttccgttaacccgttccggtacgggtaaccgggtccgggtacggtaccgggtaccgaaacggggccgtaccgtaacgtacgcgtaacg

SEQ ID NO: 53684 - DNA, 782 bp, Homo sapiens
  misc_feature: GYAE6OF01EZM4G.29.78.H01.1.454.CMB.1.raw
  modified_base (197)..(197): a, c, t, g, unknown or other
  misc_feature (197)..(197): n is a, c, g, or t
  modified_base (250)..(250): a, c, t, g, unknown or other
  misc_feature (250)..(250): n is a, c, g, or t
  modified_base (779)..(779): a, c, t, g, unknown or other
  misc_feature (779)..(779): n is a, c, g, or t
  modified_base (782)..(782): a, c, t, g, unknown or other
  misc_feature (782)..(782): n is a, c, g, or t
tcagatagagtactcacgaccggtgctcgatttagtgtgagtagtttgggtttgggggcgcctgggtacggccgggggggtcgccgagactctcctgtgcggcctctggattaagttttaggagtcatgccatgaactgggtccgccaggctccgagggagggctggagtggtctcggctattgtggcagtggtgcnctatatattatgcagaccgccctaggaacgggtccgttcacctatttccaganactaattccgaagacacgtctgtactctcgacaaagtcggagacgtcctaggacgaccgtaccggaccgaccaaccgggtcccgttactttaagtttacgtttaggttacgggtttaaaacgggccgtaacggtccggttaagggtaaacggttaccccggggggaaccccggggtccccgtaacgttcgaacccggtacggtccgggggaccctaggggggacgtccgtacggtacccgaccggttcctctcccgtaaccgtcccctacccgaaaccggaccggggtcccctaaccgttcccgggttaccccgttccccccgtcggtaccccgtaccccccgttacccgtacccgaacgtacccgacccgtaacccgttccggacggggaccctaccgtaccggccgaaccgtcccgtcgggtacctccggtccgtacggtaccgtaacggtaccttaccgttaccacgttaccgttccaagttccgtaggccggacggcggttaccggagacgggtcacgagtcgtngtn

SEQ ID NO: 53685 - DNA, 636 bp, Homo sapiens
  misc_feature: GYAE6OF01ATAQH.29.78.H01.1.454.CMB.1.raw
  modified_base (381)..(381): a, c, t, g, unknown or other
  misc_feature (381)..(381): n is a, c, g, or t
  modified_base (400)..(400): a, c, t, g, unknown or other
  misc_feature (400)..(400): n is a, c, g, or t
  modified_base (469)..(469): a, c, t, g, unknown or other
  misc_feature (469)..(469): n is a, c, g, or t
  modified_base (476)..(476): a, c, t, g, unknown or other
  misc_feature (476)..(476): n is a, c, g, or t
  modified_base (480)..(480): a, c, t, g, unknown or other
  misc_feature (480)..(480): n is a, c, g, or t
  modified_base (492)..(492): a, c, t, g, unknown or other
  misc_feature (492)..(492): n is a, c, g, or t
  modified_base (496)..(496): a, c, t, g, unknown or other
  misc_feature (496)..(496): n is a, c, g, or t
  modified_base (510)..(510): a, c, t, g, unknown or other
  misc_feature (510)..(510): n is a, c, g, or t
  modified_base (554)..(554): a, c, t, g, unknown or other
  misc_feature (554)..(554): n is a, c, g, or t
  modified_base (600)..(600): a, c, t, g, unknown or other
  misc_feature (600)..(600): n is a, c, g, or t
  modified_base (624)..(624): a, c, t, g, unknown or other
  misc_feature (624)..(624): n is a, c, g, or t
tcagatagagtactcacgaccggtgctcgatttagtgtgagtagtttgggtttggggtctgagagaggagtccacccctgggatcttcaggtgttttcatttggtgatcaggacggaacagagagaactcaccatggagtttgggctgagctggtctttttcttgtggctaattttaaaaggtgtccagtgtgacgtgctagttggtggagtcgtgggggcgccgtggggtacgggccgggggggtcgcgtgagactctcctgtcgccggcctcgtggtatttaaggttttaggagtcatcgccagtgtaacgtcgggtccgcgaggcctaccgagggggaacgggtcgtgggaggttcgggtctcgggcttagttacggnggcgtaggtgggtggcgtntatatattatgacagaccgtcccgtaggaacggggtccgttacacctattccgagagtactatacgaanacacgtntagntctagactaagnggancgtcgtagactacncggacacggacgtccgttattacttagttaggttacggtaacgnaggtcgtaagggaacgtaccggggacccgggacccgtatcggaacncgggtaccgggacgacggggtacncggtcggtcccg

SEQ ID NO: 53686 - DNA, 787 bp, Homo sapiens
  misc_feature: GYAE6OF01CRIXO.29.78.H01.1.454.CMB.1.raw
tcagatagagtactcacgaccggtgctcgatttagtgtgagtagtttgggtttgggggcgcctgggtacggccgggggggtcgctgagactctcctgtgcggcctctggatttaagttttaggagtcatgccatgaactgggtccgccaggctccgagggaaggggctggagtgggtctcggctattagtggcagtggtggcgctatatattatgcagacgccctgaacgggtccgttcacctatttccagagaacaattacgaaagaacacgctgtatctagacaaagtggagagcctagagactcgacgacgacggcctactattattgtagttaaacggcgagtcgtaggaacggtacggggaccgggcccgtacgttgacctacggtcggggccggagggggaccgtcgtcggtaccgaccgtcctccgtcgaacgtccctacccgaacggaaccgggcccctaacgttcccgggtttcccccttccccccgtcggtaccccctacccccgtcccgttaaccgaacgaccgtcccgtaacccgttccgggcgggggtacccaaccggtaccgaccgtacccgggtccccgggtaccggggtaccggttaccgggtaccccggttacggggtacccgtaaacgggttacccgtttaacccgtttaccgtaaaccgggtttaccttaaccgttaccgttaccggttacggggaacccgggtccgggggtaacccggttaccgggggtaaccgaaccggggtaacccgacgtaaacggttgcgacg

SEQ ID NO: 53687 - DNA, 738 bp, Homo sapiens
  misc_feature: GYAE6OF01CWCNH.29.78.H01.1.454.CMB.1.raw
  modified_base (216)..(216): a, c, t, g, unknown or other
  misc_feature (216)..(216): n is a, c, g, or t
  modified_base (225)..(225): a, c, t, g, unknown or other
  misc_feature (225)..(225): n is a, c, g, or t
  modified_base (399)..(399): a, c, t, g, unknown or other
  misc_feature (399)..(399): n is a, c, g, or t
  modified_base (430)..(430): a, c, t, g, unknown or other
  misc_feature (430)..(430): n is a, c, g, or t
  modified_base (444)..(444): a, c, t, g, unknown or other
  misc_feature (444)..(444): n is a, c, g, or t
  modified_base (463)..(463): a, c, t, g, unknown or other
  misc_feature (463)..(463): n is a, c, g, or t
  modified_base (734)..(734): a, c, t, g, unknown or other
  misc_feature (734)..(734): n is a, c, g, or t
tcagatagagtactcacgaccggtgctcgatttagtgtgagtagtttgggtttgggggtcgccctgggtacggccgggggggtcgcgtgagactctcctgtgcggcctctggattaagtttaggagtcatgcccgatgaacgtggggtccgccgacggctccgaggggaaggggcctggacgtgggtctcggcttattagtggcagtggtggcgtntattagttnttagtggctaggaccgccctaggaacgggcccggttacgaaccgtactttaccgaaagacgaactaagttaccggaaagtaacacgtcttaggtaacgtcgtggaactaaagtcggagacgtcctagagaactacggacgacgacggcctattattatcgtagtaaacggcgancgtagaagtaccgggccggtccacgtgaccncgtgggcaggggcncgtggtccacgtctccgtnacgtcctcgacgacggtcccgaagtccggtcccttaccccgtggtacccctacccgttacgtaccgaacgtaccgaccgtaacccgtcggtaggggaccctaacggaccgtaccgaccggtaccccggtcgggggtaccctacgggtacccgttcgggtaaccgaaccggttacctttaacccgttaccccgtaacgttacccttaccgtaacggtacgtacggacggtcgggtacccgttacggaccgtacgggacccacgaacgtacgngacg

SEQ ID NO: 53688 - DNA, 748 bp, Homo sapiens
  misc_feature: GYAE6OF01CXCM5.29.78.H01.1.454.CMB.1.raw
  modified_base (744)..(744): a, c, t, g, unknown or other
  misc_feature (744)..(744): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaagggctggagtgggtctcggctattagtggcagtggtggcgctatatattatgcagaccgccctgaagggccggttcaccatttccagagacaattacgaagaacacgctgtatctgacaaatggagagtcctgagactcgacgacacggccgttactattattgtagttaaaggcgagcgtaggaaacgtaccgggacccggggcccgacgttcgaccacggtcggggaccgagggggaccgtcgtcggtcgacccgtcctccctcacgccctacccgaaccgaaccgggccctaacgttcccggttccccgtttccccccgtcgggacccctacccccgttcccctacccgaaccggtaccgaccctaacccgttccggtacgggggaccaaccgaaccggcccgaacccggtccccggtcggggtaccgttaccgggtaccgttacggggtaacccgtaaacgggtacccgtttaaccgtttaccccgtaacggttaaccctttaccttaccgtccggttaccgggtacgggcccggggttaccgtcggggacccggtaaagggacccggtacgtaacgtgnggac

SEQ ID NO: 53689 - DNA, 754 bp, Homo sapiens
  misc_feature: GYAE6OF01DYKPC.29.78.H01.1.454.CMB.1.raw
  modified_base (750)..(750): a, c, t, g, unknown or other
  misc_feature (750)..(750): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgcaggctccgagggaagggctggagtgggtctcggctagttagtggcagtggtggcgctatatattatgcagacgccctaggaagggccggttcacctatttccagagacaattcgaaagaacacgctagtactacgtgacaaaagtgggaagacgtaccgtagaagacctacgaccgaaccgaccgggtccgttactaatttagttaggttagttaaaaggcggaaggtcgttaagggaacgtacggggggaccccgggaccccgtagttcggacctacggtcgggggacccgaagggggaccgcgtagggtacccgacccgtccgttccctaccgacgtaccccgtacccgaaccgaaccggggtaccccacgtacccggttaccccttcccccggtacggcccctacccgtaccctaccgaacgtaccgacctaacccgtcggtcggggtaccacgtaaccgcgaccgggtaccccgtcggggtcgtacccggtccggttacgggtaacctaacgggtaccttaaccgtccgtaaacggtaccttaccgttactacgttagggaaccggcgggcgttacggacggtaacggcgactaagtcgngacg

SEQ ID NO: 53690 - DNA, 952 bp, Homo sapiens
  misc_feature: GYAE6OF01BFN3U.29.78.H01.1.454.CMB.1.raw
  modified_base (146)..(146): a, c, t, g, unknown or other
  misc_feature (146)..(146): n is a, c, g, or t
  modified_base (948)..(948): a, c, t, g, unknown or other
  misc_feature (948)..(948): n is a, c, g, or t
tcagatagagtactcacgaccggtgctcgatttagtgtgagtagtttgggtttgggggcgcctgggtacggccgggggggtcgctgagactctcctgtgcggcctctggatttaagttttaggagtcatgccatgacgtgggtccncgaggctcgaggggagggcgtggaggtgggtctcggacttagttaggtggcgtaggttgggtcggccgtacttaattatttaagttagtcgacgaacggtacccgtcccgtagggaaccggggttcccggttaccaacccttacgttttacccgaaaggtaaacggtaaaccttaaacgtttaaccggaaaacgaaaccgtaccggtccgttagttaacttcgtacggaacgtaaaaggtggaacgacgtccgtaggaacgtaccgtaccggaaccgaccgaccggtccgttacttaagtttacgttggttaaaggttaacggcgtaacggtcgtaagggtaaaccgggtacccgggggaccccgggaccgttacgtaccggaacccgtacgggtccggggaccggtaggggaccgtcggttccggtaccctaccggttcctacccgtaccgaccggtaccccgtacccgaaccggaacccgggtccccttagggttcccccggtttcccccgtcccccggtacggtacccccttaccccccgttaccgaaccggtaacggtaccccgtaccccgtttacccgggttcggggaacccggggtacccaaaccgggtcccggtaacccggtccccggttcccggggttacggggtcccttacccgggttacccgggttaacgggtaaccgtaaccggttccccttaaacccgttcgtaaacccggtttcctacggttacgtcccgggtacgggaccggggttcccggtacgtaccgggaaaccgtacgggcctaaagtcgtggngtac

SEQ ID NO: 53691 - DNA, 856 bp, Homo sapiens
  misc_feature: GYAE6OF01DTDHI.29.78.H01.1.454.CMB.1.raw
  modified_base (303)..(303): a, c, t, g, unknown or other
  misc_feature (303)..(303): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccgagggaaggggctggagtgggtctcggcttattagttgcagtggtggcgctatatattatgcagaccgccctggaagggccggttcacctatttccgagagacaattcgaaagaaccacgctgtatctgacaaagtggaagagcctganacctacgaacgaccacggccgtacttaatttattaggtaggttaaaggcgagtcgtaggtaacgtaccgggggacccggggaccgtacgttacgaccgtacggtcggggggacccgaagggggaccgccggttcgggtacccgtaacccggttccctcccttcgaaccggtccccctaacccgaacccggaaccggggcccctaaccggttccccggtttaccccgtttccccccgtaccgggaccccctacccccgtccccttaacccgaacgtaccgtcccgtaaccccgttcgggtaccggggggtcccaaaccgaccggtaccgacccgggtacccccggtggggtaccccgtccggggtacccgttacggggttaacccgaaacgggttaccccgttaaacccgtttaaccccggtaaccggtttacccgtttaccgttaaccgtttacccggttaaccgggaaccgggggtccccggggtaccggggttaccggggaaccccgggtaaacggggtaccccggtaaccggttaaagttacgggcgacg

SEQ ID NO: 53692 - DNA, 700 bp, Homo sapiens
  misc_feature: GYAE6OF01B8M6S.29.78.H01.1.454.CMB.1.raw
tcagatagagtactcacgaccggtgctcgatttagtgtgagtagtttgggtttgggggtcgcctagggtacggcccggggggtcgcgtgagactctcctgtgcggcctctggattaagttttaggagtcatgccatgaacttgggtccgccaggctccagggaagggctggagtgggtctcggctagttagtggcagtggtggcgctatatattagtgcagacgcccgtggaacgggtccggttcacctatttccagagaacaagttcgaagaacacgctagtatctgacaaagtggagagcctagagactcgacgacgacggcctctattattggtagttaaaggcgagcgtaggaacgtaccggggacccgggaccgtaactacgaccgaacgtcgggggaccgacggggaccgcgttacggtaccgacccggtctccgtaccacgtccctaccgaaccgacgggtcccctaagttcccggtcccttacccccgtggtacccctacccgttacccaaccgtaacgcgacctacccgtcggtcggggacacgacggaccgacggtcccgtacgggacctcggtaccgtacgggtaccgtaacggtccttaaccgttaccgtaacgttaccgtccgtaagttccggtaagcggggtaccggtcgtagggtaccgaacgggtcgtaacgaggtagtcgacg

SEQ ID NO: 53693 - DNA, 646 bp, Homo sapiens
  misc_feature: GYAE6OF01BE7TO.29.78.H01.1.454.CMB.1.raw
  modified_base (410)..(410): a, c, t, g, unknown or other
  misc_feature (410)..(410): n is a, c, g, or t
  modified_base (641)..(641): a, c, t, g, unknown or other
  misc_feature (641)..(641): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaagggctggagtgggtctcggctattagtggcagtggtggcgctatatattatgcagacgccctgaagggccgttcaccatttccagagacaattcgaaagaacacgctgtatctgacaaatggagagcctgagactcgacgacaccggcctctattattgtagttaaaggcgagctaggaagtaccggggacccgggccgacttcgaccaacggtggggcccgaggggacctcgtcgggtccaccgttccnccctcacgccctaccgaaccgacgggccctacgtccggtcccgttcccccgtcggccctacccctcctaccgaacgacgcctacccgtcgtcggggacctacgacgccgaccgcccgtcgggccgtcggtccgtcggtacgaacggaccttacccgttaccgtacgttaccttacgttacgtcgtacggtaacggccgggtacgtccgggacgtacggccgacgtacgtgngtacg

SEQ ID NO: 53694 - DNA, 741 bp, Homo sapiens
  misc_feature: GYAE6OF01D7G48.29.78.H01.1.454.CMB.1.raw
tcagatagagtactcacgaccggtgctcgatttagtgtgagtagtttgggtttggggtccgagccatggtgcagactccccagagctctcctcctcctccactgcacagggtctctctcccagcctgtgctgactcaatccgccctctgcctctcgcctccgtgggagctcggtacaaggtcacctgtactctgagcaggtcggacacgagacacgcctacgcctatccggtcgttggcactacgacggacgaacggacggaccgaacggaccggaccggtcccttacgttactagatacgaacagtaccaaatagtagacgtcggacgacgtacgaacggacggaacgggaaacggggcgtaacctccggtagtaccgttcgtacttaccgcgtacgttccaccgtacgtccgtcggtacggtcgtagtaccgaccgtacctaaccgtaccgttaacctaccgttccccgtacccgtacccgttacggtacggttacgttaaggggaactcggtacgggaccgttacgtaacgtttaaccttacgttccgaacgttacggacccgttcgggtcggaccgttaggtcgtaaccgtttcggttaaccggtccgggttaccgggtacccgggaacccgtagtccgtccgggtaacgttccgacggtaaccgaccggtacccgaacccggtaccctaaaccggttccgtacctaccgtttccccgttccgcccggtttaccccc

SEQ ID NO: 53695 - DNA, 717 bp, Homo sapiens
  misc_feature: GYAE6OF01EW1A1.29.78.H01.1.454.CMB.1.raw
  modified_base (255)..(255): a, c, t, g, unknown or other
  misc_feature (255)..(255): n is a, c, g, or t
tcagatagagtactcacgaccggtgctcgatttagtgtgagtagtttgggtttggggtctgagagaggagtcccacccctgggatcttcaggttgttttcatttggtgatcaggacggaacagagagaactcaccatggagtttgggctgagcgtgtgttttctaggtggtctaagtttaaaaggtgtccagtgtgacgtgcgaggttggtggagtcggtgggggcgccgttggggtaccggggccggggggtcncgtaggagactcctcgtggtcgcggtcctgtaggtaatttaaggtttaggacgtcagtgaccagtagtaacgtcggggtaccaccgaggccgtaccggaaggggtaagggcgtgggagggtcgggtccttaccgggtcttaagttacggttgacgtagggtcggtggcgtactatactagtatgacagtaccgccgtaggacgggtaccgtcaactattcaaggtacaactaacgttacgaacgtaactacgtcttagtactacgtagacgtaaagtacggaacgacgtacgtaggaactaccggtaacggaaccgaaccggtaccgggtaccttacgttagttttaagtaggtaaggttaagcgtacggtacgtagggaaccggtaccgggggaccgggtcctaacggttacgacccgacgggttacgggacccggtaggggcccgtggtccggtaacccg

SEQ ID NO: 53696 - DNA, 576 bp, Homo sapiens
  misc_feature: GYAE6OF01E4XQF.29.78.H01.1.454.CMB.1.raw
  modified_base (383)..(383): a, c, t, g, unknown or other
  misc_feature (383)..(383): n is a, c, g, or t
  modified_base (555)..(555): a, c, t, g, unknown or other
  misc_feature (555)..(555): n is a, c, g, or t
  modified_base (573)..(573): a, c, t, g, unknown or other
  misc_feature (573)..(573): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccaggggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggacccggggcccgacttgaccactggggccagggggacncgtggtcacccgtctccctcagccctccaccgaacgggcccatccggtccttcccccgtggcccaccctccctccaacgacgccacctcgtcggggccacgacgccacgccccgtgggcctgtcccgtggtacaaggacctaccttccagtacctctatctgacggcgggcnggacgaacggcaccatgntcg

SEQ ID NO: 53697 - DNA, 624 bp, Homo sapiens
  misc_feature: GYAE6OF01AZKAF.29.78.H01.1.454.CMB.1.raw
  modified_base (622)..(622): a, c, t, g, unknown or other
  misc_feature (622)..(622): n is a, c, g, or t
tcagatagagtactcacgaccggtgctcgatttagtgtgagtagtttgggtttggtggtctctctcccagcctgtgctgactcaatcgccctctgcctctgcctccctggggaggctcggtcaaggtcacctgtactctgagcagtggacacagcagctacgccatcgcttggcatcagcagaggccagacacgggccctgttacttgatgacagtcaacaatgatggcagtcacagcgaagggggacggatccctgatcgcttctcagtctccagccttcgtgggcctgacgcgcctacctcacaatcctcggcctcagtctgaggatggacgctgactattactgtacaggtacccttgggggacctacgtggacctatttaccgacgggttccgttacggggaacccgggggtaaccaaacgggttcccgaacccggttcgggtacccggttacaccggtacccccgaaacgggtcccccaaacccccgcgtttaccggtaccctaacgttcccttaccggtttccccccgcccccttaccccttcgtaacgttaccgttacctacgtccgttacgggacggtcccgggtctcggggaccaacgggtccgctaagacgngc

SEQ ID NO: 53698 - DNA, 575 bp, Homo sapiens
  misc_feature: GYAE6OF01E1VGG.29.78.H01.1.454.CMB.1.raw
  modified_base (150)..(150): a, c, t, g, unknown or other
  misc_feature (150)..(150): n is a, c, g, or t
  modified_base (284)..(284): a, c, t, g, unknown or other
  misc_feature (284)..(284): n is a, c, g, or t
  modified_base (381)..(381): a, c, t, g, unknown or other
  misc_feature (381)..(381): n is a, c, g, or t
  modified_base (524)..(524): a, c, t, g, unknown or other
  misc_feature (524)..(524): n is a, c, g, or t
tcagatagagtactcacgaccggtgctcgattttagtgtgagtagtttgggtttggggtccgagccgatggtgcagactccccagagcgtctcctcctcctccactgcacagggtctctcctcccagcctgtgctgactcaatcgccctntgcctctgcctcctgggagctcggtcaaggtcacctgtactctgagcagtgacacagcagctacgccatcgcttagcatcagcaggcgacaagacgaccgggcccttacgttactgtattcgactagtacaaanatgagtcggctacgacacacggacggaagggggcgactcctgactcgcttacgcgtagtccacagtcgtcgtcgggcctgaccgccgtaccgtaccncaacacgttccgcccggcttcagttctaggagagtgacgtctagaccttattacgcgactacggtacgtcgggactaccgtgtactagtttcgcgggttccgtaccggggaccgtacgtaagggtccctaccggtcggtcganacccgcccgtaaacgccccaacccgtgttcaccctacctgttcccggtccc

SEQ ID NO: 53699 - DNA, 788 bp, Homo sapiens
  misc_feature: GYAE6OF01BH1FN.29.78.H01.1.454.CMB.1.raw
tcagatagagtactcacgaccggtgctcgatttagtgtgagtagtttgggtttggggtccgagccatggtgcagactccccagagctctcctcctcctccactgcacgagggtctctctcccagcctgtgctgactcaatccgccctctcgcctctcgcctcccgtggggacggctcggtacaacggtctaccgttgtactctaggacgacgtaggtacggaccacgagacgacgccgtaaccgcctagttccggtcgtttacgggactacgtaccgaaggacgaaggaccggacccgaacggaccggtacccggggttccctttacggtttacgttacggtaatcgaactacgtaaccaaactagtggtagtcggacgtagtaccgaacggacgggaacgggaacgggggtacgtaccgtccgtggacttccgtcttacgtcgtacgtccctacgacgttcgtacgggtcggtaccgtaggtacccgtccgttacccgttaaccgttaccaaccgttaccgttccccggtcccggtacccgttaccgtagttacggtaagggacgtaacgtacgggacggttactacgttaactttacgtcgtacggtaccgacggtaccgggttcggactacggtcgtaccgttagtaccgggttacgggttcccggtacgggaacccgggacgttaccgggtccgtaccgggttccggtcggtaccgacccgaaccccggaccgtaaccccctacgtccttacgtacccttcccgttcggtacccccgttccccg

SEQ ID NO: 53700 - DNA, 605 bp, Homo sapiens
  misc_feature: GYAE6OF01CGXCY.29.78.H01.1.454.CMB.1.raw
  modified_base (602)..(602): a, c, t, g, unknown or other
  misc_feature (602)..(602): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattatgtgttaaaggcgtagctggaatacggggaccgggcccgacttgaccacgtggggccaggggaccgctggtcaccgtctcctcgacgcctccaccgaagggcccatccggtcttcccccgtggccaccctcctccaacgacgccacccgtcgtcgggggccacgacgccgacgccccgtcgggccgtcggtcccgttcgggtacgaacggtacccttaccgttcccaggttaccctacttacgtccgtaggacggcgggcgtgggaccgtaagggccgacacgttgntcg

SEQ ID NO: 53701 - DNA, 773 bp, Homo sapiens
  misc_feature: GYAE6OF01D55PF.29.78.H01.1.454.CMB.1.raw
  modified_base (768)..(768): a, c, t, g, unknown or other
  misc_feature (768)..(768): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgtcatgaactgggtccgccaggctccgaggggaaggggctggagtgggtctcggctattagtggcagtggtggcgctatatattatgcagaccgccctaggaacggggtccggttacacctactttccagtaagactaattcgaaagaacacgctgtatctgacaaagtggagacgcctaggaacgaccgtacggaaccgaccgaccgggtcccgttacttatttagtttaggttaaggttaaagggcgtaggcgtagggaacgtaccggggacccggggaccgtacgttacggaccgtacggtcgggggacccgtagggggaccgtcggttcgggtaccctacccggtcctccctcgacgtcccctacccgaccggaacggccctacgttcccggttccccttcccccgtggacccctaccccttaccgtaccgaacggtcgtaccctaccgttcgggtacggggacccacgcgccgaccgtcccggtacgggtccgtcgtcccggtacgggttacgaaccgggtacccctttaccgtacccgtaacgtttaccctaccgttaacgttcccggtagggcccgggtccggggtaccgttacccggggaaccggtaaccgggtcctaacgttaacggtagntaacg

SEQ ID NO: 53702 - DNA, 700 bp, Homo sapiens
  misc_feature: GYAE6OF01DAGQ7.29.78.H01.1.454.CMB.1.raw
  modified_base (650)..(650): a, c, t, g, unknown or other
  misc_feature (650)..(650): n is a, c, g, or t
  modified_base (679)..(679): a, c, t, g, unknown or other
  misc_feature (679)..(679): n is a, c, g, or t
  modified_base (694)..(694): a, c, t, g, unknown or other
  misc_feature (694)..(694): n is a, c, g, or t
  modified_base (698)..(698): a, c, t, g, unknown or other
  misc_feature (698)..(698): n is a, c, g, or t
tcagatagagtactcacgaccggtgctcgatttagtgtgagtagtttgggtttggtggtctctctcccagcctgtgctgactcaatccgccctctgcctctcgccctccgtgggagctcggtcaaggtcacctgtactctgagcagtggacacagcagctacgccatcgcttggcatcgagcgaggacggccacggacgccgggccttcgttacttgatgaccagtacaaactaagtggatgggacagtacaacgaggaccggaaggggggtaccggactacccgtgtaactcgtcttacgactacgtctaccgacggtcgttcggcggggcctcggacggtcctacctacctacgaactaactcccggtcccggaccctacggacgttacgtaggtaagggagttcggaggtccgtaagtaaccttattacgtcggtacgaacggtaccggtacggggactacggtacggtctacgggttacgtacggggttaccggttaaccggggaccggtaaccggaggtcccgtacggtaccggttaccggtaccgtaaccgacccggtaacgacccctaacccgttcgtacggttacccttaaccgttcccgtaccgttaccccaccggttccctaacgttccgttactacgtntaccgtcggaacggcggtcggtaaccggngtaaccggcgatagngtcngc

SEQ ID NO: 53703 - DNA, 657 bp, Homo sapiens
  misc_feature: GYAE6OF01CA4HD.29.78.H01.1.454.CMB.1.raw
  modified_base (247)..(247): a, c, t, g, unknown or other
  misc_feature (247)..(247): n is a, c, g, or t
  modified_base (309)..(309): a, c, t, g, unknown or other
  misc_feature (309)..(309): n is a, c, g, or t
  modified_base (444)..(444): a, c, t, g, unknown or other
  misc_feature (444)..(444): n is a, c, g, or t
tcagatagagtactcacgaccggtgctcgatttagtgtgagtagtttgggtttggggtctgagagaggagtccacccctgggatcttcaggtgttttcatttggtgatcaggacggaacagagagaactcaccatggagtttgggctgagctggtctttttcttgtggctattttaaaaggtgtccagtgtgacgtgcagttggtggagtcgtgggggcgccgtggggtaccgggccgggggggtcncgtgagctctcctgtgcggctcgtggattaagttttaggagtcatgccatgaactgggtccnccaggctccgaggggaggggctgggagtgggtctcgggctagttaggtggcaggtggtggcgctatattatagtgcagacgccctaggaacgggccgttcacctatttccagagactaagttacgaagaacacgntagtatctgacaaagtggagacgtccgtgaacgactacggacgaaccgtaccgggcctttacgttatttacgtttaggttagggttaaacgggcgtaacggtcgttaaggggtaaacggtacccggggggaccccggggtacccgtaacggtttccggaacccgacgggttccgggggacccgaaggggggtaccgcggttccgggtaccccg

SEQ ID NO: 53704 - DNA, 737 bp, Homo sapiens
  misc_feature: GYAE6OF01CKSUM.29.78.H01.1.454.CMB.1.raw
  modified_base (295)..(295): a, c, t, g, unknown or other
  misc_feature (295)..(295): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtcccgccaggctccgagggaaggggctggagtgggtctcggctattagtggcagtggtggcgctatatattatgcagacgccctggaagggccggttcacctatttccagagaacaattcgaagaacacgctagtatctagacaaagtggagancctagagactcgacgacgacggtccgtctattagttaggttagttaaaggcgagtcgtagggtaaacggtaccggggacccgggtacccgtaccgttacgaaccgtacggtcggggaccggaggggaccgcgtcggtccgaccgttctccctcacgtccctacccgaaccgacgggcccgacgtcccgttcccgttacccccgcggtcccctaccccgtccctaaccgtaacgacccgtaccgtaaccccgtccggtaccgggggtacccaacggaccgacccggtccggtaccccggtacgggtccgtaccgtccggttaccgggtaccgtaaaccgggtaccttacccgtttaccgtaaccgtaccgttaccgttacgtaccgtagggtacgggcgggtaccggtcggtacgggaaccggaccggtacgtaactcgtgcg

SEQ ID NO: 53705 - DNA, 701 bp, Homo sapiens
  misc_feature: GYAE6OF01BFD4S.29.78.H01.1.454.CMB.1.raw
  modified_base (698)..(698): a, c, t, g, unknown or other
  misc_feature (698)..(698): n is a, c, g, or t
tcagatagagtactcacgaccggtgctcgatttagtgtgagtagtttgggtttgggggcgcctgggtacggccgggggggtcgctgagactctcctgtgcggcctctggatttaagttttaggagtcatgccatgaactgggtccgccaggctccagggaaggggctggagtgggtctcggctattagtggcagtggtggcgctatatattatgcagacgccctggaacgggccggttcaccatttccagagacaattcgaagaacacgctgtatctgacaaagtggagagcctagagactcgacgacacggccgtctattattgtagttaaaggcgagcgtaggaacgtaccggggacccggggacccgtacgttcggaaccgtacggtcgggggaccgacgggggacgcgtcgggtacctacccggtcctcccgtcgaacggcccctacccgaacccggaacggggcccctaacgttcccggtcccctttccccccgtgggacccctaccccgtcctaccgaacgcgaccctaccgtcggtcggggaccacgacgccacggcccgtcgggaccgtcggtccgtacgggtacgaacggtaccttaccgttaccgacggttaccttaccgtaacgttccggtaggaccgggttccggggaccgttcgggaaccggtaacggggccaaccgtagtaggnacg

SEQ ID NO: 53706 - DNA, 609 bp, Homo sapiens
  misc_feature: GYAE6OF01BNGYU.29.78.H01.1.454.CMB.1.raw
  modified_base (268)..(268): a, c, t, g, unknown or other
  misc_feature (268)..(268): n is a, c, g, or t
  modified_base (403)..(403): a, c, t, g, unknown or other
  misc_feature (403)..(403): n is a, c, g, or t
  modified_base (423)..(423): a, c, t, g, unknown or other
  misc_feature (423)..(423): n is a, c, g, or t
  modified_base (515)..(515): a, c, t, g, unknown or other
  misc_feature (515)..(515): n is a, c, g, or t
  modified_base (606)..(606): a, c, t, g, unknown or other
  misc_feature (606)..(606): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccaggggaaggggctgggagtggggtctcgggctattagtggcagtggtggcgctatatattatgcagacgccctggaacgggccggttcaaccatttccagagacaattcgaaanacacgctgtatctgacaaatggagagcctgagactcgacgacgacggccgtctattagtgtaggttaaaggcgagctaggaagtaaccgggcccggggacctacgttcgaccgacggtcggggccgaagggggcncgtcggtaccaccgtctccncacgccctaccaccgaacgggacctacgtccggtccttcccccgcggcccaccctacctccgaacgacgacctaccgtcgcggggcacgacnccgacgcccgtcggctcgccgtcgtagaacggactacctcaactcctctacgtcgaggacggcgggacgtggaccgtaacggcagagtagnacg

SEQ ID NO: 53707 - DNA, 629 bp, Homo sapiens
  misc_feature: GYAE6OF01B65IR.29.78.H01.1.454.CMB.1.raw
  modified_base (390)..(390): a, c, t, g, unknown or other
  misc_feature (390)..(390): n is a, c, g, or t
  modified_base (624)..(624): a, c, t, g, unknown or other
  misc_feature (624)..(624): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccgagggaaggggctggaggtgggtctcggctattagtggcagtggtggcgctatatattatgcagacgccctaggaacgggccggttcacctattccagagacaattcgaagacacgctgtatctgacaaagtgagagcctgagactcgacgacacggccgtctattatgtagttaaaggcgagctaggaagtaccggggaccgggccgacgttgaccacggtcgggcgaggggacncgtggtccaccggtctccgcacgccctaccaccgaacgggccctacgtccggttaccttcccccgtggccctacccgtccctaccgaacgacgacccaccgtcggtacggggccacgacgccgacgcccgtaggcgtcgtccgtcggtacgaacggtaccttaccgtaccgtacgtaccttaccgtactccggtaggacggccgggcgtcggacgtacggccgactacggtagngtacg

SEQ ID NO: 53708 - DNA, 599 bp, Homo sapiens
  misc_feature: GYAE6OF01CGFOX.29.78.H01.1.454.CMB.1.raw
  modified_base (200)..(200): a, c, t, g, unknown or other
  misc_feature (200)..(200): n is a, c, g, or t
  modified_base (208)..(208): a, c, t, g, unknown or other
  misc_feature (208)..(208): n is a, c, g, or t
  modified_base (339)..(339): a, c, t, g, unknown or other
  misc_feature (339)..(339): n is a, c, g, or t
  modified_base (417)..(417): a, c, t, g, unknown or other
  misc_feature (417)..(417): n is a, c, g, or t
tcagatagagtactcacgaccggtgctcgatttagtgtgagtagtttgggtttggggtccgagccatggtgcagacctccccagagctctcctcctcctccactgcacagggtctctctcccagcctgtgctgactcaatccgccctctgcctctcgccctccgtggggagtctcggtcaaggtccacctgtactctgancagcgacnagcagctacgctatcgtctggcatcgagcagacgcagaccgaccgggtcctacgttatcgatgactgtacaataatgaagtcggcacgcacgaggtacgaacggggacgtactccgtggtactcgtcttcnctacgtcctacacgtctcggtcggcctagacgtcgactacctacactactcccggcctctcgagttcgaggacggtancggtaggtctacgtacttacgtagttccgacgacggttaccggcggtacaacgtcggactttaagtcggtacggttccgtaccgggggaaccgtagtaccggtccggtaactccgggtaccaccgaccggtaacccacgtccccgaaccctcgtcgtccaaccggttccctacgttaccccc

SEQ ID NO: 53709 - DNA, 839 bp, Homo sapiens
  misc_feature: GYAE6OF01BNZ3L.29.78.H01.1.454.CMB.1.raw
  modified_base (215)..(215): a, c, t, g, unknown or other
  misc_feature (215)..(215): n is a, c, g, or t
  modified_base (251)..(251): a, c, t, g, unknown or other
  misc_feature (251)..(251): n is a, c, g, or t
  modified_base (297)..(297): a, c, t, g, unknown or other
  misc_feature (297)..(297): n is a, c, g, or t
  modified_base (326)..(326): a, c, t, g, unknown or other
  misc_feature (326)..(326): n is a, c, g, or t
tcagatagagtactcacgaccggtgctcgatttagtgtgagtagtttgggtttggggtctgagagaggagtccacccctgggatcttcaggtgttttcatttggtgatcaggacggaacagagagaactcaccatggagtttgggctgagctggtctttttcttggtggtcttaagttttaaaaggtgtcctagtgtgacgtgcaggttggtggngtcgtggggcgccgtggggtaccgggcggggggtcncgtgagactctccgtgtcgcggcctcgtaggtagtttaagtttagngtcagtcgccagtagaacgtcgggtcccncgacggcgtccggaaggggaggggcgtggtagggtcggtcgtcggtacttaagttacggtggctagggtgggtcgcgtcttaattagttaagtttagtcgacacggaccccgtccggtaaggaaccggggttcccggtacctaaccgttacgtttacccgaaggtaacgaacctaacgttacgaaacgaccgtacggtactagttaaccgtcgtaaggaactaaaacggtgggaacgtacgtacccgtaggaaccgtaacccgtcggggaacctaacccggtaccggttacccgttaattttaacggtttaaacgttgggttaaacgggtttaaacgggacggtaacggtaacggttaaccgggggaaaaccgggggtttaaccccgggggtaacccccccggggacccggtttaacgggttaaccccggaaccggggtacccgggggttacccgggggaacggggttaaacccgggggaccggttcccgggtacccgggttaaccccccggg

SEQ ID NO: 53710 - DNA, 695 bp, Homo sapiens
  misc_feature: GYAE6OF01CBQK1.29.78.H01.1.454.CMB.1.raw
  modified_base (618)..(618): a, c, t, g, unknown or other
  misc_feature (618)..(618): n is a, c, g, or t
tcagatagagtactcacgaccggtgctcgatttagtgtgagtagtttgggtttggggtccgagccatggtgcagactcccagagctctcctcctcctccactgcacagggtctctctcccagcctgtgctgactcaatccgccctctgcctctcgcctccgtgggaggctcggtcaaggtcacctgtactctgagcaggtcgacacgagcagcctacgcctatcgtcttggcatcgagcagacggccaggaccgaccgggtcccttagttacttgatgactagtacaacagttgagtggactacgacacgaggacgggaaacgggggacgtactaccgtgacgtcgtcttcgcgtacgtcctaccgagtctcggtcgggtcctaggacgtccgtacctacccgtacaaccgtaccttcccgtaccccggtccttacctacggttcctagggaacggtagtcgggacgttcctaaggttacctacgtttacgtacggtccgtaacggaccgggttcgggactacggtcggtacttacgttccgggtaacggtttccgggtacccgggaaacccgggtaccgttacggtacccggtacccggttcgggtaccccggtaanaccccgggtaaccccgtaacgggacccccctaaaccgttcaccggtaccctaccgtttccccgtaccgttccccccg

SEQ ID NO: 53711 - DNA, 807 bp, Homo sapiens
  misc_feature: GYAE6OF01B1019.29.78.H01.1.454.CMB.1.raw
  modified_base (145)..(145): a, c, t, g, unknown or other
  misc_feature (145)..(145): n is a, c, g, or t
  modified_base (260)..(260): a, c, t, g, unknown or other
  misc_feature (260)..(260): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccncaggctccgagggaagggctggagtgggtctcggctattagtgcagtggtgcgctatatagttatgcagacgcctgaacggccgttcactatttccagagacaattcgaagaacncgctgtatctagacaagtggagagcctagagacgtcgacgacgacggccgtatactttagtgttagttaaaggcgtagccgtaggaacgtaccgggaccgggtccgacttcggaaccgtacggtcggggaccgtaggggacctcggtcggttaccaccggttctacccgtacgacgttaccctacccgaacggtaacccgggtcccctacggttacccggtttacccccgttacccccccgttaacggcccccttaaaccccccgttccccgtaacccgtaacgtttacccgggaacccggttacccgtaaacccccggttttcggggtaaccgggggggtaaccctaaccggtaacccgggtacccggaacccggggtaccccggttcggggttaacccgttccgggtacccgggttacgggtaacccgtaaacgggttaccccgtttaaccgtttaacccgtaaacgtttacccgttacgttaccgttaccgtaacgggtacggtccgggtactcgggacccgtaagggcccgtaacagttaggc

SEQ ID NO: 53712 - DNA, 705 bp, Homo sapiens
  misc_feature: GYAE6OF01BP1WJ.29.78.H01.1.454.CMB.1.raw
  modified_base (249)..(249): a, c, t, g, unknown or other
  misc_feature (249)..(249): n is a, c, g, or t
  modified_base (271)..(271): a, c, t, g, unknown or other
  misc_feature (271)..(271): n is a, c, g, or t
  modified_base (518)..(518): a, c, t, g, unknown or other
  misc_feature (518)..(518): n is a, c, g, or t
tcagatagagtactcacgaccggtgctcgatttagtgtgagtagtttgggtttgggggaagaggaagactgacggtccacccctgggatcttcaggtgttttcatttggtgatcaggacggaacagagagaactcaccatggagtttgggctgagcgtggtcttttcttaggtggctaattttaaaaggtgtccagtgtgacgtgcagttggtggagtcgtggggcgcctggggtacggcggggggtcntgagactctcctgcgcggcctntggatttaagtttagagtcatgcatgaactggtaccgcacggctccgaggggaacgggcgtgggaggtcggggtctcgggtacttagttaggtggtcgaaggttggtggcgtcgtaattattattatggacaaggtaccgccctagggaaccgggtcccggtttacacccgttaagtttcccgaagacggtaactaagttacggaaagaaccgacgtctaggttatccgtagaacctaaagtcgganacggtacctaggacgaactcgaacgacgtaccggaccttcgttaagtttacgtaggttagtaaaacgggtcggaagtccgtaagggtaaaaccggttcccgggggaacccggggccccgtttaggtcccggtaaaccgacccggttcggggggaccttaaacggggggcctcggttcggtaccccgg

SEQ ID NO: 53713 - DNA, 729 bp, Homo sapiens
  misc_feature: GYAE6OF01C82KY.29.78.H01.1.454.CMB.1.raw
tcagatagagtactcacgaccggtgctcgatttagtgtgagtagtttgggtttggggcgcctgggtacggccggggggtcgctgagactctcctgtgcggcctctggatttaagttttaggagtcatgccatgaactgggtccgccaggctccgagggaaggggctggagtgggtctcggctattagtggcagtggtggcgctatatattatgcagacgcctgaagggccgttcacctatttccagagacaattcgaaagaacacgctgtatctgacaaagtggagacgcctagacgactcgacgacgaccggtccgtcttattagttgtaaggtttaaaggcgagcgtagggaacgtaccgggggacccgggacccgacgttacgaccgtacggtcggggaccggacggggaccgtcgtcggtaccaccgttcctcctacgacgcccctaccaccgaccgggccctacggtccggttacccctcccccgtggaccccttaccccctacccgtaccgaaacggccgtacccgtacccgttcgggtcgggggacccaaccggacgccgaccggtccccgtaggggtccctcgggtccccgttaggtacccgtaacgggtacccttaacccttaccgtacgttacccgttattaccggtttacccgtacgggtacgggtcccgggggtccgtacggggaacccggaacgggtccccggacaaggtacgcag

SEQ ID NO: 53714 - DNA, 1076 bp, Homo sapiens
  misc_feature: GYAE6OF01EBECM.29.78.H01.1.454.CMB.1.raw
tcagatagagtactcacgaccggtgctcgatttagtgtgagtagtttgggtttggggggagagaggagtccacccctgggatcttcaggtgttttcatttggtgatcaggacggaacagagagaactcaccatggagtttgggctgagctggtctttttcttgtggtacttaattttaaaaggtgtccagtgtgacgtgcaggttggtggagtcgtgggggcgccgtggggtaccgggccggggggtcgcgtgagactccttccgtggtcgccggtcctcgtaggtaattttaaggtttttaggagttaccagtcgccgtagtacgtaaccgtcgggtcccgccgacggccgtcccggaagggggtaacgggggtcggtagggtacgggttcgggttaccggtccgggttacgttacgtttaagggttcgggtacggtagggttggggttcgggtaccggttccaaaatttaagttaacgtttttaaaacgttggggtaccctaacgggtaaaccggcccccccgtttacggggtaaaaacgggggggccccccgggggttttttacccggaaaacccccccaaaggttttttttaccccccgaaaacgggtaaacggtaaacccgaaaaaacgttttttccccgggaaaaacgggaaaaacccgtaaacccgggtaccccgtttacgggtttaaacgtttacccgttaagggtcccgtaaaaaaagttcggggtaaacgggtaaacgggtacccccgtttagggaaaccggtaacccgtttaacccgggaaaccccgggtaacccgtaaaccccggggttacccccggtttacccgtttaagtttttaaacgtttaacgggtttacgggttttaaaaaacggggtcccgggtaaacgggtacccgttacgggggtaaaaaccggttaaaccccgggggggtaaccccgggggggtaccccccggtaaccgttttaccgggaaccccggtaaccgggttaccgggggggaccccgaacgggggggtaacccggtacccggttacgggggttcccgtaaacccccgggtttcccccg

SEQ ID NO: 53715 - DNA, 725 bp, Homo sapiens
  misc_feature: GYAE6OF01D54AZ.29.78.H01.1.454.CMB.1.raw
  modified_base (252)..(252): a, c, t, g, unknown or other
  misc_feature (252)..(252): n is a, c, g, or t
tcagatagagtactcacgaccggtgctcgatttagtgtgagtagtttgggtttggggtctgagagaggagtccacccctgggatcttcaggttgttttcatttggtgatcaggacggaacagagagaactcaccatggaggtttgggctgagctggtcttttttcttgtggcttaattttaaaaggtgtccagtgtgacgtgcagttggtggagtcgtgggggcgccgtggggtaccgggccgggggggtcncgtgagactctcctgtgcggcctgtggtaattaagtttaggagtcatgccatgaactggtccgccaggctccgaggggaaggggcgtaggaggtgggtcgtcggcttaagttaggtggactaggtggtacggcgacttaagttaatattaagcgacaacggtaccgacccgttaggaacggggtcccggttacaaccctagtttacccaaaggacgtaaactaaactttaccggaaaagtaaccgaacggtacgttagtaacgttcgtaacgataaaagttgggaagacgtccgtagacgaacgtgaaaccgacgaaccgggtccttacttaactttagttaggtaaggttaaacgggccgtaaggtcgtaacggggtaaacggtaacccgggggaccccggggtacccgtacgttacggacccgtaacgggtcgggggaacccggtaaggggacctccggttggtaaccccg

SEQ ID NO: 53716 - DNA, 751 bp, Homo sapiens
  misc_feature: GYAE6OF01EK81K.29.78.H01.1.454.CMB.1.raw
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccgaggggaagggctggagtgggtctcggctattagtggcagtggtggcgctatatattatgcagaccgccctaggaacgggtccggttacacctatttccagagactaattacgaaagaacacgctagtatcgtgacaaagtggagacgctagagacctacgaccgacgaccggcctactatttagttggtagtaaaggcgagtacgtaggaacggtaccggggacccgggacccgtacgttacgaccgtacggtcggggaccggacggggacgtcggtcggtccacccggtctcccgtcaccgccctaccgaaccgacggccctacgttcccgtcccgttcccccgcggacccctacccgtaccctaccgaacgaccgacccctaaccggtccgggtacggggacctaaccggacgtacccgaccggtccccggttagggcccgtaccgggtaccggttccgggtaaacgaaccgggttaacccttaacccttaccggtaaccgttaccgttacctaacggtcccggttaggaccggggtccgggtaccggttacggggaacccgttaacggggtaccgacggtaacgtagtcgacg

SEQ ID NO: 53717 - DNA, 1114 bp, Homo sapiens
  misc_feature: GYAE6OF01EAEUQ.29.78.H01.1.454.CMB.1.raw
  modified_base (224)..(224): a, c, t, g, unknown or other
  misc_feature (224)..(224): n is a, c, g, or t
  modified_base (250)..(250): a, c, t, g, unknown or other
  misc_feature (250)..(250): n is a, c, g, or t
tcagatagagtactcacgaccggtgctcgatttagtgtgagtagtttgggtttggggggaagaggaagactgacggtccacccctgggatcttcaggtgttttcatttggtgatcaggacggaacagagagaactcaccatggagtttgggctgagctggctttttctgtggcttattttaaaggtgtccagtgtgacgtgcagttggtggagtcgtgggggcnccgtggggtaccgggccggggggtcncgtgacgactctcctggtcgcggcctcgttgggtaattttaaaggtttttagggagttaccgtaagttcggaccctaagttacggtaaaccgttcggggtaccccggacccggtaacgggtccgttacccggaagggggggaaacgggggtcggttagggggtacgggtttacggggggttccgttccggggtaccttttaacggttttaaggttcggggaccgttaacggggtttgggggtttacggggacccggttaccgtttaaatttaaacgtttaagttttaaacggtttcggaacccggtaaccggtaaacccccggttaccccccgggtttaacgggggaaaaacccgggggggttcccccgggtttttaaacccgaaaccccccggtttaaacgttttttaccccccgggaaaagggttaaacccgggtaaaccgttaaaacgttttaacccgggaaaaacgggaacccgttaaacccgggtacccgttttaagggttaaccctttacggttttaaccgggaaacccgttaaaaaggtttgggggaaaaccggtaaccggttacccggttaacggggtaaaccggtaaccccggttaaccggggtaaacccgaaaccccgggtacccgggggttaacccctttaacgttttaaccgttttaagtttacgggggtttaaacggttttaaacgggccgggtaaacgtccgggttaaaccggggtaaacgggtacccccgggggggtaaccccgggggtaccccggttaacccggttaacggaacccccggtaaccggggttcggggggaacccccggtaagggggggaacccgtcccgggttcggggtaaccccccgg

SEQ ID NO: 53718 - DNA, 665 bp, Homo sapiens
  misc_feature: GYAE6OF01AVITA.29.78.H01.1.454.CMB.1.raw
  modified_base (178)..(178): a, c, t, g, unknown or other
  misc_feature (178)..(178): n is a, c, g, or t
  modified_base (237)..(237): a, c, t, g, unknown or other
  misc_feature (237)..(237): n is a, c, g, or t
  modified_base (254)..(254): a, c, t, g, unknown or other
  misc_feature (254)..(254): n is a, c, g, or t
  modified_base (379)..(379): a, c, t, g, unknown or other
  misc_feature (379)..(379): n is a, c, g, or t
  modified_base (389)..(389): a, c, t, g, unknown or other
  misc_feature (389)..(389): n is a, c, g, or t
  modified_base (561)..(561): a, c, t, g, unknown or other
  misc_feature (561)..(561): n is a, c, g, or t
tcagatagagtactcacgaccggtgctcgatttagtgtgagtagtttgggtttggggtctgagagaggagtccacccctgggatcttcaggtgttttcatttggtgatcaggacggaacagagagaactcaccatggagtttgggctgagcgtgtgtttctagtgctatttaaaggtntccagtgtgacgtgcagttggtggagtcgtggggcgccgtgggtacggccggggggtcncgtggagactctcctgngccggcctctaggtattaagttttaggagtcatcgaccagtgaacgtggggtcccgccagggcctccgaggggaacggggcgtaggagtggtctcggacttagttaggtgctaggtgtggccgtntattatattngcagaccgccgtaggaacgggtcccgttcacctattcccaggactacgaacttaccgaagaccacgtcttagtactccttaggacctaaagtgggaagcgtccgtagacgtaacccgtgaaccgaccggtaccggtcccggtattaacgttgtttacggaagtttaacgggngtacggagttacgggaacgtaccgggggtaccccgggaccccggtagttaccgacccggtaacgggtcggggacccggaggggtacccggtgtcggggttaccc

SEQ ID NO: 53719 - DNA, 701 bp, Homo sapiens
  misc_feature: GYAE6OF01BOMO6.29.78.H01.1.454.CMB.1.raw
  modified_base (206)..(206): a, c, t, g, unknown or other
  misc_feature (206)..(206): n is a, c, g, or t
  modified_base (518)..(518): a, c, t, g, unknown or other
  misc_feature (518)..(518): n is a, c, g, or t
  modified_base (699)..(699): a, c, t, g, unknown or other
  misc_feature (699)..(699): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatggaactgggtccgccaggctccaggggaagggctgggagtgggtctcggctattagtggcaggtgggtggcgntaatattattatgcagaccgccctggaacggggtccggttcacctactttccgagacgactaagttcgaaagaaccacgctgtatctagactaaaagtcggaagacgtcgtgacgtaccgtacggaaccgaccgtaccgggtcctacttaagtttacgtttggtaacggttaaacggcgtagtacggtaggtaacggtaccggggacccgggacctacgttcgaccgtacggcgggcgacgggacgcgtcgacgcctctcctcacgtcctaccgacgaacggtcctacgtccgttcctccccgtgtaccccnccgtccacgaacgacaccgtacgcggtacgggccaacgtacgacccgtacggtcccgtcgggtacgtccgtaccggttacgtaaccgttacccgggtaccttaccgttaccggtactacgttacccgttacgtccgtaggcgggtaccggtcgtacggacggacgtaccgacgagtacggnag

SEQ ID NO: 53720 - DNA, 655 bp, Homo sapiens
  misc_feature: GYAE6OF01CII6O.29.78.H01.1.454.CMB.1.raw
  modified_base (248)..(248): a, c, t, g, unknown or other
  misc_feature (248)..(248): n is a, c, g, or t
  modified_base (377)..(377): a, c, t, g, unknown or other
  misc_feature (377)..(377): n is a, c, g, or t
  modified_base (642)..(642): a, c, t, g, unknown or other
  misc_feature (642)..(642): n is a, c, g, or t
  modified_base (651)..(651): a, c, t, g, unknown or other
  misc_feature (651)..(651): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgcctgaagggccggttcaccatttccaganacaattcgaagaacacgctgtatctgcaaatggagagcctgagactcgacgacacggcctctattattgtagttaaagcgagctggaatacgggaccgggccacttgaccagtggggaccaggggaccngtcggcaccgtctcctcgagtccctaccaccgaacgggcccacgtccggtcccttccccccgtacggtcccaccccgttccctacccgaaacgtacgaccacccgttccggtcgggggaccaacgacgaccgaccggccccgtaggggtcccgttccggtcccgtacgggtcgaaaccgggtaccttaaccgttcccgtaagttaccttcctaacgttccgtagggtacggcccgggggtactacggggaccacgggggaccganacggttagntacg

SEQ ID NO: 53721 - DNA, 659 bp, Homo sapiens
  misc_feature: GYAE6OF01BZLTU.29.78.H01.1.454.CMB.1.raw
  modified_base (657)..(657): a, c, t, g, unknown or other
  misc_feature (657)..(657): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcacctatttccagagacaattcgaagaacacgctgtatctgcaaatggagagcctgagactcgacgacgacggccgtctattattgtagttaaaggcgagcgtaggaagtaccggggacccggggcccgacgttcggaaccgacgtcgggggacccgagggggaccgcgtcggtccaccggtcctccgtaccgacgcccctacccgaaccgaacgggcccctaacgttccggttccctttccccccgtcgggcccctaccccgttccctacccgaaacgcgaccctacccgtccgtcgggggccacgacgccgacgcccgtcggacctcgccgtacggtacaacggtaccttaccgttaccgtacgttacctacgttactcgtagacggccgggtcgtcgggacgtaacggcgacgacgtgngc

SEQ ID NO: 53722 - DNA, 617 bp, Homo sapiens
  misc_feature: GYAE6OF01A4TML.29.78.H01.1.454.CMB.1.raw
  modified_base (613)..(613): a, c, t, g, unknown or other
  misc_feature (613)..(613): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccggggccgacttgaccactggggccaggggacgcgtggtccaccgtctcctcgacgcctcccaaccaacggggccccagtccggtccttccccccgtcggcccaccctccctacccaagacgccaccctcgtcgggggccacgacgccacggccccgtgggcctccggccgttcgggtaccaaacgggaccttaaccgttcccgaagttaccttccgtattccgttaggacggccgggacgtgggccgaacgggccgacgaactggntacg

SEQ ID NO: 53723 - DNA, 694 bp, Homo sapiens
  misc_feature: GYAE6OF01AD4BR.29.78.H01.1.454.CMB.1.raw
  modified_base (184)..(184): a, c, t, g, unknown or other
  misc_feature (184)..(184): n is a, c, g, or t
  modified_base (199)..(199): a, c, t, g, unknown or other
  misc_feature (199)..(199): n is a, c, g, or t
  modified_base (244)..(244): a, c, t, g, unknown or other
  misc_feature (244)..(244): n is a, c, g, or t
  modified_base (292)..(292): a, c, t, g, unknown or other
  misc_feature (292)..(292): n is a, c, g, or t
  modified_base (312)..(312): a, c, t, g, unknown or other
  misc_feature (312)..(312): n is a, c, g, or t
  modified_base (315)..(315): a, c, t, g, unknown or other
  misc_feature (315)..(315): n is a, c, g, or t
tcagatagagtactcacgaccggtgctcgatttagtgtgagtagtttgggtttggggtctgagagaggagtccacccctgggatcttcaggtgttttcatttggtgatcaggacggaacagagagaactcaccatggagtttgggctgagcggtgtcgttctaggtcggctaatttaaaaggtntcagtgtgacgtgcngttggtggagtcgtgggggcgcctggggtacggccgggggggtcncgtgagctctcgtggtcgcggtcctgtaggtatttaaggttagacgtnatcgacatgtacgtcggccncgnggtcgtacggaggggagggtggtggtggtcggtcgtcggtacgtagttaggtggcgtggtggtcggtcgtagtatattattagtgacgacgtaccggtaccggtacggtacgggtaccggttaccgtaaccgtacgttacgtacgaacgtaacgtaacgtaacgtaaacgaacgtacgtacgtagtagtacgtacgacgtaagtagtacgacgacgacgacgaccgtaccgaaccgtaaccgtaccgtacgtacttagttagttagttaggtaacgtacgtacgtacggtacggtaaccgggtacccgggtacccgggtaccggtacggtaccgtacggtaccgggtaccgggaccgggacgggcggtcgtcggtaccg

SEQ ID NO: 53724 - DNA, 549 bp, Homo sapiens
  misc_feature: GYAE6OF01AX5QF.29.78.H01.1.454.CMB.1.raw
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagacacgctgtatctgcaaatggagagcctgagactcgacgacacggccgtctatatgtgtaaagcgagctggaatacgggacgggcccgacttgaccacgtggggccagtggacgctggtcaccgtctcctcagcctcaccaggcccatcggtcttcccctggcaccctcctccagagccaccgtcctcgggggcacgagccgaacggcccgtggggcctggccctgggtcaaggacctacttccagttacctcgttactctggcggcgggctcggcaaggccgcagtgcg

SEQ ID NO: 53725 - DNA, 630 bp, Homo sapiens
  misc_feature: GYAE6OF01DULOD.29.78.H01.1.454.CMB.1.raw
  modified_base (319)..(319): a, c, t, g, unknown or other
  misc_feature (319)..(319): n is a, c, g, or t
tcagatagagtactcacgaccggtgctcgatttagtgtgagtagtttgggtttgggcgcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctggaacgggccggttcacctatttccaagagacaattcgaaagaacacgctgtatctgacaaatggagacgcctgagactcgacgacgacggccgtntattattggtagttaaaggcgagcgtaggaagtaccggggaccggggcccacttcgaccgacggtcggggaccgaggggacgcgtcgggtcctaccgtcctccgtacacgccctaccgaccgaacggccctacgtccggttccctccccgtcggcctacccctcctaccaacgcacctaccgtcggtacggggccacgacgcgaccgtcccgtgggtcctcgcccgtaggaccgtaacggtacttacctcctaagtaccttactagtcgtaggcggccgggtcgtacgggacgaacggcgaccgagtaggc

SEQ ID NO: 53726 - DNA, 596 bp, Homo sapiens
  misc_feature: GYAE6OF01EZCOG.29.78.H01.1.454.CMB.1.raw
  modified_base (594)..(594): a, c, t, g, unknown or other
  misc_feature (594)..(594): n is a, c, g, or t
  modified_base (596)..(596): a, c, t, g, unknown or other
  misc_feature (596)..(596): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccgttcaccatttccagagacaattcgaagaacacgctgtatctgcaaatggagagcctgagactcgacgacacggccgtctattattgtgttaaaggcgagctggaagtacggggaccggggcccgacgttcgaccacgtcggggccaggggacgcgtcggtcaccgtctcctcacgccctccaccgaacgggcccagtccggtccttcccccgtcggcccaccctccctaccaacgacgccaccctcgtcggggccacgacgcgacgcccgtgggcctcggtccgtcggtacgaacggtaccttaccttccgacgttacctcttacgtctggacggcgggcgtcggacgaacgggcgacatgngn

SEQ ID NO: 53727 - DNA, 543 bp, Homo sapiens
  misc_feature: GYAE6OF01B3RFQ.29.78.H01.1.454.CMB.1.raw
  modified_base (455)..(455): a, c, t, g, unknown or other
  misc_feature (455)..(455): n is a, c, g, or t
  modified_base (477)..(477): a, c, t, g, unknown or other
  misc_feature (477)..(477): n is a, c, g, or t
  modified_base (539)..(539): a, c, t, g, unknown or other
  misc_feature (539)..(539): n is a, c, g, or t
  modified_base (543)..(543): a, c, t, g, unknown or other
  misc_feature (543)..(543): n is a, c, g, or t
tcagatagagtactcacgaccggtgctcgatttagtgtgagtagtttgggtttggtggtctctctcccagcctgtgctgactcaatcgccctctgcctctgcctccctgggagctcggtcaaggtcacctgtactctgagcagtggacacagcagctacgccatcgcttggcatcagcagaggccagacacggccctcgttacttgatgacagtacaacaatgatggcagtcacagcgaagggggcggatccctgactcgcttctcagtctccagctcgtcgggcctggacgcgcctacctcactaactccgtcccggtcctccgagtctaggaaggactggaggtctaggtacttattacgtgtacacggaccgtggggcctacgtggactagttcgaggttccgtacgggaccgggacaacggtcaccggtgcgtcacgccacgcccaacccngtcgctactccgtcttaccccnccctctccacgttacctctactcgtcggacggtcgggtctcgggacgacggtccgacagtangtgn

SEQ ID NO: 53728 - DNA, 891 bp, Homo sapiens
  misc_feature: GYAE6OF01B4IW0.29.78.H01.1.454.CMB.1.raw
  modified_base (887)..(887): a, c, t, g, unknown or other
  misc_feature (887)..(887): n is a, c, g, or t
tcagatagagtactcacgaccggtgctcgatttagtgtgagtagtttgggtttggtggtctctctcccagcctgtgctgactcaatcgccctctgcctctgcctccgtgggagctcggtcaaggtcacctgtactctgagcagtggacacagcagctacgccatcgcttggcatcagcaggacggccagaccgaccgggtccctcgttacttgatgacagtacaaacaagtgatggacagtcacgaggacggaaagggggaccggactcccgtagactcgtcttcgtcacgtcctccgagtctcggtcgggcctggacgtcccgacctaccgtccaaccgtaacttccccgtcccgggtacccttaccgtaacggttccgtgggtaaacgggtacggttcgggaaccgggtccttaaacggttaactttaacgtttaccggtacggtaaccggtaaccggggttacccgggtacgggggtaccttaaccgggttccgggtaaaccgtttaccggttttccgggtaaaccgggggtttccccggtttaaaccccgggggggaaaccccgggggtaaaccttaaccgggggttccccgttaaacccgggggtttcccgtaacccggggttacccaaccccgggttaaacccccggaaacccggtaacccccccgttaaacccccgtaacggtttcccgggttaaacccccgttaccgtttccccggttacccccgggtttcccccccgtaaccccggttccgttaacccgttaaccggttttaaaccctcccgttaaaccgggtttccggtaacgggggtacccggggttacccggggtcccggttaaggggaaacccgtaccgggaccgttacctaaaggtcgggacncgtc

SEQ ID NO: 53729 - DNA, 740 bp, Homo sapiens
  misc_feature: GYAE6OF01CS0DX.29.78.H01.1.454.CMB.1.raw
  modified_base (737)..(737): a, c, t, g, unknown or other
  misc_feature (737)..(737): n is a, c, g, or t
tcagatagagtactcacgaccggtgctcgatttagtgtgagtagtttgggtttgggggcgcctgggtacggccgggggggtcgctgagactctcctgtgcggcctctggatttaagttttaggagtcatgccatgaactgggtccgccaggctccgagggaaggggctggagtgggtctcggctattagtggcagtggtggcgctatatattatgcagaccgccctgaacgggccgttcacctatttccagagacaattcgaaagaacacgctgtatctgactaaagtggaagacgtcctaggagacctccggaacgaccgaccgggcccgtacttattagttgttagttaaaggcgagcgtaggaacgtaccggggacccggggcccgtacgttcggaacccgtacggtcggggacccggaagggggaccgcgttcggtcccgaaccgttccctcccttcgaccgtccctaccgacccgacgggaccctacgtccgttcccttcccccgtcggcccctacccctcctacccgaacgcgaccgtaccccgtcggtacggggaccacgaccgacgacccggcccggtcgggcccgtccggtcccgttacgggtacccgtaaacggtacccttaacccgtttacccgtaaccgtttacccttccgttaaccttccggttacgggaccgggtcccggggtaccgtacgggaaccggtaccgggtaccgaccgtagtacgngcg

SEQ ID NO: 53730 - DNA, 840 bp, Homo sapiens
  misc_feature: GYAE6OF01EHPGQ.29.78.H01.1.454.CMB.1.raw
  modified_base (219)..(219): a, c, t, g, unknown or other
  misc_feature (219)..(219): n is a, c, g, or t
  modified_base (257)..(257): a, c, t, g, unknown or other
  misc_feature (257)..(257): n is a, c, g, or t
  modified_base (305)..(305): a, c, t, g, unknown or other
  misc_feature (305)..(305): n is a, c, g, or t
tcagatagagtactcacgaccggtgctcgatttagtgtgagtagtttgggtttggggtctgagagaggagtcccacccctgggatcttcaggttgttttcatttggtgatcaggacggaacagagagaactcaccatggagtttgggctgagctggtcttttttcttggtggtcttaatttttaaaagggtgtccagtgtgacgtgcaggtttggtggngtcgtgggggcgccgtggggtaccgggccggggggtcncgtgagactcctcctgtgccggtcctcgtggtatttaagtttaggatnatgccatacgaacgtcgggtcccgccaggcctccggaggggacgggcgtgggaggtgggtcgtcggtacttagtttaggtcggacgtaggtgggtaggcgtacgtaattattagtttagtgtaccgaacggtacccgtccccggttagggaacgggggttccccggtttaccgtaacccgtttaacgttttacccgaaggtaacgtaaacccgtaaacgtttacccggaaaacgaaaccgtaccggtcgttacgttaacgtcgttacgacgtaaaggtcgggacgacggtcccgtaggtaaccggtaaccgttaccggaacccggaacgtaaccccggttcccgtttaaccgttaagttttaaggtttacgggttaagggttaaaaacgggcggtaacggtaccgggttaagggtaaaccgggtaaccccggggggtaccccgggggtacccggtaacccggttaacccgggacccggtaaccggggtccgggggtaaccgggacgggggtaccggtccggttccggtaccccgg

SEQ ID NO: 53731 - DNA, 770 bp, Homo sapiens
  misc_feature: GYAE6OF01AQHZ1.29.78.H01.1.454.CMB.1.raw
  modified_base (222)..(222): a, c, t, g, unknown or other
  misc_feature (222)..(222): n is a, c, g, or t
  modified_base (248)..(248): a, c, t, g, unknown or other
  misc_feature (248)..(248): n is a, c, g, or t
tcagatagagtactcacgaccggtgctcgatttagtgtgagtagtttgggtttgggtctgagagaggagtccacccctgggatcttcaggtgttttcatttggtgatcaggacggaacagagagaactcaccatggagtttgggctgagcgtggtctttttcttgtggcttaattttaaaaggtgtccagtgtgacgtgcagttggtggagtcgtgggggcnccgtggggtacgggccgggggggtcncgtgagactctcctggtcgcggcctgtgggtaatttaaggttttaggagtcatgccatgaacgtcgggtcccgcacggctccgaggggagggtcgtgggtagtgggtctcggcttagttagtggctaggtggtggctctaagttatagttatgacacgaccgcccgtttaaggaacggggtcccggtttacaacccgttagttttacccgaaggtaacgtaacgtaaacgtttaccggaaaacgaaccgaccggtacgttaggttacctacgtacggtacctaaaggttgggaacgacgtccgtaggacgtaacgtacggaaaccgaccggtaccggtaccgtttacgttaattttgtttacggttaaacgggtttaaaggcggaacgttacggtaacgggggtaaaccggttaacccggggggacccccgggggttaaccgtaccgtttacccggaaaccccggttcggggtaccggggggaccgggaaccgggggtccggtccgggttccgggtaccccg

SEQ ID NO: 53732 - DNA, 977 bp, Homo sapiens
  misc_feature: GYAE6OF01BZU3S.29.78.H01.1.454.CMB.1.raw
tcagatagagtactcacgaccggtgctcgatttagtgtgagtagtttgggtttggggtccgagccatggtgcagactccccagagctctcctcctcctccactgcacagggtctctctcccagcctgtgctgactcaactccgccctctcgcctctcgccctcccgtggggacgtccgtcggtacaacggtccaccttgtactctggacgacgaggtacggacacgagcgacgctaccgcctacgtccgtcgttggactacgtcgacggcgaaggaccggaccgaacggtaccggacccggggtcccctttacgtttacgttaggaagtacggaaccgtacggttaaccaaaagtaagttacggtaagtcgggacgtacgtaccgaacggaagggaccggggaaacggggggaccgggtaccttacccgtaggtaccttaccggtctttccgactaccgtcctaccgacgtccgtaccggtcgggtaccctaggccgggtactaaccccgtacccttaacgaaccgtttaaccgtcccccgttcccgggtaccctttaccgggacggtttaccgtaacgggaacgggttacgtacggggaccggtttaccgtaacggtttaaaacccgtttcgtttaacccgtcggggttaaccccgtaacggggtttaccccgggttaacggggtcccgttaaccgggttaccgggttaccgtttaaaccggttttccgggggtaaacccggtttttcccgggggggtaacccccgggggaaaccccgggggttaaaccccgttacccgggggttacccgtaacccccgggggttttccgggtaacccgggtaacccccggtaaaccccgggggaacccgtaacccccgggggtaaacccccccaaccccggtttccggtttaccccggtttacccccggttaacccttttaccccccgtttcccccggggtttaaaacccccccc

SEQ ID NO: 53733 - DNA, 746 bp, Homo sapiens
  misc_feature: GYAE6OF01AJSG1.29.78.H01.1.454.CMB.1.raw
  modified_base (267)..(267): a, c, t, g, unknown or other
  misc_feature (267)..(267): n is a, c, g, or t
  modified_base (599)..(599): a, c, t, g, unknown or other
  misc_feature (599)..(599): n is a, c, g, or t
  modified_base (666)..(666): a, c, t, g, unknown or other
  misc_feature (666)..(666): n is a, c, g, or t
  modified_base (735)..(735): a, c, t, g, unknown or other
  misc_feature (735)..(735): n is a, c, g, or t
tcagatagagtactcacgaccggtgctcgatttagtgtgagtagtttgggtttggggtctgagagaggagtccacccctgggatcttcaggtgttttcatttggtgatcaggacggaacagagagaactcaccatggaggtttgggctgagcgtggtctttttcttggtggcttaagttttaaaaggtgtccagtgtgacgtggcaggtttgggtaggtacggtcgtggggggccgccgttggggtaccggggcccggggggggtcncgtggagtactccgtccgtggtcggccggtcctcgtagggtaacttttaaggtttacggacgttcagtcgaccagtacggaacgttcgggtcccgcgagggcctccgtaagggggaacgggtcgtagggtaggtcgggtacctggtaccgttaagtttaggcgggtctaagggttcggggtcgtacgtcgttaagtaactttagttacgtgacgtacggcccggttccgtaggaaccggggttccctttaccaacgttcgtttacccgaggtaacaccgtaagttacgaacgaccgtacgtctagttgtaccgagaacaaacgggtggaacnggtacttcggaagtaccgtacggaaccgtcgtacggaccgtttactagtttacgtcggaagtacggngcgtagacgggtaaccgtccgggccgaccgttacgacggcccacggggttacggcccgtaaggggtcgngtcggtccccg

SEQ ID NO: 53734 - DNA, 723 bp, Homo sapiens
  misc_feature: GYAE6OF01D4CD4.29.78.H01.1.454.CMB.1.raw
  modified_base (722)..(722): a, c, t, g, unknown or other
  misc_feature (722)..(722): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggtagtcatgccatgaactgggtccgccacggctccagggaaggggcgtggaggtgggtcgtcggctattagtggcagtggtggcgctatatattatgcagacgccctgaagggccggttcaccattttccagagacaattcgaagaacacgctgtatctgcaaagtggagacgctgagacctcgacgaccgacggccgtcttattagttgtagttaaagggcgagtctaggaacgtaccgggggacccggggcccctacgttacgaccgacggtgggggaccgaagggggacccgtcgtcggtaccgacccggttctccctcgaaccgcccctcccgaaccggaacggggcccccttagttaccccggttcccctttaccccccggtcgggaccctacccccgtcctaaccgaaacgccgtacctaacccggttcggtcggggaccaacaccggtaccgaccggtccccggtcgggtactcccgggtaccgttacgggtaccgaaacggtacccgttccctttaccgaacgttacctttacgtactcggttacggacgggtccgggtcgcggtaaccgaagggttccccagttaactggcng

SEQ ID NO: 53735 - DNA, 876 bp, Homo sapiens
  misc_feature: GYAE6OF01CYY2Z.29.78.H01.1.454.CMB.1.raw
  modified_base (234)..(234): a, c, t, g, unknown or other
  misc_feature (234)..(234): n is a, c, g, or t
tcagatagagtactcacgaccggtgctcgatttagtgtgagtagtttgggtttggtggtctctctcccagcctgtgctgactcaatcgccctctgcctctgcctccctgggaggctcggtcaaggtcacctgtactctgagcagtggacacagcagctacgccatcgcttggcatcagcagaggccagacacgggccctgttactgatgacagtcaacaatgatggacagtcanagcgaaagggggcggatcccgtagactcgcttcgtctagtctccagccgttcgtcggggcctggacgccgtcctaacctacacgtaactcccggtccggtacctccgtaacgtcgtagggtaacgtaggtacggtacggtaccgttacggtaactttaacgtttacggttacgtaacccggtaacgggtaacccgggttaccgggggtacctaaccggggttttaccggtaaccctttaaggggttttaccccgggaaacgggggtttttaccccccggggtttaaaccccggggggaaaccccgggggttaaacccggttaaacggggtttcccccgggttaccgggttttacccgggggtaaccggtaaccccgtaaacccgggtaccccccgaaaacgggttaacccccccgtaaaccccggtttcgtttaacccgggttcccccgttaaaccgtttccccgggttttcccccttaccccccggttacccccgtttaccggtaaccggtttaaaacctttccccggttactttaacccggtaccgggttacggggaaccccgggttccgggttaaccgggcggttaaaaccccggaacgggggttcccctaaacggttaaggcccgggattaggtaccg

SEQ ID NO: 53736 - DNA, 944 bp, Homo sapiens
  misc_feature: GYAE6OF01BMAVU.29.78.H01.1.454.CMB.1.raw
  modified_base (251)..(251): a, c, t, g, unknown or other
  misc_feature (251)..(251): n is a, c, g, or t
tcagatagagtactcacgaccggtgctcgatttagtgtgagtagtttgggtttggggtctgagagaggagtccacccctgggatcttcaggttgttttcatttggtgatcaggacggaacagagagaactcaccatggagtttgggctgagctggtctttttcttgtggtcttaagttttaaaaggtgtccagtgtgacgtgcagttggtggagtcgtgggggcgccgtggggtaccgggccggggggtcncgtgagactcctccgtgtgccggtcctcgtggtaatttaaggttttaggagtcatcgacctagtacgaacgttcggggtcccgaccgacggtcctacccggaaggggggtaacgggggtcgtaggggtacgggtcggggttaccgttccgggtactttagtttaggtcgggtcgtagggttgggtcggccgtacttaagttaacttaagtttacgtcggaccgaacggaccccgtaccccggttaaggggtaaacccgggggttccccggtttaccctaacccgttaacgttttacccgaaaggtaacgtaaacctaaaacggtttaacccggaaaagaaacccgtacgtaccgttaaggtttactacgtacggtaacgtaaacggtagggtaacggtaaccgtcccggtaaggaacccggtaacccgttaacccggaaacccgggaaacccggttaaccccggggttaccccgtttaacgttttaacggttttaaacgttttaggggttaaacgggtttaaaaccggggccggttaaaccgggtaccggttaaacgggggtaaaacccgggtaccccgggggggtaaccccccggggaaccccgttaccgggtttaacccggacccgggtaaccggggtccggggggaacccggtaacggggggacccttccgggttaccgggtacccccgg

SEQ ID NO: 53737 - DNA, 653 bp, Homo sapiens
  misc_feature: GYAE6OF01BGTFT.29.78.H01.1.454.CMB.1.raw
  modified_base (649)..(649): a, c, t, g, unknown or other
  misc_feature (649)..(649): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtggtctcggctattagtggcagtggtggcgctatatattatgcagacgccctgaagggccggttcaccatttccagagacaattcgaagaacacgctgtatctgcaaatggagagcctgagactcgacgacacggccgtctattattggtagttaaaggcgagctaggaagtaccggggacccggggcccgacgttcggaccacgtcgggggccgagggggaccgcgtcgggtccaccgtcctcccgtcacgccctcccaaccgaacgggccctacgttcccggtcccttccccccgtcggcccctacccctccctacccgaacgaccgacctacccgtcggtcggggcacgacgccacggcccgtgggcctcggtcccgtcggtacgaacggtacctaccgttaccgtacgttacctcttacgtccgttaggacgggtccgggtaccgtcgggaccgtaacgggccgtacgagtcggntacg

SEQ ID NO: 53738 - DNA, 1058 bp, Homo sapiens
  misc_feature: GYAE6OF01E4U7H.29.78.H01.1.454.CMB.1.raw
  modified_base (250)..(250): a, c, t, g, unknown or other
  misc_feature (250)..(250): n is a, c, g, or t
tcagatagagtactcacgaccggtgctcgatttagtgtgagtagtttgggtttggggtctgagagaggagtccacccctgggatcttcaggtgttttcatttggtgatcaggacggaacagagagaactcaccatggagtttgggctgagctggtctttttcttgtggcttaattttaaaaggtgtccagtgtgacgtgcagttggtggaggtcgtgggggcgccgtggggtaccgggccgggggggtcncgtgacgacctcctcgtgcggccgtccgtcggtagttaagttttaaggttaggtcatgcgactagtaacgtacgggtccggtcccgaccggacggtcccggtaacggggaacggggggtacgggtcggggtagggtacggggttcgggttccggtcggttaacgttttaacgggttacgggtcggacggttaggggtcggggtcgggtaccgttaactttaaagttaagttttaacgtagtacggaccgtaacccgggtaccccgtacccggggtaacgggtaccccggggtttacccgtaacccgtaacctttaacccgtaacgtaacggtaacgtaaaccgttaaaccggaaacgtaaaccgaaccggttccgttacggtttaacttcgtaaccgggtaacgaaaacggtttaacgggaggtaaccggtacccgttaacggtaacggtaaacccgttacccgggaaaccccgggtaaccgggaaacccccggggttacccccgggttttaactttaaccgtttttttaaaagttttacgggggtttaaacgggtttttaaaaaacgggggaccccggtaggggttaacccggttaaaacgggggtaaaaacccgggggttaaccccggggggggttaaaacccccccgggggggtacccccccggtttaaccgggtttaacccggtaaaccccgggggaaacccccgggtttccgggggggggggtaaacccccgggtaaccccgggggggaaccggggggttcccctttaccccggggggtttaacccgggtaaccccccccggg

SEQ ID NO: 53739 - DNA, 842 bp, Homo sapiens
  misc_feature: GYAE6OF01DOOPL.29.78.H01.1.454.CMB.1.raw
  modified_base (170)..(170): a, c, t, g, unknown or other
  misc_feature (170)..(170): n is a, c, g, or t
  modified_base (840)..(840): a, c, t, g, unknown or other
  misc_feature (840)..(840): n is a, c, g, or t
tcagatagagtactcacgaccggtgctcgatttagtgtgagtagtttgggtttggggcgccgtgggtacgggccggggggtcgctgagactctcctgtgcggcctctggatttaagttttaggagtcatgccagtgaacgtcgggtccgcgaggctccgagggagggcgnggagtggtcgtcggcttagttagtggcgtaggtggtggcgtactattattattatcgacgacgaccgtccgtagggaacgggtcccgttaccaccttagtttccaagaacgaacgtaagttacgaaagaaccacgtcttagtactcgtagacgaaagtggagacgccgtagaacgacgtacggaacgaccgaccggtcgtttacgtatttagtaggttaacgttaacggcgagtcggtaaggtaacggtaaccggggacccgggtaccgtaccgttaacggaccccgtacgggtcgggaccgggtacggggaccgttcgtaccggtccctaccggttcctacccgttaccgaccgtccccggtaacccgaacccgggaaccggtcccgtaacccggtttcccggtttccccccgttcccccggtacggtaccccccttaacccctacccggtaaccgtaaacggcccgacccgttaccccggtcgggtacccgggacccaacggtacccgaccggtcccggccggttacgggcccgtaccggtccgttaacgggaaaccgttaacccggtaccgttaaccgttccgtaaaccgttaccgttaaccgtttaacgtcccggaaggggtacccggtccggggtataccgggacgtaaccgcgtacgaacgtgncg

SEQ ID NO: 53740 - DNA, 732 bp, Homo sapiens
  misc_feature: GYAE6OF01BGR23.29.78.H01.1.454.CMB.1.raw
  modified_base (186)..(186): a, c, t, g, unknown or other
  misc_feature (186)..(186): n is a, c, g, or t
  modified_base (266)..(266): a, c, t, g, unknown or other
  misc_feature (266)..(266): n is a, c, g, or t
  modified_base (731)..(731): a, c, t, g, unknown or other
  misc_feature (731)..(731): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgccaggctccagggaagggctggagtgggtctcggctattagnggcagtggtggcgctatatattatgcagacgcctgaacggcggttcacattccagagacaattcgaagacacgctgtatntgactaaaagtggaagacgcctgagacctcgacgacgacggcgtactattatgtagttaaaggcgagcgtggaagtacgggaccggggtcccacttcgacgacggtcggggccgagggggaccgcgtacggtccaccggttacctcccgttacgacggtccctaccgaacccggtaacggcccctaagttcccggttcctttcccccgtacgggcccctaacccgttcccctaccgaacgaccggtaccaaccccggttccggtcgggggaccaaccgaggacccgtaacgggtccccgtacggggtcgtcccgggtcccgttacgggtacccgtaaacgggtacccgttaaacccgtttcccggaaacgttacccttaccgttacgttacccggtagggtaaccgggtcccgggaacggttccgggaaccgtaccggggtaccctaaccgtaacgtaggacggng

SEQ ID NO: 53741 - DNA, 743 bp, Homo sapiens
  misc_feature: GYAE6OF01A2I5Q.29.78.H01.1.454.CMB.1.raw
  modified_base (739)..(739): a, c, t, g, unknown or other
  misc_feature (739)..(739): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaaagaacacgctgtatctgacaaagtgggagacgcctagacgacgtaccgaacgaccgaccggtccgtacttaatttacgtttgttaaggtttaaggacgtacggtcgtacggaacggtaccgggggaccccggggacccgtaacgtccgaccgtacggtcggggaccggacgggggccgcgtcggtaccgtaccgtctcccgtacgaccgtcccctaccgaacccgacggggcccctaggttcccggttccccttcccccggcgtaccccctacccttcccgtaaccgaaacgcctaccgtacccgtcggggttacgggaccaacgtacgacccgacggtccccgtagggtccctcgggtcccgtttaggaccgtaaccggtacccttaccttaccgtaacgttacccttaccgttacgttaccggagggtacggtcccggtacggtagggaacccggaagggtccaaccgtaagtccggntacg

SEQ ID NO: 53742 - DNA, 652 bp, Homo sapiens
  misc_feature: GYAE6OF01CMP2T.29.78.H01.1.454.CMB.1.raw
  modified_base (274)..(274): a, c, t, g, unknown or other
  misc_feature (274)..(274): n is a, c, g, or t
  modified_base (612)..(612): a, c, t, g, unknown or other
  misc_feature (612)..(612): n is a, c, g, or t
  modified_base (648)..(648): a, c, t, g, unknown or other
  misc_feature (648)..(648): n is a, c, g, or t
  modified_base (652)..(652): a, c, t, g, unknown or other
  misc_feature (652)..(652): n is a, c, g, or t
tcagatagagtactcacgaccggtgctcgatttagtgtgagtagtttgggtttggtggtctctctcccagcctgtgctgactcaatcgccctctgcctctgcctccctgggaggctcggtcaaggtcacctgtactctgagcagtggacacagcagctacgccatcgcttggcatcagcagaggccagacaccgggcctcgttacttgatgacagtacaacatgatggcagtcacaggcgaagggggacgatcccgtgatcgcttctcagtccncagcctcgtcggacctggcgacgtcctacctccaactaacttcccgcccgggtcctccgtagttccgtaggaaggtacgtggaacgggtctacggtaactttacgtttaccgtacgttaccgacggtaacccggttgggggactaccgtgggtacctaagtttccgaacgggttccgttacgggaacccggggaactacgggtccgaccgttcggtacgtaccgaccgccgaacgaccccaacctacgttcgtacctacgttccgttaccgttccccaccccgttactcccaacgtttacctaccgtacgtcccgttgggacccggacggggttcccnccggggaaacctacgggacccgtagtaagttaccgnagtn

SEQ ID NO: 53743 - DNA, 817 bp, Homo sapiens
  misc_feature: GYAE6OF01DJ0P4.29.78.H01.1.454.CMB.1.raw
  modified_base (144)..(144): a, c, t, g, unknown or other
  misc_feature (144)..(144): n is a, c, g, or t
  modified_base (813)..(813): a, c, t, g, unknown or other
  misc_feature (813)..(813): n is a, c, g, or t
tcagatagagtactcacgaccggtgctcgatttagtgtgagtagtttgggtttggggcgcctgggtacggccgggggggtcgctgagactctcctgtgcggcctctggattaagttttaggagtcatgccatgaactgggtccnccgaggctccgagggaagggctggagtgggtctcggctattagtggcagtggtggcgctatatattatgcaggaccgcccgtaggaacgggtccgttacacctatttcccaagacgaacaacgttacggaaacgaaccgacgtcttgtactctcgacaaagtggaagacgcctaggacgacgtcgacgacgaccggccgtctatttagtgtagtaaggcgagtcgtaggaacgtaccggggaccgggcctacgttacgaccgtaacggtcggggaccggaggggcctacggtcggtacctaccggttcctccctacgacgtccctaccgaaccggtaaccgggcccctaacggttcccggtttcccccgttcccccggtacgggacccccttaacccccgttacccgtaaccgaaacggttacccgacccgtaacccggttccggggacgggggaaccaacccggacgtacccgacccgggtccccgggttaccggggccgttacccgggtacccggtttaccgggtaacccggtaaacccggttaccgttaaccccgtttacccgtaaaccggttacccttacgttaaccgttccggtacgggtacggggtccccggggtacggtacgggaacccgggaaacgggtccccgtaagaacggttaacggngacg

SEQ ID NO: 53744 - DNA, 697 bp, Homo sapiens
  misc_feature: GYAE6OF01CZ5XQ.29.78.H01.1.454.CMB.1.raw
tcagatagagtactcacgaccggtgctcgatttagtgtgagtagtttgggtttggggtccgagccatggtgcagactccccagagctctcctcctcctccactgcacagggtctctcctcccagcctgtgctgactcaatccgccctctcgcctctcgccctccgtgggacggcgtcggtacaaggtcctacctgtactctagagcaggtggacacgagcacgacctacgccatcgacgtcggacatcagcaggacgccaaggaccgtaccgggtcccttacggtttaccttagactcgaacctaagtacaaaacgtaagtgacgtaggactaaggtcaaccggagggaaccgggtaacggggggaccggtaccttccggtacgtcgttccggtccttacgtacgtaaccgtccgtaacccgcgtccgttccggtcggggtcctaggtccggtaccctacccgtacccttaacgaaccgtaccgtcccgtcccggtcccttaccgaggtcgtacggaggtacgtggacggtctacgtacttagttaccgtacgtcgacgtaccgggcggtcacgtgcttaggtccgtaagggtccttaccggggaccggtacctacgtcccgtcgtccggtccgtacgaacccggccgacccgacccgaacccgtagtaccgtccgacccgttcctccgtccccccg

SEQ ID NO: 53745 - DNA, 924 bp, Homo sapiens
  misc_feature: GYAE6OF01CC82G.29.78.H01.1.454.CMB.1.raw
  modified_base (161)..(161): a, c, t, g, unknown or other
  misc_feature (161)..(161): n is a, c, g, or t
  modified_base (187)..(187): a, c, t, g, unknown or other
  misc_feature (187)..(187): n is a, c, g, or t
  modified_base (224)..(224): a, c, t, g, unknown or other
  misc_feature (224)..(224): n is a, c, g, or t
  modified_base (249)..(249): a, c, t, g, unknown or other
  misc_feature (249)..(249): n is a, c, g, or t
  modified_base (786)..(786): a, c, t, g, unknown or other
  misc_feature (786)..(786): n is a, c, g, or t
tcagatagagtactcacgaccggtgctcgatttagtgtgagtagtttgggtttggggggaagaggaagactgacggtccacccctgggatcttcaggtgttttcatttggtgatcaggacggaacagagagaactcaccatggagtttgggctgagcgtgngttttctaggtgctaatttaaaggtntccagtgtgacgtgcagttggtggagtcgtgggggcncgtggggtacgggccgggggggtcncgtgagtactctccgtgtcggcggtcccttgtaggtaatttaaggttttaggagtctagtcgaccattaggaaccgttcggggcccgaccgtaggcctaccggagggggaacgggggtctaggggtaggtcggggtccgtacgggtcttaagttacgggtcgggtccgtaagggttgggtacggtcccggtagtttaaactttaagtttaacgtttaaggttcggaacgacggtaaccccggtccccggttaaggggtaaacccgggggttccccgtttaaccgtaaccccggtttaacttttaccccgggaagttaaacggtaacccgttaaacggtttaccggaaaaagtaaaccctccggggtaacctttagggtttaaccgtccgttaacgggaaccttaaaaacggggttggggaacccgtaaccggtccccgtaaggtaaccggttaacccggaccggtaaccgaacccgggtaccccgggttccgttaaccttaagttttaacgttaggggtttacggttaaaccggggnggtaccggttacggtaagggtaaaccgggggttaaccccggggaccccgggtaccccgtttaggtaccccggaaaccggtcccggggtacggggaccccgggtaaacgggggtccccttacggtccggttaccccggg

SEQ ID NO: 53746 - DNA, 768 bp, Homo sapiens
  misc_feature: GYAE6OF01EW0K6.29.78.H01.1.454.CMB.1.raw
  modified_base (764)..(764): a, c, t, g, unknown or other
  misc_feature (764)..(764): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccgaggggaaggggctggagtgggtctcggctattagtggcagtggtggcgctatatattatgcagacgccctgaacgggccggttcaccatttccagagacaattcgaagaacacgctagtatctgacaaaagtggagagcctgagactcgacgacacggccgtctattacgttgtagttaaaggcgagcgtaggaagtaccgggggaccgggcccgtacgttacgaccacgtcgggggaccgagggggaccgcgtcgggtaccacccgttcgtcccgtaccgacggtacccctacccgaacccggaaaccggggtcccctaacggttccccgggttacccctttcccccccgtcgggtaccccttaaccccccgtaccccttacccgaaacggaccgacccgtaacccgttccgggttacgggggaccctaaccgacggacccgtaacggcccccggttaggggccctcgggtacccgttacgggtaccgtaaacggtacccttaaccgtttaccccgaacggtttaccctaccgtttaacgttcccgttagggaaccggtccggggtaccgttacgggacccgttaaacggggccgtacgaacggttgntacg

SEQ ID NO: 53747 - DNA, 580 bp, Homo sapiens
  misc_feature: GYAE6OF01BRGFA.29.78.H01.1.454.CMB.1.raw
  modified_base (319)..(319): a, c, t, g, unknown or other
  misc_feature (319)..(319): n is a, c, g, or t
  modified_base (565)..(565): a, c, t, g, unknown or other
  misc_feature (565)..(565): n is a, c, g, or t
tcagatagagtactcacgaccggtgctcgatttagtgtgagtagtttgggtttggggtccgagccatggtgcagactccccagagctctcctcctcctccactgcacagggtctctctcccagcctgtgctgactcaatcgccctctgcctctgcctccctgggaggctcggtcaaggtcacctgtactctgagcagtggacacagcagctacgccatcgcttggcatcagcagagccagacacgggccctgttacttgatgacagtacaacaatgaatggcagtcacgagcgaagggggcgatccctggatcgcttcncagtctccagctcgtcgggccttgaacgccgctacctcaacaacttcctccggacccttccgaagttccgaggtaacggatcgggaacgtccgttagaacgtttacttaacgtcgtacaacggccgtggggacctacggtcggactattcgacggttcgtaccgggaaccgggacctaaggtcccaaccggtggtaccggacacggaccctaacgggaccctaacccgtcgttcgtaacctacctntccgggttacccccc

SEQ ID NO: 53748 - DNA, 883 bp, Homo sapiens
  misc_feature: GYAE6OF01BXUVZ.29.78.H01.1.454.CMB.1.raw
  modified_base (193)..(193): a, c, t, g, unknown or other
  misc_feature (193)..(193): n is a, c, g, or t
tcagatagagtactcacgaccggtgctcgatttagtgtgagtagtttgggtttgggtccgagccatggtgcagactccccagagctctcctcctcctccactgcacagggtctctctcccagcctgtgctcgactcaatccgccctctgaccttctgcctcccgtgggagctcggtcaaggtcacctgtactntgagcaggtaggacacacgcagtctacgccagtccgtcttcggctaattaccgaagactaacggacggacccaacggacccgtaccggggtaccccttacggttacgttcggaagttcgaacctacggtaccaaaacctaagttaggtaaggttcgggacctaaccggtcgaaaccggtaggtaccggaaacggggggtacggtacctcccgtagggtactccggtacttccgacgtacgttacctcggtaacggtcctttaccgggtcggtccttacgggaaccgtcccgtaccttaccctacgacgtaaccgtttcccggacccggtaccctccggttaacggttcgtacggtaaagggtagttaaccgggtacggtacgtttaacgttacctttaagtttaaccggttcggttaaacccgacgggtttaaccgggtaaccggggttctaaacccgggtttcggtacgttttaccggttaccggaccgggggttttaacccgtacccgggggggtaaaaccccggtaacgttaaaaccggggtttaccccgggttaacccgggttcccgggttaccgggttaacccgaaacccggtcccccggtaaacccgggtaccccctaaaacccccgggtttgtaacccggttacccttcccgggtttaccccttaaccccgtttacccccccg

SEQ ID NO: 53749 - DNA, 703 bp, Homo sapiens
  misc_feature: GYAE6OF01CSVX2.29.78.H01.1.454.CMB.1.raw
  modified_base (698)..(698): a, c, t, g, unknown or other
  misc_feature (698)..(698): n is a, c, g, or t
tcagatagagtactcacgaccggtgctcgatttagtgtgagtagtttgggtttgggggcgccgtgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcactatttccagagacaattcgaagaacacgctgtatctgacaaatggagagcctgagactcgacgacaccggcgtctattatgtagttaaggcgagctaggaataccggggacccgggccgtacgttcgaacccacggtggggaccgaggggacgcgtcggtccaccgtcctccgtcgaacggccctaccaacgaaccggggccctaagtccggtcccttcccccgtcgggcccaccccttccgtaccaaagaccgaccaacccgtcggtcgggggaccaaccgtacgccgaaccggtccccgtaggggtcccgttccgtcccgttacgggttaccgaaaccgggtaccttaacccgtttacccgtaaacggttacccttaacgttaaccgtttacccggtaggaccgggtccgggggtacccgttcggggaacggaaccgggccgttaacgacgtaaagngtacg

SEQ ID NO: 53750 - DNA, 651 bp, Homo sapiens
  misc_feature: GYAE6OF01CQL03.29.78.H01.1.454.CMB.1.raw
  modified_base (228)..(228): a, c, t, g, unknown or other
  misc_feature (228)..(228): n is a, c, g, or t
  modified_base (415)..(415): a, c, t, g, unknown or other
  misc_feature (415)..(415): n is a, c, g, or t
  modified_base (464)..(464): a, c, t, g, unknown or other
  misc_feature (464)..(464): n is a, c, g, or t
  modified_base (646)..(646): a, c, t, g, unknown or other
  misc_feature (646)..(646): n is a, c, g, or t
  modified_base (649)..(650): a, c, t, g, unknown or other
  misc_feature (649)..(650): n is a, c, g, or t
tcagatagagtactcacgaccggtgctcgatttagtgtgagtagtttgggtttggtggtctctctcccagcctgtgctgactcaatccgccctctgcctctcgccctcccgtgggaggctcggtcaaggtcacctgtactctgagcagtggacacagcagctacgcctatcgcttggcatcagcaggacgccagacgaccgggtcctgttactgatgacagtacaaanatgagtcggcagtacaacgaggacgggaaacgggggcggactccgtagactcgtccttactcgacggttcctcgagtccgtccggtacgggtcctacggccgtaccgtacccttaacccactaaacctaaccgttccccgtccccgggtaccttacctaacggggttcgtacgggaaaggttaccgnggtaacggtcctaaggtaactttacgtacgtacgtacggacggtaccgngggtactacggtgtacgtacgttcggtaccgggttcggttaaccggggaccgggtaaccgtacggaccgtcccggtcggtccgaccacggacccaggaccccacgtgtcaccgtctcgtactccgcctcctacgtctacgtctctcggcgtcggaggcccggtgcgaccgcgggtacagtancgnng

SEQ ID NO: 53751 - DNA, 695 bp, Homo sapiens
  misc_feature: GYAE6OF01A9D35.29.78.H01.1.454.CMB.1.raw
  modified_base (243)..(243): a, c, t, g, unknown or other
  misc_feature (243)..(243): n is a, c, g, or t
  modified_base (461)..(461): a, c, t, g, unknown or other
  misc_feature (461)..(461): n is a, c, g, or t
tcagatagagtactcacgaccggtgctcgatttagtgtgagtagtttgggtttggggtccgagccatggtgcagacctccccagagctctcctcctccactgcacagggtctctcctcccagcctgtgctgactcaatccgccctctgccctctcgccctcccgtggggacggcttcggtacaaggtccaccctgtactctgagcgaggtcggacacgagccagcctacgccatcgctggctntcagcgaggacgaccacgaccgaccgggtcccttacgttacttgatacgactacgtacaaacgtagtgagtcggacacgtacacggacggacgggacggggaccgtactcccgtgtactccgtcttaccgctacgtccgtaccgtagtccgtacggtcggtacgtcggacgtaccgtaccttaacctacaacgtaccgtcccgtcccgtaccgtacgngttaccgagggtacgacggtacggtacggtactacgtactttacgtactcgtaccgtacggtacggacggtctacgtcggtacttcgttaccgggacggtttccggaacccggggacggtaccgtaacggtccgtaccggtacggtaccggtccgaaccccggtaccccggaaccgtccccgtaacccgtcgtacccgtaccgttacccttcccttccccgtaacccgtacccg

SEQ ID NO: 53752 - DNA, 750 bp, Homo sapiens
  misc_feature: GYAE6OF01D02YI.29.78.H01.1.454.CMB.1.raw
  modified_base (147)..(147): a, c, t, g, unknown or other
  misc_feature (147)..(147): n is a, c, g, or t
  modified_base (203)..(203): a, c, t, g, unknown or other
  misc_feature (203)..(203): n is a, c, g, or t
  modified_base (286)..(286): a, c, t, g, unknown or other
  misc_feature (286)..(286): n is a, c, g, or t
  modified_base (749)..(749): a, c, t, g, unknown or other
  misc_feature (749)..(749): n is a, c, g, or t
tcagatagagtactcacgaccggtgctcgatttagtgtgagtagtttgggtttgggggcgcctgggtacggccgggggggtcgctgagactctcctgtgcggcctctggatttaagttttaggagtcatgcccatgaactgggtccnccgaggctccgagggaagggctggagtgggtctcggactattagtggcaggttggnggcgactattattattatgcagaccgccctggaacgggccgttccacactttccagagactaattacgaaagaaccacgcgtntagtctgaacaaagtaggagaacgtccgtgaacgtacgtaccgaacgaccgaccggtccgttacttactttagttggtaaggttaacggcgagtacgtaggaaacggtaccggggacccgggtacccgtacgttaccggacccgtaaggtccggggaccgaacggggtacgtaccgttcggtacccgtacccgtcctccctaccgaccgtacccgtacccgaaccggtaccgggacccctacggttcccggttaccccttccccgtcggtacccctacccgtcccgtaaccgacgaccgtccgtaccgtaccggtcgggaccaccgagcccgacggtccgtacgggtcctccggttaccggtcggtaaaccggtaacgtaccgttacccgttacgtaccgtaccgttaccttacgtcgtcggaacgggtcggtaccgtaggacccgtaacggctagaagtganc

SEQ ID NO: 53753 - DNA, 779 bp, Homo sapiens
  misc_feature: GYAE6OF01CZBGP.29.78.H01.1.454.CMB.1.raw
  modified_base (216)..(216): a, c, t, g, unknown or other
  misc_feature (216)..(216): n is a, c, g, or t
  modified_base (741)..(741): a, c, t, g, unknown or other
  misc_feature (741)..(741): n is a, c, g, or t
  modified_base (777)..(777): a, c, t, g, unknown or other
  misc_feature (777)..(777): n is a, c, g, or t
tcagatagagtactcacgaccggtgctcgatttagtgtgagtagtttgggtttgggggcgcctgggtacggccgggggggtcgctgagactctcctgtgcggcctctggatttaagttttaggagtcatgccatgaactgggtccgccaggctccgaggggaagggctggagtgggtctcggctagttagtggcaggtggtggcgctatatattangcagacgccctaggaacgggccgttacacctatttccaagagaactaattacgaagaacacgtcttgtatcgtgactaagtaggagacgccgtagaacgaccgtacggaccgacgaccggtccgttattacgttagttaggttaagttaaacggcgagtcgtaagggaacggtaccggggacccgggtaccgtacgttcggaacccgtacggtccggggaccggaacggggaccgtcggtcggtaccgtaccgtaccctccgtcaccggtccctacccgaacccgaaccgggtccctaacggttccccggttcccttcccccgtacggccccttaacccctcccgtaacaaacggtccgaccctacccggttcgggtacggggccaacgtaccggaccgttaccgggccccgttacggggtcccttcgggtacccggagggttaaacccggtaccggtttaaccctacccgttttacgaaacccgttacgttcctaacggcggttccgggaacggtccgggggtntaacccggggaacgaaccggggtcaacgataccggncg

SEQ ID NO: 53754 - DNA, 879 bp, Homo sapiens
  misc_feature: GYAE6OF01EQ19X.29.78.H01.1.454.CMB.1.raw
  modified_base (510)..(510): a, c, t, g, unknown or other
  misc_feature (510)..(510): n is a, c, g, or t
tcagatagagtactcacgaccggtgctcgatttagtgtgagtagtttgggtttgggtctgagagaggagtcccacccctgggatcttcaggttgttttcatttggtgatcaggacggaacagagagaacctccaccagtggtaggtttgggctgagcgttggttcttttttcgttgtggtacttaaagtttttaaaaggtcgtaccagtgtggacgtgcgtaggttgggtggtagtcggtcgggggccgtccggtgggggtaccggggccgggggggtcgcgtcggagacttcctccgtggtcggccggtccttcgtaggttaagttttaaggttttaggtagtacagtcgacctagtacggtaaccggtccggggtcccgaccgacggtcccggtaaccgggtaacggggggaaggggtcggtggggtagggttccgggttcgtaccggtacgtttaggttacggtggcgtagggttgggtacgcgtactagttattacgtagtcgganaacggcccgtaccggtagggaacccgggttcccgtacctaacccgttacgtttacccgaagtaacgaactaacggttacaaaaccgtacgtaccgtagtttacgtactacgtaacggtaagaaacgggtggaacgtaaccggcctaacgggaaccgttaaccaaccgggaacccgtaccggtacccgggttacctttacgttaaagttttacgggttaagggttaaacggtaacggacggtacgtaccggggtaaaccggaaccggggttaaccccggggggaccccggtaccgttaacggtcccggaaacccgggttcggggacccgggtaccggggaacgggccctacgggttcccggtaaaccccg

SEQ ID NO: 53755 - DNA, 554 bp, Homo sapiens
  misc_feature: GYAE6OF01BIOO8.29.78.H01.1.454.CMB.1.raw
  modified_base (553)..(554): a, c, t, g, unknown or other
  misc_feature (553)..(554): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccggggcccgacttgaccacgtggggccagggggacgcgtggtcaccgtctcctcagcctccaccaacgggcccagtccggtccttccccctcggccaccctcctccaagacgccacctccgtcggggcacgacgcacgcccgtggctcgcctggtcaacggctactcacgtactctatctgcggcgggctcggcaacggcagatagnn

SEQ ID NO: 53756 - DNA, 617 bp, Homo sapiens
  misc_feature: GYAE6OF01BC1EP.29.78.H01.1.454.CMB.1.raw
  modified_base (437)..(437): a, c, t, g, unknown or other
  misc_feature (437)..(437): n is a, c, g, or t
  modified_base (615)..(616): a, c, t, g, unknown or other
  misc_feature (615)..(616): n is a, c, g, or t
tcagatagagtactcacgaccggtgctcgatttagtgtgagtagtttgggtttgggggcgcctgggtacggccggggggtcgctgagactctcctgtgcggcctctggatttaagttttaggagtcatgccatgaactgggtccgccaggctccagggaaggggctggagtgggtctcggctattagtggcagtggtggcgctatatattatgcagacgccctggaagggccggttcacctatttccagagacaattcgaagaacacgctgtatctgacaaatggagagcctgagactcggacgacgacggccgtctattagttgttaggttaaaggcgagcgtaggaacgtaccgggggaccggggacccgtacgttcggaccacggtcgggggccgaagggggaccgtcgtgggtcctaccggtcctcctcgacnccctaccgaccgaacgggccctagttccggtcccttcccccgtggcccctaccctcctaccgaacgacgcctaccgtcggtcggggaccacgcgcgacgccgtcgggctcgccgtggtacaacgtcctactctacgtactactactcgtgcggtcggcgtacgacgacggcagagtgnng

SEQ ID NO: 53757 - DNA, 669 bp, Homo sapiens
  misc_feature: GYAE6OF01DZC5T.29.78.H01.1.454.CMB.1.raw
  modified_base (667)..(667): a, c, t, g, unknown or other
  misc_feature (667)..(667): n is a, c, g, or t
  modified_base (669)..(669): a, c, t, g, unknown or other
  misc_feature (669)..(669): n is a, c, g, or t
tcagatagagtactcacgaccggtgctcgatttagtgtgagtagtttgggtttgggggcgcctggggtacggccgggggggtcgctgagactctcctgtgcggcctctggatttaagttttaggagtcatgccatgaactgggtccgccaggctccgaggggaaggggctgggagtgggtctcggctattagtggcagtggtggcgctatatattatgcagaccgccctggaaggggccggttccacctactttccaagacgactaattacgaaagaacacgctgtatctgacaaagtaggagacgctagagactacgacgacgacggccgtactattattggtagttaaggcgagcgtaggaacgtacggggacccggggtttttacccgacgttcgaccgacggtcggggaccggacgggggacgtcgtcggtccgtaccgtcctccgacgcgccctaccgaaccgaaccgggaccctacgttcccggttaccccttcccccgtacggcccctaccctaccctaccgaacgaccgacctacccgtcggtcggggaccacgacgccacgcccgtcgggcgtcgccgtcggacgaacgtaccttacctacctacgttacctactacgtcgtaggacggcgggcgtaggaccgacggacgacacgtgngn

SEQ ID NO: 53758 - DNA, 718 bp, Homo sapiens
  misc_feature: GYAE6OF01BG8ZF.29.78.H01.1.454.CMB.1.raw
  modified_base (714)..(714): a, c, t, g, unknown or other
  misc_feature (714)..(714): n is a, c, g, or t
tcagatagagtactcacgaccggtgctcgatttagtgtgagtagtttgggtttgggggcgcctgggtacggccggggggtcgctgagactctcctgtgcggcctctggatttaagttttaggagtcatgccatgaactgggtccgccaggctccgagggaaggggctggagtgggtctcggctattagtggcagtggtggcgctatatattatgcagaccgccctggaacgggtccggttcacctatttccagagactaattcgaagaacacgctgtatctagacaaagtggagagcctgaagactcgacgacgaccggccgtacttattagttgtaggttaaacggcgagcgtaggaacgtacggggacccgggccgtagtcgaccgacggtcggggacgacggggacgtcgtcggtccaccggtctccgtcgacgtccctacccgaccgaaccgggtaccctaccggttcccggttaccccttcccccgtacggtaccccctaccccgttaccgtacccaaacggtacccgtaacccgttccgggacggggacctaaccgcgaccacccggtcccgtacgggccttaccggcccgtttacggaccgtaaacgggtacccttaccgttacccgtagttacccgttaccttacgttccgtgggaaccgggtccgggtcgttacgggacggaacgggtccgaacgttaagacgcngtcg

SEQ ID NO: 53759 - DNA, 664 bp, Homo sapiens
  misc_feature: GYAE6OF01BBTSG.29.78.H01.1.454.CMB.1.raw
  modified_base (298)..(298): a, c, t, g, unknown or other
  misc_feature (298)..(298): n is a, c, g, or t
tcagatagagtactcacgaccggtgctcgatttagtgtgagtagtttgggtttgggggcgcctgggtacggccgggggggtcgctgagactctcctgtgcggcctctggatttaagttttaggagtcatgccatgaactgggtccgccaggctccgagggaaggggctggagtgggtctcggctagttagtggcagtggtggcgctatatattatgcagacgccctgaagggccgttacaccatttccagagacaattcgaagaacacgctgtatctgacaaagtggagagcctgganacgtcgacgacacggccgtctattattgtagttaaaggcgagcgtaggaaacgtaccggggacccggggacccgtacgttcgaccgacggtggggacccgagggggacgcgtcggtccaccgtctccgtcacgccctaccacgacggcccacgtccgtccttccccgtcggccctacccgtcctaccaacgacgccacctcggtacggggcaaccgacgccgacggtccccgtacgggtccgtccggtcccgttacgggttaccaaaccggggttaccttacccggttaccctaaccgttaaccgttcttacgtccgtaggaccgggtcgggcgttacgggacgtaacggccggatagtaggctag

SEQ ID NO: 53760 - DNA, 585 bp, Homo sapiens
  misc_feature: GYAE6OF01CN1FE.29.78.H01.1.454.CMB.1.raw
  modified_base (584)..(585): a, c, t, g, unknown or other
  misc_feature (584)..(585): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaaatggagagcctgagactcgacgacacggccgtctattattgtagttaaaggcgagctaggaatacggggaccggggcccgacttcgaccacgtggggaccagggggacgcgtcggtcaccgtctcctcacgcctccaaccgaacgggcccacgtccggtcctttccccctcggccctaccctcctaccaacgacgccaccgtcgtcggggcacgacgcacgcccgtggcctcgcctggtacaacggtacctacgttccacgtactctactcgtgacggtcgggcgtggacgacggcgagactagnn

SEQ ID NO: 53761 - DNA, 785 bp, Homo sapiens
  misc_feature: GYAE6OF01AU26V.29.78.H01.1.454.CMB.1.raw
  modified_base (208)..(208): a, c, t, g, unknown or other
  misc_feature (208)..(208): n is a, c, g, or t
  modified_base (638)..(638): a, c, t, g, unknown or other
  misc_feature (638)..(638): n is a, c, g, or t
  modified_base (781)..(781): a, c, t, g, unknown or other
  misc_feature (781)..(781): n is a, c, g, or t
tcagatagagtactcacgaccggtgctcgatttagtgtgagtagtttgggtttgggggcgccgtgggtacggccgggggggtcgctgagactcctcctgtgccggcctctggacttaagtttaggagtcatgccatgactgggtccgccaggctccgagggaggggtcgtggaggtgggtctcggactattagtggcagtggtggcgntagtatattatgcagacgcccgtaggaacgggtccggttcacctatttccgagagactaattacgaaacgaacacggctgtatcgtgacaaagtggaagcgtcctaggacgaactccggaagaccgaccgggccgtacgttacttagtttggtacggtttaaaacgggcgtacggacggtacggtaaacggtaacccgggggacccggggtaccccggtaagtaccggtaaccgacgggttaccggggaccgggtaacgggggtacgtcggtcgggtacccgtaccgttcccgtacccgtacgaccgtacccgtacccgtaaccgtaacccggggccttaaccggtcccgggttacccctcccccgttagccccgtaacccttcccgtaaccgaacgcgaccgtacccgtacgggtcgggacaccgtacncgtccggacgttcgggcgttcggaccgttacggtacgtaaacggtccttaaccggttccctaacgttcccggttaactacggttcggtcgtaacggggtcggtaccgtaccgggacgtaaaccggggctacggaacgttacgngtcg

SEQ ID NO: 53762 - DNA, 732 bp, Homo sapiens
  misc_feature: GYAE6OF01AR8R3.29.78.H01.1.454.CMB.1.raw
  modified_base (187)..(187): a, c, t, g, unknown or other
  misc_feature (187)..(187): n is a, c, g, or t
  modified_base (315)..(315): a, c, t, g, unknown or other
  misc_feature (315)..(315): n is a, c, g, or t
  modified_base (363)..(363): a, c, t, g, unknown or other
  misc_feature (363)..(363): n is a, c, g, or t
  modified_base (678)..(678): a, c, t, g, unknown or other
  misc_feature (678)..(678): n is a, c, g, or t
tcagatagagtactcacgaccggtgctcgatttagtgtgagtagtttgggtttggggtctgagagaggagtccacccctgggatcttcaggtgttttcatttggtgatcaggacggaacagagagaactcaccatggtagtttgggctgagcggtgtcgtttctaggtcggctaagtttaaaaggtntcagtgtgagtgcagttggtggagtcgtggggcgccgtgggtcgggccggggggtcgctgagctctcctgtcgcggcctgtggtatttaaggtttaggagtctatgcctatacgacgtcggtcccgcnggcctacggagggagggcgaggtggtggtcgtcgacgtattggcgagngtgggtcgcgtactatattactatcgcgaagccgtccgtaggaacggggtccctttaccgacgtacgtttcccgaagaccgtaactaacgttaacggaaacgaacctcggtaaccttgttacttacgagtaacggttaaatcggggaaactcgtacccgttaggacgacccgttaacgacggtaaccggcccgtccgttaagtttatttagtacgggttaacggtaacgacgggtattacggtaacgggtaaaccgggtacccgggggtaacccggggtcccttaaaccggtttacggggaccccttacccgggnggggggttaaaccccgggaaaggggtcccgtccgggtttaacccgggtccccgg

SEQ ID NO: 53763 - DNA, 731 bp, Homo sapiens
  misc_feature: GYAE6OF01BTKZK.29.78.H01.1.454.CMB.1.raw
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccaggggaagggctggaggtgggtctcgggctattagtggcagtggtggcgctatatattatgcagaccgcccgtggaacgggccggtttacacctatttcccaagtacgaactaaacgttcggaaaagaaccgacggtcttaggtaacttctggaccaaaagtggacgagcccttggacgactcggaccgaacaccgggtcctctaatttgttagtaggttaaacggcgagcgtaggaacgtaccggggtcccgggaccctaggttcgaccgacggtcggggccgagggggacctcgtggtacctacccggtcctccgtaccgacgccctaccgaccgaaccgggcccgtacgtcccgttccccgttacccccgtcggtccccgtaccctcccgtaccaaagccgaccgtaccgtcgggtaccggggcctaacggcgtaccgacggcccgtacgggcctcggtccggttcgtaacccgtaacggaccttcccgtaccgttaacgttccttaaccgtgtccgttaacgggcgggccggggttaccagggacccggtaacggtccggactacgtagcgag

SEQ ID NO: 53764 - DNA, 783 bp, Homo sapiens
  misc_feature: GYAE6OF01DD766.29.78.H01.1.454.CMB.1.raw
  modified_base (217)..(217): a, c, t, g, unknown or other
  misc_feature (217)..(217): n is a, c, g, or t
  modified_base (255)..(255): a, c, t, g, unknown or other
  misc_feature (255)..(255): n is a, c, g, or t
tcagatagagtactcacgaccggtgctcgatttagtgtgagtagtttgggtttggggtctgagagaggagtcccacccctgggatcttcaggttgttttcatttggtgatcaggacggaacagagagaactcaccatggagtttgggctgagcgtggtctttttcttggtggtcttaagttttaaaaggtgtacctagtgtgacgtgcgtagttggnggagtcgtggggcgccgtggggtacgggccgggggtcncgtgagctctctgtgcgctgtggtattagttgatcatgcagtgacgtcggtccgcgacgccgtacggaaggggaacggggtcgtagggtaggttcggtcgtacggtacgttaagttacggtggcgtagggtggtcggacgtacttaataatttagttaagtgacgacgtaccgcccgtagggaacgggtcccggttaccaaaccgttcgtttaccgaaggtacgtaacgtaaacgttaccggaaacgaaccgtaacgtccgttaagttacgtaccgttagaaaccgttaaagtagggaacgtacggtcccgtaaggtaacgtaaccgacggtacccgaaccggtacccggtaccgttactttaaaggttacgttaggttaacggttaacggcgtaaggtaccggtaaagggtaaaccgggtaccccgggggtaaaccccggggcccgttaaccggtaccgggtaacccgtacggggtaccggggtacccgggaaagggggtcccgttaccgggtccggtaccccccgg

SEQ ID NO: 53765 - DNA, 584 bp, Homo sapiens
  misc_feature: GYAE6OF01BAI6W.29.78.H01.1.454.CMB.1.raw
  modified_base (576)..(576): a, c, t, g, unknown or other
  misc_feature (576)..(576): n is a, c, g, or t
  modified_base (583)..(583): a, c, t, g, unknown or other
  misc_feature (583)..(583): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtagttaaaggcgagctggaatacggggaccggggcccgacttgaccacgtcggggccagggggacgctggtcaccgtctcctcacgcctccaccgaacgggcccactccggtccttcccccgtggcccaccctccctccaacgacgccacctcgtcggggccacgcgccacgcccgtgggcctcggtccgtggtacaaggtacctaccttccagttacctactactctggacggcgggcgtcggacgtaacggcganactagcng

SEQ ID NO: 53766 - DNA, 625 bp, Homo sapiens
  misc_feature: GYAE6OF01A7YRA.29.78.H01.1.454.CMB.1.raw
  modified_base (621)..(621): a, c, t, g, unknown or other
  misc_feature (621)..(621): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtagttaaaggcgagctggaatacggggaccgggcccgacgttcgaccacgtggggccgaggggacgcgtggtccaccgtctcctcacgcctccaccgaacgggcccacgtccggtccttcccccgtcggcccacccctccctccaacgacgcctaccgtccgtcggggccacgacgccacgccccgtcgggcctcggcccgttggtaccgtaacggtaccttaccgttcccgtaacgttaccttcttactccgttaggacgggccggggtcgtcgggaccggaacgggaccgagtaacgtgngacg

SEQ ID NO: 53767 - DNA, 772 bp, Homo sapiens
  misc_feature: GYAE6OF01A7EP9.29.78.H01.1.454.CMB.1.raw
  modified_base (771)..(771): a, c, t, g, unknown or other
  misc_feature (771)..(771): n is a, c, g, or t
tcagatagagtactcacgaccggtgctcgatttagtgtgagtagtttgggtttgggggcgcctgggtacggccgggggggtcgctgagactctcctgtgcggcctctggatttaagttttaggagtcatgccatgaactgggtccgccaggctccgagggaaggggctggagtgggtctcggctattagtggcaggtggtggcgctatatattatgcagaccgccctggaacgggccgttcacctatttccagagactaagttcgaaagaacacgctgtatctagacaaaatggagacgtcctagagtacgtcgaacgacgtacccggccgttactaagtttattggttaaggttaaacgggcgagcgttaggaaacggtccggggacccgggtcccgtaattcggaaccgtacggtcgggggaccaacggggggaccgtacggttcggtacctacccggtctccctacgacgccctacccgaaccgaacgggcccctaacgttcccggttcccttcccccggtacggtacccctaccccgtccttaaccgaaccggacgaccccttaccgtccggtacgggggacccaacgaccgacgacccggtcccggtacgggtccgtacgtcccgggttaaggtaccgtaaacccgggtacttaaccccgtttacgtacgttaacccttacgttacgtaacccggtgggaaccgggtcccgggttacgtacgggaaaccccgaaacgggggtccgtaacctaacggttaagtccgng

SEQ ID NO: 53768 - DNA, 948 bp, Homo sapiens
  misc_feature: GYAE6OF01D7KDN.29.78.H01.1.454.CMB.1.raw
  modified_base (149)..(149): a, c, t, g, unknown or other
  misc_feature (149)..(149): n is a, c, g, or t
  modified_base (944)..(944): a, c, t, g, unknown or other
  misc_feature (944)..(944): n is a, c, g, or t
tcagatagagtactcacgaccggtgctcgatttagtgtgagtagtttgggtttgggggcgcctggggtacgggccggggggtcgctgagactctcctgtgcggcctcgtggattaagtttaggagtcatgccatgaacgtcggggtccnccgaggctccgaggggaaggggctggaggtgggtctcggcttagttagtggctaggtggtggcgctatattattatcgcagaccgcccgtggaacgggtccgttaccaaccttatttaccgaagaagaactaacgttacgaaacgaacgacgtaccgttagtacttacgtagaactaaaggtagggaacgaccgtccgttaggaaccgacgtaccggaaccggaacccgtaccgggtaccgtttaccttaagttttaaggtttagggttaacgggtttaaaacggggcgtaacggtacggttaacgggtaaaccgggtaaccccggggggaccccggggtacccgtaacggttccggaacccgtacggggtaccggggacccggacgggggccgtaccggttcgggtaccctaccccggttccgttaccccgtacgacccggtccctaacccggaacccgtaacccgggacccgtacgttccccggtttaccccttcccccggacggtaccccctacccgtacccgtaaccgaaccggtaccgaccggttaccccggttaccggggtaccgggggaccctaccgggtaaccggacccggtacccggccccgggttacggtcccggttaccggggttccccggtaaccggttaaccggtaacccggtttaaccccttaccggttaccccgtaacggtttacccgttaacccgttaccggttccggtacggggtaccgggttcccggggttaccggacgggtaacccggaaccgggtttcgaaacccggttagccgngtcg

SEQ ID NO: 53769 - DNA, 706 bp, Homo sapiens
  misc_feature: GYAE6OF01AZVST.29.78.H01.1.454.CMB.1.raw
  modified_base (294)..(294): a, c, t, g, unknown or other
  misc_feature (294)..(294): n is a, c, g, or t
  modified_base (413)..(413): a, c, t, g, unknown or other
  misc_feature (413)..(413): n is a, c, g, or t
tcagatagagtactcacgaccggtgctcgatttagtgtgagtagtttgggtttgggggcgcctgggtacggccgggggggtcgctgagactctcctgtgcggcctctggatttaagttttaggagtcatgccatgaactgggtccgccaggctccgaggggaaggggctggagtgggtctcggctattagtggcaggtggtggcgctatatattatgcagaccgccctaggaacgggccgttacacctatttccagagacaattcgaagaacacgctgtatctgacaaatgganagcctgagacgtcgacgacgcggtccgtacttattagttggtagttaaaggcgagcgtagggaacgtaccggggacccgggcccgtagttcgaccgacggtcggggaccgagggggacncgtcgggtccaccgtcctcctcgacgtccctaccgaaccgacgggccctacgtcccggttcccttcccccgtcggtacccctaccccgtccctaccgaacgaccgaccctacccggtccggtacggggaccaccgacgaccgtaccggcccggtacgggccgtccggtcccgttacgggtaccgtaacggtacccttaaccgttacccgtaacgttacccgtaccgttacgttccgtaggtacgggcccgggaccgtacgggaccggtaacgggaccgaacgacgtagcgacg

SEQ ID NO: 53770 - DNA, 777 bp, Homo sapiens
  misc_feature: GYAE6OF01CVODC.29.78.H01.1.454.CMB.1.raw
  modified_base (774)..(774): a, c, t, g, unknown or other
  misc_feature (774)..(774): n is a, c, g, or t
tcagatagagtactcacgaccggtgctcgatttagtgtgagtagtttgggtttgggggcgcctgggtacggccgggggggtcgctgagactctcctgtgcggcctctggatttaagttttaggagtcatgccatgaactgggtccgccaggctccgagggaaggggctgggagtgggtctcggctattagtggcagtggtggcgctatatattatgcagacgccctgaagggccggttcaccatttccagagacaattcgaagaaccacgctgtatctgacaaatggagagcctagagactcgacgacacggccgtctattattgtagttaaaggcgagcgtaggaagtaaccggggacccggggaccccgtaacgtttcgggaaccctaccggtacggggggaccccgaagggggggtacccgaccgtttcgggttacccaacccgggtttcccctcccgtaccgaaccggtaccccttaccccgtaaaccccggaaacgggggacccccctaacgttacccggggttccccttttacccccccccggttcggggacccctaaccccccgtttacccctaaccccgaaacggtaccggaccctaacccgtccggtacgggggaccaaccgacggacccgaacggccccgtcgggggcctaccgggtcccgttagggtacccgaaacgggtaccttacccgttaacccacggttaacctccttagtccgtagggacggccgggtcgtacgggaccaacgggaccgacgaagtgngac

SEQ ID NO: 53771 - DNA, 751 bp, Homo sapiens
  misc_feature: GYAE6OF01BHN5I.29.78.H01.1.454.CMB.1.raw
tcagatagagtactcacgaccggtgctcgatttagtgtgagtagtttgggtttgggggcgcctgggtacggccgggggggtcgctgagactctcctgtgcggcctctggatttaagttttaggagtcatgccatgaacgtgggtccgccgaggctccgagggaagggctggagtgggtctcggctattagtggcaggtggtggcgctatatattatgcagaccgccctggaacgggccggttacacctatttccgaagagaactaagttacgaaagaacacgctagtatctagacaaagtggagacgccgtagacgtactccggacgacgaccggtccgtacttaatttagtgttaaggttaaaggcgtagtacgtaggaaacggtaccggggacccgggcccgtacgttcgaaccgtacggtcgggggacccgagggggaccgcgtcggtacccgtaccgtaccttcccgtaccgacgtacccctaccgtaacccggaaccgggtccctacgttcccggtacccttcccccgtcggtaccccaccccgttccctaacccgaacgaccgtaccccgacccgttccgggtaccggggacctaaccggacgtacccgaccggtccccgggtcggtcccgtaccggtccggtacggtacgaacggttacctaccgttaccgtaccgtaccgtacttacgtcgtaggaccggtcgggtaccgtacggaaccgacgggtccgaaagtcggaagcga

SEQ ID NO: 53772 - DNA, 720 bp, Homo sapiens
  misc_feature: GYAE6OF01ASD9W.29.78.H01.1.454.CMB.1.raw
  modified_base (446)..(446): a, c, t, g, unknown or other
  misc_feature (446)..(446): n is a, c, g, or t
tcagatagagtactcacgaccggtgctcgatttagtgtgagtagtttgggtttgggggcgcctgggtacgggccgggggggtcgctgagactctcctgtgcggcctctggatttaagttttaggagtcatgccatgaactgggtccgccaggctccgagggaaggggctggagtgggtctcggctattagtggcagtggtggcgctatatattatgcagacgccctgaagggccgttcacatttccagagacaattcgaagaacacgtctagtatctagacaaaatgggagagtcctaggagactacggacgaacgaccggcctacgttaatttagttgtaggttaaagggcgtaagcgtagggaaacgtaccggggacccggggtcccgacttcggaacctacggtggggacccgagggggacgtcgtggtacaccggttctccncgacgtccctacccgaacgaacgggtcccacgtaccgttcccttccccgtcggccctaccccgtcctaccgaacgacgaccgtaccgtccggtacgggggaccaacgtacgacgacgcccgttacgggccgtacgtcccgtaggtacccggtaaacggtacccgttaaccgttaccgtaacggttaaccctacctaacggtttccgtagggaacggggtacccgggtaccggttacgggaaccggtaacgggacccgtagtacgttaggcgtag

SEQ ID NO: 53773 - DNA, 626 bp, Homo sapiens
  misc_feature: GYAE6OF01EEF8T.29.78.H01.1.454.CMB.1.raw
  modified_base (623)..(623): a, c, t, g, unknown or other
  misc_feature (623)..(623): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtagttaaaggcgagctaggaagtacggggaccgggcccgtacttcgaccacgtcggggaccaacggggacgcgtggtccaccgtctccctcacggccctcccaaccgaacgggcccacgtccggttccttcccccgtcggtcccacccgtccctacccaacgaccgtacctaccgtcgtcggggtaccacgacgccgacgcccgtcgggcctcgccgtcggtacgaacggtaccttactacccacgttacctcttacgtcgtaggacggccgggacgtcggaccgtaacggccgacgtaagtgngag

SEQ ID NO: 53774 - DNA, 787 bp, Homo sapiens
  misc_feature: GYAE6OF01AF41W.29.78.H01.1.454.CMB.1.raw
  modified_base (245)..(245): a, c, t, g, unknown or other
  misc_feature (245)..(245): n is a, c, g, or t
  modified_base (682)..(682): a, c, t, g, unknown or other
  misc_feature (682)..(682): n is a, c, g, or t
tcagatagagtactcacgaccggtgctcgatttagtgtgagtagtttgggtttggggtctgagagaggagtccacccctgggatcttcaggtgttttcatttggtgatcaggacggaacagagagaactcaccatggagtttgggctgagcgtgtcttttctagtggctaattttaaaaggtgtccagtgtgacgtgcagttggtggagtcgtgggggcgccgtggggtacgggccggggggtcncgtgagactctccgtgtgcggcctcgtggtatttaaggttttaggagtcatcgccatacggaacgttcggggtacccgccgaaggccgttacccggaagggggaacgggggtccgtagggtacgggtcgggttccgtcgggtaccttaaggtttagggtcgggacgtaagggttggggtcgggccggtacttaattaactttaagtttagtgaccacggacccgtccccgtagggtaacggggtccccggtttaccaccttacgtttaccgaagtaacgtaaccgtaagttaaccggaaagtaaccgaccggtacttagtaacgtccgttaaggaccgtaaaaggtggaacggtaccgcccgtaggtaacgaccgtacggaaccgtaaccggaccggtcccttattaactttaggttaggttaacggttaaaggcgngttacggtaagggaaccggttacccgggggacccgggttaccccgtagttaccggacccgtacggggtcggggacccggaaggggcccgtggtaccggtaccccg

SEQ ID NO: 53775 - DNA, 674 bp, Homo sapiens
  misc_feature: GYAE6OF01D6JAH.29.78.H01.1.454.CMB.1.raw
  modified_base (230)..(230): a, c, t, g, unknown or other
  misc_feature (230)..(230): n is a, c, g, or t
  modified_base (297)..(297): a, c, t, g, unknown or other
  misc_feature (297)..(297): n is a, c, g, or t
  modified_base (449)..(449): a, c, t, g, unknown or other
  misc_feature (449)..(449): n is a, c, g, or t
  modified_base (453)..(453): a, c, t, g, unknown or other
  misc_feature (453)..(453): n is a, c, g, or t
  modified_base (670)..(671): a, c, t, g, unknown or other
  misc_feature (670)..(671): n is a, c, g, or t
tcagatagagtactcacgaccggtgctcgatttagtgtgagtagtttggggtttggggggcgcctggggtacggaccggggggggtcgctgagactctcctgtgcggcctctggattaagttttaggagtcattgccatgaactgggtccgccaggctccgaggggaaggggctggagtgggtctcggctattagtggcagtggtggcgctagtatattatgcacgaccnccctgaagggccggttccaccatttccagtagactaattcgaaagaacacgctgtactcagacaagnggagacgcctagacgacgtacgacgaccgacggtccgtacttattagttgttacggtaacggcgacggaccggtaacggtacccggggacccgggtaccgtacgtcgaccgacggtcgggaccggagggcgtcgtcgtcctaccgtcctccncacnccaccgaccgaccggtcctacgtccgtccctccccgtcgccctaccccgtcctaccgaacgccgtacctaccgtcggcgggaccacgacgaccgaccggtccgtcggtaccgtccggtaccgtacggtaccgtaacggtacccttacgtaccgtacgttaccgtacctacgtacggtcggtacggtcggtcgcggaccgacggtaccacgtagtcgnngtc

SEQ ID NO: 53776 - DNA, 718 bp, Homo sapiens
  misc_feature: GYAE6OF01C2XCO.29.78.H01.1.454.CMB.1.raw
  modified_base (252)..(252): a, c, t, g, unknown or other
  misc_feature (252)..(252): n is a, c, g, or t
  modified_base (702)..(702): a, c, t, g, unknown or other
  misc_feature (702)..(702): n is a, c, g, or t
tcagatagagtactcacgaccggtgctcgatttagtgtgagtagtttgggttggggggaagaggaagactgacggtcccacccctgggatcttcaggtgttttcatttggtgatcaggacggaacagagagaactcaccatggagtttgggctgagcgtggtcttttctgtggctaattttaaaaggtgtccagtgtgacgtgcaggttggtggagtcgtgggggcgccgtgggtaccgggccggggggtcncgtgacgactcgtccgtgtgccggtcctgtggtatttaagtttaggagtcagtcgccagtgaacgtggtcccgacgtacggcctccggaaggggaacgggggtctagggtaggtgggttaccgtcggtactttaagtcggtggtcgtagggtggtacggcgtacttaagtaattagttagtgacgtacgaccggtcccgtaggaaccggggtcccgttacacccttagtttacccgaggtaacgaccgttaaagtacggaaacgtaacctacggcttacggtactcgtagactaaagtggaagcggacctagacgtaccgtacgaacgaccgtccgggtccttacgtattacgttaggtaggttaacggacgtagtaccgtaggaaccgtaccgggggtaccccgggacgtacgttcgaaccgtaccggggtcgggacccggaggggacncccggtttggaccccg

SEQ ID NO: 53777 - DNA, 809 bp, Homo sapiens
  misc_feature: GYAE6OF01BCXHM.29.78.H01.1.454.CMB.1.raw
tcagatagagtactcacgaccggtgctcgatttagtgtgagtagtttgggtttggggtccgagccatggtgcagactccccagagctctcctcctcctccactgcacagggtctctctccagcctgtgctgactacaatcgccctctcgcctctcgccctcccgtggggacgctcggtcaaggtcacctgtactcgtgagcgaggtcggacacagcagacctaccgcctagtcgcgttggcagtcacgcgacggacggaccgaacggaccgtacccggggtcccttacggtttaccgttagaacgtacgaacgtaacggtaaccaaacgtaagttcggaacgtcggacgtaacgtacgaacggaacgggacggggaaacggggggtacgtaccttacccgtagtaccgttcgtaccttccgtacgtaccgtaccgtacgtacgtccgtcgggtccgggtcctacgggaccgtccgtacccttaaccctaccgtaaccgtaccgttccccggtaccccgttacctacggtacgtcggtaggacggtaacgtcgggactcgttaacgtacttacgtacgtacggtacggtaaccggtaccgggtcgggaaccttaccggtcgttaaccgttaacggtttccgggaaccggtttcccggggaaccggggtacccgggtaaaccgtaccgggttacccgtacccggggttcgtaaccgggtacccgaaccccggaaaccccggtaacccggtaccccccgaaacgttccgttaaccggtccccttaaccgttccccggttaccccgtaccccc

SEQ ID NO: 53778 - DNA, 694 bp, Homo sapiens
  misc_feature: GYAE6OF01DAOGO.29.78.H01.1.454.CMB.1.raw
tcagatagagtactcacgaccggtgctcgatttagtgtgagtagtttgggtttggggtctgagagaggagtcccacccctgggatcttcaggtgttttcatttggtgatcaggacggaacagagagaactcaccatggagtttgggctgagctggtctttttcttgtggcttaattttaaaaggtgtccagtgtgacgtgcagttggtggagtcgtgggggcgccgtgggtacgggccgggggggtcgctgagactctccgtgtcgcggcctcgtggatttaagtttaggatcatcgccatgaacgtgggtccgccgaggcctccgaggggaaggggcgtgggaggtgggtcgtcggtctagttaggtggcgtaggtggtggcgtcgtattattattagtgacaacggaccgtcccgtaggaacgggtcccggtttaccaccgttactttacccgaagtacgtaaacaacgttacgaaaacgtaaccgacgtctagtactacgtagacaaagtcggagacgcgtaggactaccgtacgaaccgaccgtacccggtacgtcttaagtttagttggtaaggttaaacggcggtacgacggttaagggaaccggtaacccgggggtacccggacccggttacgtaccggaacccgacgggtccggggaaccggacggggtacgtcggtcggtacccg

SEQ ID NO: 53779 - DNA, 738 bp, Homo sapiens
  misc_feature: GYAE6OF01A9UHP.29.78.H01.1.454.CMB.1.raw
  modified_base (387)..(387): a, c, t, g, unknown or other
  misc_feature (387)..(387): n is a, c, g, or t
  modified_base (578)..(578): a, c, t, g, unknown or other
  misc_feature (578)..(578): n is a, c, g, or t
  modified_base (719)..(719): a, c, t, g, unknown or other
  misc_feature (719)..(719): n is a, c, g, or t
tcagatagagtactcacgaccggtgctcgatttagtgtgagtagtttgggtttggagtctgcaccatggctcggacccactcctcttcctcaccctcctcctccactgcacagggtctctcctcccagcctgtgctgactcaactccgccctctgcctctcgccctccgtgggacgctcggtcaaggtccactgtactctgagcaggtgacacgagcagctacgccatcgtcgtggcagtcagcaaggacggaccaacggaaccggccgggtcccttacgtttacttgagtacgaaccgtaagtaccaaatagtcgaagtcggacaacgacaacggacgggaacgggaaacgggggacgtactcccgtagacttccggtactttccngtacggtcctacgtcgtcgtcggtcggctaggaccgtcgtaccctacgtacctaaccgtacgttccccgtcccggtaaccttccggaagtttccggagggaaacggttcgtaagggtccggtactttaccggtaactttaccggttacgacgggtaacggtaacccgggtcgggttcgggacctttacggngttaccgtttaacgggttacccgttacggggttccggtaacccggggggaaccgttaacccggtacggttaccgttccgggtaccggtaccgacgacccggaacccgtaacccggacccctaaccggtcaccgtttaaccncccgttcccgttacccccg

SEQ ID NO: 53780 - DNA, 630 bp, Homo sapiens
  misc_feature: GYAE6OF01AOXFK.29.78.H01.1.454.CMB.1.raw
  modified_base (412)..(412): a, c, t, g, unknown or other
  misc_feature (412)..(412): n is a, c, g, or t
  modified_base (630)..(630): a, c, t, g, unknown or other
  misc_feature (630)..(630): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgacaaaatggagagcctgagactcgacgacacggcctactattatgtagtaaaggcgagctggaatacggggaccgggcccgacttggaccacgtgggggcccgaagggggaccgcgtcggtcgacccgttctccctnacgccctccgaacccgaacgggcccacgtccggttcccttcccccgtcggccccacccctccctacccgaagacgacctactccggtcggggccacgacgccgacgcccgtgggctcgtccgtggtaccaacgggtacctaaccgttccgaagttaccgtacctacgttcgtacggacgggccgggtcggaggtccgaacgggcgacgtacgtgtcgn

SEQ ID NO: 53781 - DNA, 705 bp, Homo sapiens
  misc_feature: GYAE6OF01D2RTK.29.78.H01.1.454.CMB.1.raw
  modified_base (701)..(701): a, c, t, g, unknown or other
  misc_feature (701)..(701): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaagggctggagtgggtctcggctattagtggcagtggtggcgctatatattatgcagacgccctgaagggccggttcaccatttccagagacaattcgaagaacacgctgtatctgcaaatggagagcctgaagactcgacgacacggccgtactattattgtagttaaggcgagctggaacgtacggggaccggggccccgacgtgaccacggtcgggggaccagggggaccgtcgtcggtaccgaccgtcctccctcaccgccgtcccaacccgacgggaccccacgttacccggttccccgtttccccccgtcgggtaccccaccccctccctacccgaacggccgaccctacccgtcggtcgggggccaacgacgccgaaccggcccgtggggtacccgtcggtacccggttacgggttaccgaaaccgggtacccgttaaccgttacccgtaaacgttcccttaccgttacgttccgtaggggtacggtccccggggtacgttcggggaaccgtacgggacccgtacgaacgttaggngtcg

SEQ ID NO: 53782 - DNA, 575 bp, Homo sapiens
  misc_feature: GYAE6OF01CDYNU.29.78.H01.1.454.CMB.1.raw
  modified_base (318)..(318): a, c, t, g, unknown or other
  misc_feature (318)..(318): n is a, c, g, or t
  modified_base (489)..(489): a, c, t, g, unknown or other
  misc_feature (489)..(489): n is a, c, g, or t
  modified_base (499)..(499): a, c, t, g, unknown or other
  misc_feature (499)..(499): n is a, c, g, or t
  modified_base (510)..(510): a, c, t, g, unknown or other
  misc_feature (510)..(510): n is a, c, g, or t
  modified_base (518)..(518): a, c, t, g, unknown or other
  misc_feature (518)..(518): n is a, c, g, or t
  modified_base (539)..(539): a, c, t, g, unknown or other
  misc_feature (539)..(539): n is a, c, g, or t
  modified_base (566)..(566): a, c, t, g, unknown or other
  misc_feature (566)..(566): n is a, c, g, or t
  modified_base (571)..(571): a, c, t, g, unknown or other
  misc_feature (571)..(571): n is a, c, g, or t
  modified_base (574)..(575): a, c, t, g, unknown or other
  misc_feature (574)..(575): n is a, c, g, or t
tcagatagagtactcacgaccggtgctcgatttagtgtgagtagtttggggtttgggggcgcctgggtacgggccgggggggtcgctgagactctcctgtgcggcctctggattaagttttaggagtcatgccatgaactgggtccgccaggctccgaggggaaggggctggagtgggtctcggctattagtggcagtggtggcgctatatatatgcagacgcctgaagggccggttcaccatttccagagtacaattcgaaagaacacgctgtatctgacaaaatggagagcctgagactcgacgacaccggccgtntaattattgtagttaaaaggcgaagaccgggaaagtacccggggacccggggcccgtacgttgacccgtacgcggggccgagggggacgcgtggtccgaccgtctcctcagcctcgacaacgggcccactcggtccttccccgtgcccgacctcaccagacgtcacgtcgngggcaccgancacgccgtcgnccggtcgntcgagactagtccaggtcctnatcgtagacgcggcgtggagtaccggnacganagnn

SEQ ID NO: 53783 - DNA, 665 bp, Homo sapiens
  misc_feature: GYAE6OF01BZFTN.29.78.H01.1.454.CMB.1.raw
tcagatagagtactcacgaccggtgctcgatttagtgtgagtagtttgggtttgggggcgcctgggtacggccgggggggtcgctgagactctcctgtgcggcctctggattaagttttaggagtcatgccatgaactggatccgccaggctccaggggaagggctgggagtgggtctcggctattagtggcagtggtggcgctatatattatgcagacgccctggaacgggccggttcacctatttccagagacaattcgaagaacacgctagtatctgacaaagtggagagcctgagaccgtcgaacgacaccggcctacttatttacttggtaggtttaaacggcgagtcgtagggaacgtaccggggacccgggccgtacttcggaccctaacggtcggggaccggacggggaccgtcggttcggtccgtacccgtcgtccctcgaccgtccctaccaccgaacggtcccacgttcccgttcccttcccccgtcgcccgtcccctcccgtaccgacgacgaccgaccgtcggtcggggaccacgacgcgacgcccgtacggtccgtcgtccgtcggacgtacgtaccgttaccgttccgtacgtaccgttactacgtctcggacggtccggtcgtacggtacggacggacgacgagtgacg

SEQ ID NO: 53784 - DNA, 933 bp, Homo sapiens
  misc_feature: GYAE6OF01DNJX5.29.78.H01.1.454.CMB.1.raw
  modified_base (252)..(252): a, c, t, g, unknown or other
  misc_feature (252)..(252): n is a, c, g, or t
tcagatagagtactcacgaccggtgctcgatttagtgtgagtagtttgggtttggggggagagaggagtccacccctgggatcttcaggtgttttcatttggtgatcaggacggaacagagagaactcaccatggagtttgggctgagctggtcttttttcttgtggtcttaagtttttaaaaaggtgtccagtgtgacgtgcagttgggtggagtcgtgggggcgccgtggggtacggggccggggggtcncgtgagactctccgtgtgcgcctcgtggtatttaaggttttaggagtcatcgccagtgaacgtgggtccgcgaggcctccggaaggggaacgggggtctagggagggttcgggtccgtcggtacttaggtttaggtcggacgtagggttggggtcgggtcggtacttaagttaattagtttagtaggcgtaacggacccggtcccgttagggaaaccggggttcccggtttaccaacccgtttacgtttacccgaaacgggtaacgtaaaccgttaaacggttaccgaaaacggaaacccgtaccggttacgtttacggttaaacttacgtacggtaaaactaaagggttacgggaaaggtacccgtaccggttagggaacccgttaaccgtaccgggaaaaccgtacccggtaacccgggtaccccgtttaacgttttaaagttttaacggttttacggggttttaaaacgggttaaacggggaccggttaacgggtaacccgggtttaaacgggggaaaacccggggttaaccccgggggggaacccccgggggttccccggttaaaccgggtttacccgggaaaccccggtttaccgggggacggggggtaacccccgggtaagggggggtacccctacggggtttcccgggttaaccctaccccggggtttccccgg

SEQ ID NO: 53785 - DNA, 598 bp, Homo sapiens
  misc_feature: GYAE6OF01B5136.29.78.H01.1.454.CMB.1.raw
  modified_base (592)..(592): a, c, t, g, unknown or other
  misc_feature (592)..(592): n is a, c, g, or t
  modified_base (597)..(598): a, c, t, g, unknown or other
  misc_feature (597)..(598): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgacaaatggagagcctgagactcgaccgacacggccgtctattattgtaggttaaaggcgagtcgtaggaacgtacggggacccggggcccgacttcgaccgacgtggggccgagggggaccgcgtcggtcgaccgtctccctcacgcctccaccgacgggccacgtcgtcctccccgtcgccaccctcctacccaagacgccaccgtcgtacggggccacgcgccgacgcccgtagggtcctcggtccgtggtaccaacggtacctaccttccgacgttacctacttctcgtgacggcggcgtcggacgacggcganagtgnn

SEQ ID NO: 53786 - DNA, 809 bp, Homo sapiens
  misc_feature: GYAE6OF01EVHZ5.29.78.H01.1.454.CMB.1.raw
  modified_base (319)..(319): a, c, t, g, unknown or other
  misc_feature (319)..(319): n is a, c, g, or t
  modified_base (328)..(328): a, c, t, g, unknown or other
  misc_feature (328)..(328): n is a, c, g, or t
  modified_base (332)..(333): a, c, t, g, unknown or other
  misc_feature (332)..(333): n is a, c, g, or t
  modified_base (472)..(472): a, c, t, g, unknown or other
  misc_feature (472)..(472): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctgggagtgggtctcggctattagtggcagtggtggcgctatatattatgcagacgccctgaaggggccggttcaccatttccagagacaattcgaagaacacgctgtatctgcaaatggagagcctgagactcgacgacacggcgtctattatntagtacggnggannagtagacgggaccgggaccgcgtacgacctaggtcggcggacggggacgcggtcggccgtccgtcgtccctcgacgtcctacccaaccgcaacggacccgacttcccccgtaggttccccccttacccggtccccgtancccccgtaaccccgtaccccgtaacccgtaacccgtacccggtacccgggtaccccgtacccgggggtaccgggtacccgggaaccggaccccgtaccgggtacccccgttacccggggtacccccgggttcggggttaccccggttaaccggggttacccggttaaacccgggttaaaccccggttaaaacccggtttaaccccgttaacccggtttaaacccgtttaacccggtttaaccggttaccggtttacccggggtaaccgggttaccgggggtacccgggttaaccgggggtacccgggtaaaccgggtaaccgggtaaccgggtaacg

SEQ ID NO: 53787 - DNA, 644 bp, Homo sapiens
  misc_feature: GYAE6OF01EZG8F.29.78.H01.1.454.CMB.1.raw
  modified_base (145)..(145): a, c, t, g, unknown or other
  misc_feature (145)..(145): n is a, c, g, or t
  modified_base (396)..(396): a, c, t, g, unknown or other
  misc_feature (396)..(396): n is a, c, g, or t
  modified_base (635)..(635): a, c, t, g, unknown or other
  misc_feature (635)..(635): n is a, c, g, or t
  modified_base (641)..(641): a, c, t, g, unknown or other
  misc_feature (641)..(641): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccnccaggctccgagggaaggggctggagtgggtctcggctattagtggcagtggtggcgctatatattatgcagacgccctgaagggccgttcaccatttccagagaccaattcgaagacacgctgtatctgacaaatggaagacgcctagagacctacgacgaccacggcctactattattgtagttaaaggcgagctaggaaagtaccggggacccgggaccgacgttgaccacggtgggccgaggggacncgtggaccaccggtctcctcgacgcctacccgaacgaacgggccccagttccggtcccttcccccgtcggccctacccctacctaccgaaagccgacctacctcggacggggtccaacgtcgacacggcccgtgggcctcgtccgtaggtacgaaacggtaccttaaccgttaccgacgtaccttccgtaacgttcgtggaacgggtccgggacgtagggaaccggtacgggaccgtanacgtgngta

SEQ ID NO: 53788 - DNA, 894 bp, Homo sapiens
  misc_feature: GYAE6OF01DG0MY.29.78.H01.1.454.CMB.1.raw
  modified_base (158)..(158): a, c, t, g, unknown or other
  misc_feature (158)..(158): n is a, c, g, or t
  modified_base (841)..(841): a, c, t, g, unknown or other
  misc_feature (841)..(841): n is a, c, g, or t
tcagatagagtactcacgaccggtgctcgatttagtgtgagtagtttgggtttgggggtccgagccatggtgcagacctccccaagagctctccctcctcctccactgcacgtaggtcctctcctcccagcctgtgctcgactacaacgtccgccctntcgtcctcgtccgccctcccggtggggacgtccgtccggtacgtaacggttcctaccgtggttactcggtagaccgaccgtacggtacggaaccacgacgacctacgtaccgtacccgaccaagttcccggtacgttacggacaacgttaccgaacgaccgtaagggaaccggacccgaacggacccggtacccggggtaccttaccgtttacgtagtacgtacgaacctacgtaacctaacgtaagtacgtagtacggtactacggtaccgtaaccggaacgggaacggggaacggggtaccgtacgttacccgacggtaccgtaccggttccttaccgtaccgttaccgttccgaccgtacggttccgttacgggtccggtacgtcggacccgtaccgtacctaccctaccaaccgttacccgttccggtacccgtaccgtccgttagtacggtaggtacgtcgaacgggttccgactttaagtaccgttagtacgtacgttacgggaacgttcggacggtactacggggtaccttaggtaaccgtttccggttaaccgggttccgggtaccgggaacccgggtaaacccggtaccggtaaccgtacccggggttacggtaacccgtacccgggaaacccgttaaccccggaaaaccccgttccccgttaaaccccggttntaaacccggtttaccccctacccggttccccgtttaacccccgttaccccccg

SEQ ID NO: 53789 - DNA, 651 bp, Homo sapiens
  misc_feature: GYAE6OF01BGO7Q.29.78.H01.1.454.CMB.1.raw
  modified_base (182)..(182): a, c, t, g, unknown or other
  misc_feature (182)..(182): n is a, c, g, or t
  modified_base (231)..(231): a, c, t, g, unknown or other
  misc_feature (231)..(231): n is a, c, g, or t
  modified_base (271)..(271): a, c, t, g, unknown or other
  misc_feature (271)..(271): n is a, c, g, or t
  modified_base (277)..(277): a, c, t, g, unknown or other
  misc_feature (277)..(277): n is a, c, g, or t
  modified_base (319)..(319): a, c, t, g, unknown or other
  misc_feature (319)..(319): n is a, c, g, or t
  modified_base (362)..(362): a, c, t, g, unknown or other
  misc_feature (362)..(362): n is a, c, g, or t
tcagatagagtactcacgaccggtgctcgatttagtgtgagtagtttgggtttggggtctgagagaggagtccacccctgggatcttcaggtgttttcatttggtgatcgaggacggaacagagagaactcaccagtggaggtttgggctgagcggtgtgttctaggcgctaatttaaaggntcagtgtgcgtgcagtggtgcgtgtgggcgccttgggcggcgggggtcngagagctcgtcgtgcgcgtctgtagtagttagttacgatntagtcnagtacgtacgtcggaccgcgtacgccgtacggagggtacggngtggtaggtcgtcgtagtctagtgccgtagtagtagcgtagtntatatagtacgtacgacgacgtacgtcgtacggtacggtacgtacgtacgtacgtacgagtacgtacgtacgtaacgacgacgtacgtacgtacgtacgtactacgtagtagtagtacgtacgtacgtacgtacgtacgacgacgacgtacgtacgttacgttagttagtagtacgtaacgtagtacgtacggtacggtaaccggtaccggtacccggtaccggtaccggtaccggtacggacgggtaccgggaccgggtaccgggtaccggtccggtaccggtacccg

SEQ ID NO: 53790 - DNA, 944 bp, Homo sapiens
  misc_feature: GYAE6OF01DXGQ5.29.78.H01.1.454.CMB.1.raw
  modified_base (231)..(231): a, c, t, g, unknown or other
  misc_feature (231)..(231): n is a, c, g, or t
  modified_base (243)..(243): a, c, t, g, unknown or other
  misc_feature (243)..(243): n is a, c, g, or t
tcagatagagtactcacgaccggtgctcgatttagtgtgagtagtttgggtttgggggcgcctggggtacgggccgggggggtcgctgagactctcctgtgcggcctctggtaatttaagtttaggagtcatgccatgaacgtcggtccgcgaggctccgaaggggaacgggtcgtgggtaggttcgggtcgtcggtacttagtttaggtggcgtaggttgggtggccgtntatattattacngaccgagacccgccgtagggtaacggggtccttaccaaccttactttaccgaaggaacgtactaacgtaacgaaagaaccaccggtactacgttacgtcgtagaactaaggtcgggaacgtacgtccgtaaggaccgaccgtacggaaccgaccggtaccgggtaccgtttatttagttttaacggttacggttttaaaggggttaaaacgggccgtaacggaccgggttaaacggggtaaacccgggggtaaaccccgggggtacccccgggggtaccggttaaccggttaaacccggggaccggtaccggggtacgggggggaccgggaaccggggggtaaccgtttccgggtacccgggttacccttaaaccccgggtttccccgccccgttaccgtacccgttaaccccccggtaaccccggaaaaccccgggggttacccgggtaaccccgtttaacccgggttccccggttaccccctttaccccccgggtaccgtaacccccgtaccccgttacccggtaacccgaacgtacccgtacccgtaaccggttccggggaacgtaccgaccgacggtacccgcggttcccgggtcggtcgccgtacgtacggtaccgtaactcccgttaaccgtcacgttaccgtagtcgtacggtcgggtacggtcggcgtaacggcggaacgcgaatcggagtgc

SEQ ID NO: 53791 - DNA, 644 bp, Homo sapiens
  misc_feature: GYAE6OF01DGXLT.29.78.H01.1.454.CMB.1.raw
  modified_base (367)..(367): a, c, t, g, unknown or other
  misc_feature (367)..(367): n is a, c, g, or t
  modified_base (406)..(406): a, c, t, g, unknown or other
  misc_feature (406)..(406): n is a, c, g, or t
  modified_base (416)..(416): a, c, t, g, unknown or other
  misc_feature (416)..(416): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtcccgccaggctccgagggaagggctggagtggtctcggctattagtggcagtggtggcgctatattattatgcagacgccctggaacgggtccgttcacctatttccagagacaattcgaagaacacgctgtatctgacaagtgagacgctagagactcggacacgacggtccgtactagtttattgtagtaaaggcagtcgtagacgtaccgggaccgggcccncttcgaccacggtcgggcgagggcgctggtccaccgtcncctcgcgccnccaaccgacggcctacgtccggttcctccccgtggcccctaccgtcctaccgacgtacgcctaccggtcggtcggggcctaacgcgtaccaccgggtcccgttagggcctcgggtaccctagggtacctaaccgggtaccttaacttcccggtagttaccctacttacgtactccgggtacgggtccggtaacgttcgggaacctacgggcctaacgagtaccggtcg

SEQ ID NO: 53792 - DNA, 687 bp, Homo sapiens
  misc_feature: GYAE6OF01DWF3R.29.78.H01.1.454.CMB.1.raw
  modified_base (145)..(145): a, c, t, g, unknown or other
  misc_feature (145)..(145): n is a, c, g, or t
  modified_base (151)..(151): a, c, t, g, unknown or other
  misc_feature (151)..(151): n is a, c, g, or t
  modified_base (205)..(205): a, c, t, g, unknown or other
  misc_feature (205)..(205): n is a, c, g, or t
  modified_base (657)..(657): a, c, t, g, unknown or other
  misc_feature (657)..(657): n is a, c, g, or t
tcagatagagtactcacgaccggtgctcgatttagtgtgagtagtttgggtttggggtccgagccatggtgcagactccccagagctctcctcctcctccactgcacagggtctctctccagcctgtgctgactcaatcgccctntgcctntcgcctccgtgggagctggtacaaggtcactgtactcgtgagcaggtgaacacngcagctacgcctatcgcgttgacatcagcaggtacgccaggaccgaccgggtcccttaggttactgacttacggaactagtaccaaactagttcggaacgttcgggactaaggtaccaaggacggaacgggtaacgggggacgtactacccgtggaactttccgtacttactcgtacgtccgtcagtccgttacgtcgggtcctaaggctacccgtaccgtaacctactaaaccgtccgtacccggttcccggaccctacgtcgttaccgaggtacgtaagcggacgttctacgtaacttacggtgtacgtacgacgggtaccgtggggaacctttacgccgggttaattacggttacgggtaccggtttaccggtaccggggaaccgggtacctacgggttcccgacgttccggggtcaaccggtcaaacccggaccgtccccaaccgttnttacccgattacccctgttaccccgttacc

SEQ ID NO: 53793 - DNA, 722 bp, Homo sapiens
  misc_feature: GYAE6OF01EINPP.29.78.H01.1.454.CMB.1.raw
tcagatagagtactcacgaccggtgctcgatttagtgtgagtagtttgggtttggggtctgagagaggagtcccacccctgggatcttcaggttgttttcatttggtgatcaggacggaacagagagaactcaccatggaggtttgggctgagctggtcttttttcttgtggcttaattttaaaaggtgtccagtgtgacgtgcaggttggtggagtcgtgggggcgccgtggggtaccgggccgggggggtcgcgtggagactcctccgtgtcgccggcctcgtggtattaaggttttaggagtcatcgccatgaacgttcggttacccgccgaggcctccggaaggggaacggggcgtgggaggttcggggtcgtcggcttagttagtgggcgtaggttgggtggcgtactaagttaatatttagtcgacaacggacccgtcccgtagggtaacggggtcccggttaccaacctacgtttacccgaagtaacgaactaaacgttacgaaaacgaacctacgtcttagtactacgtacgaacgtaaagtggaagtcgtccgtaggacgtaccgtacggaaccgaaccgaccgggtaccgttactttattagtttaggtaaggttaaacggcggaggtccgtaagggaacggtacccggggacccgggtccgtacggttccggacgtacgggtcggggaccgaggggaccgtcgtggtcccg

SEQ ID NO: 53794 - DNA, 659 bp, Homo sapiens
  misc_feature: GYAE6OF01BMUJ6.29.78.H01.1.454.CMB.1.raw
  modified_base (336)..(336): a, c, t, g, unknown or other
  misc_feature (336)..(336): n is a, c, g, or t
  modified_base (352)..(352): a, c, t, g, unknown or other
  misc_feature (352)..(352): n is a, c, g, or t
  modified_base (653)..(653): a, c, t, g, unknown or other
  misc_feature (653)..(653): n is a, c, g, or t
tcagatagagtactcacgaccggtgctcgatttagtgtgagtagtttgggtttggtggtctctctcccagcctgtactgactcaatcgccctctgcctctgcctccctgggaggctcggtcaaggtcacctgtactctgagcagtggacacagcagctacgccatcgcttggcatcagcagaggccaagacacgtgccctgttacttgatgacagtcaaacaatgatggcagtccacagcggaaacgggggacggactcctgatccgtcttactcagtctaccgagccgtctcgggcctgacgcgactaccgtacactaactccgtccggtacccncgtacgtcgtagaggntggagtcgtaacgtacttacgttactcggtcaacggccggttggggacctaacggtcggtacgtaacgtttcggaacgggttaccctttaccgggggaaccgggtaaccgtacggtaccgtacccggtccggttcggacccgacgacccgaacggtcccaaccccgtcttacggtacctacccgggtcctttacccgggtccccctaacccttccgtacctaacggtttctaccttacgtccgggagtaccggggccgggtcgtacggttaaccccggaagggtcccctacgtaagttcgnttcgga

SEQ ID NO: 53795 - DNA, 764 bp, Homo sapiens
  misc_feature: GYAE6OF01AILHE.29.78.H01.1.454.CMB.1.raw
  modified_base (149)..(149): a, c, t, g, unknown or other
  misc_feature (149)..(149): n is a, c, g, or t
  modified_base (203)..(203): a, c, t, g, unknown or other
  misc_feature (203)..(203): n is a, c, g, or t
  modified_base (247)..(247): a, c, t, g, unknown or other
  misc_feature (247)..(247): n is a, c, g, or t
tcagatagagtactcacgaccggtgctcgatttagtgtgagtagtttgggtttggggtccgagccatggtgcagactccccagagctctcctcctcctccactgcacagggtctctctcccagcctgtgctgactcaacgtccgccctntcgcctctcgccctccgtgggacgtctcggtcaaggtccacctgtactctgacncaggtcgacacagcaagcctacgcctatcgacgttcggactacncgagaccagggtacgaccaagaccgaccgggtcccttagttacgttgatacgactagtaacaaactaatcgtagcggactagtacacggaggaccggggaacgggggtccgtactcccgtaggtctaccggtcttccgtactcggtaccctacggacgtccgttacggtcgggtacctcggaaccgtcccggtactaccctacgtaaccttaaccgtcccgtcccgtaccttaccgtacgtcgtaggtaacgtagtacgggtacctacgtaacgttacttaaccgttacgtaccggtacgtaaccggtaccgggttacgggtacctagggtacggttaccgttacgttaacgggtccgggtttaacccggtaccggggggaaacccggtagtaacccggtcccgggttacggtacccgggttacggtacccggaaccggtaccccgaacccggtaaacccccaccggttaccttacccggtaccttaccccgttacccgttcccccggtaacccccg

SEQ ID NO: 53796 - DNA, 775 bp, Homo sapiens
  misc_feature: GYAE6OF01BVCSG.29.78.H01.1.454.CMB.1.raw
  modified_base (389)..(389): a, c, t, g, unknown or other
  misc_feature (389)..(389): n is a, c, g, or t
tcagatagagtactcacgaccggtgctcgatttagtgtgagtagtttgggtttggggtccgagccatggtgcagactccccagagctctcctcctcctcactgcacagggtctctctcccagcctgtcgcgtacgtactacaacgtcccgtccctcgtccgtcccttcgtccgtcccgtccggtggggacgtccggtcggtacgtaacgtcctaccgtacgtcctcgtaggacgcggtaggtacggacacgacggaccacgtaccgtaccggcctagtccgtcggttcgactacgcgacgacgaacggacggaccgtaaccgaccggtacccggttccgtttagttacgtcggaagtacggaactacgtaacaaaaggtagtaggacgnggtacaacggcgaacggaacgggacggggtaaccgggacgtccctcgtagtacgtccgtctacgtaacgtcgccctaggtacgtcggtcggtccgagtaccggaacctcctaaccctacgaaccgacgtttacccgttcccgacccgttacgacgtccgttagacgggagtacggtaggacgttaacgtacgttaattaccggtttacgaccggttaacggacggtaccggcggtaacgtcgtcggttaaccgtccggttacggtacgggttcccggaaccgggttccggaacggtacccgacgtaccgggtacccgtggaccccgtacggaccggaccctacccgaaccgtcgtaccgaccgttcctcccggtccccgttccccg

SEQ ID NO: 53797 - DNA, 849 bp, Homo sapiens
  misc_feature: GYAE6OF01CU5OI.29.78.H01.1.454.CMB.1.raw
  modified_base (271)..(271): a, c, t, g, unknown or other
  misc_feature (271)..(271): n is a, c, g, or t
tcagatagagtactcacgaccggtgctcgatttagtgtgagtagtttgggtttgggggaagaggaagactgacggtccacccctgggatcttcaggtgttttcatttggtgatcgaggacggaacagagagaactcaccagtggtagtttgggctgagcgttggttcttttttcgttgtggtacttaagtttttaaaaggtgtccgtagtgtgacgtgctaggttggtggagtcgtgggggccgccggtggggtaccgggccggggggtcncgtagacgtaccttcctccgtggtcggccggtccttcgtaggttaagtttttaaggttttaggacgttcattcgacctaagtacggtaaccggttcggggtcccgaccgtacggtccgtacccgggaagggggaacgggtcgtaggggtacggttcgggttccgtacggtactttaaggtttacgggtgggtacgtagggttcgggtacggtcgttatttaattaagtttaagttacgtcgacgtacggacccgtcccggtaagggaaccgggtcccgtttaaccaccgttacttaccgagtaacgtaactaacgttacgaaacgaacctacgtacgttacgttactaccggtacgaacgtaaaggttcgggaaaccgtacgtaccgtaggaaccggttaccgtaaccggacccggaaccgtcccgggtttaccgttatttagtttagtttacggttaaggtaaacgggcggtaaacgtcgggtaacggtaaccggggtcccgggcccgggtaacccgttcgttacccggaaccggttcggggtacccgggacggacgggtctccgggccgttacccg

SEQ ID NO: 53798 - DNA, 630 bp, Homo sapiens
  misc_feature: GYAE6OF01A0RRN.29.78.H01.1.454.CMB.1.raw
  modified_base (380)..(380): a, c, t, g, unknown or other
  misc_feature (380)..(380): n is a, c, g, or t
  modified_base (628)..(628): a, c, t, g, unknown or other
  misc_feature (628)..(628): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattatgtagttaaggcgagctggaatacgggacccgggccgacttcgaccacgtcggggccaggggacncgtggtccaccgttctccctcgacgccctacccacccgaacgggcccctacgtccggttcccgttcccccgtcggtcccacccctccctacccaacgacgccacccgtccgtcgggggccacgacgccacggccccgtcgggccgtcggtcccgtcggtaccgaacggtaccgtaccgttcctacgttacctacgttacgtcgtacggtacggccgggcgtcggaccgtaacgggccgacgacgtggncg

SEQ ID NO: 53799 - DNA, 631 bp, Homo sapiens
  misc_feature: GYAE6OF01DCP0X.29.78.H01.1.454.CMB.1.raw
  modified_base (625)..(625): a, c, t, g, unknown or other
  misc_feature (625)..(625): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccgagggaaggggctggagtgggtctcggctattagtggcaggtggtggcgctatatattatgcagacgccctgaagggtccggttcaccatttccagagacaattacgaagaacacgctgtatctgacaaagtggagacgcctggagactacgacgacgaccggccgtcttaatttagtttaggttaggttaaacggcgagtcgtaggaacgtaccgggggacccgggccgacgttcgaccacggtcggggaccgaggggacgcgtcggtccaccgtctcctcgacgccctccaccgacgggcccacgtccgtcctccccgtgaccctaccctcctaccacgacgcctaccgtcgtcggggacccacgacgacgacgcccggtggccgtcgtccgtacggacaacgtacctaccttccgacttcctacttacgtctaggaccggcgggtaccgtggacgaacggccgagtanagtcag

SEQ ID NO: 53800 - DNA, 693 bp, Homo sapiens
  misc_feature: GYAE6OF01DE2PQ.29.78.H01.1.454.CMB.1.raw
  modified_base (194)..(194): a, c, t, g, unknown or other
  misc_feature (194)..(194): n is a, c, g, or t
tcagatagagtactcacgaccggtgctcgatttagtgtgagtagtttgggtttggggtccgagccatggtgcagactcccagagctctcctcctcctccactgcacagggtctctctcccagcctgtgctgactacaatccgcccttctcgccttctcgcctccgtgggagctcggtcaaggtcactgtactcngacgcagtcggacacgagcagcctaccgccagtccgtcttggcatcgagcgaggacggcctaggaccgaccgggtcccttacgttacgtgatacggactagtacaacgtaagtcgaacgttcgggactacggtaccaacggacggacgggtaacgggggaccgtcttaccccgtgaaccgttccgtacgttactcgtacgttcctaccgacggtccttacgggtcggcctagggacctaccgtacccttacgtacctaacggtacgttcccgtcccggtaccttccgtaggtccggttaggagttacgtcgggtaccggtcctagttaaccgttacgtttcggccgttaccgaccggggtaccgcgtaacttcgggcgttacgttcggaggtacccggtcgggacccgggtactaacggccgtaccgtccgggtacgtaccggccgaccggaccgacccgtccacgttaccgcttacggtccctcccgttaccggcccc

SEQ ID NO: 53801 - DNA, 740 bp, Homo sapiens
  misc_feature: GYAE6OF01EBGN6.29.78.H01.1.454.CMB.1.raw
  modified_base (248)..(248): a, c, t, g, unknown or other
  misc_feature (248)..(248): n is a, c, g, or t
  modified_base (311)..(311): a, c, t, g, unknown or other
  misc_feature (311)..(311): n is a, c, g, or t
tcagatagagtactcacgaccggtgctcgatttagtgtgagtagtttgggtttggggtctgagagaggagtccacccctgggatcttcaggtgttttcatttggtgatcaggacggaacagagagaactcaccatggagtttgggctgagcgtgtcttttcttagtggctattttaaaaggtgtccagtgtgacgtgctagttggtggagtcgtgggggcgtccgtggggtacgggccggggggttcncgtgagactctcctgtgcggcctctggtattaagtttgagtcatgccatagaacgtgggtccnccgaggcctccgaaggggaaggggcgtgggaggttcgggtcgtcggactagttaggtcggacaggtggtggcgtctaattagttatttagcgacgacgtaaccggtccccgtagggaacggggtcccggttacctaaccctacttttaccgaagtaacgaactaacgttacgaaacgaacacgtctagtaactacgtacgactaaagtcgggagtacgtaccgtgaacggacgtaccggaaccgtaacgacccgggtcccgttaacgttaagtttacgttacggttaaggttaaacgggtcgtaaggtccgtaagggtaaacgggtaccgggggtaaccccggggacccggttaacggttacccgaaccggtaacccgggtcgggggaacccggtaaccgggggtccgtaccggtcgggtaacccccgg

SEQ ID NO: 53802 - DNA, 647 bp, Homo sapiens
  misc_feature: GYAE6OF01CX11H.29.78.H01.1.454.CMB.1.raw
  modified_base (647)..(647): a, c, t, g, unknown or other
  misc_feature (647)..(647): n is a, c, g, or t
tcagatagagtactcacgaccggtgctcgatttagtgtgagtagtttgggtttgggggcgcctgggtacggccgggggggtcgctgagactctcctgtgcggcctctggatttaagttttaggagtcatgccatgaactgggtccgccaggctccgagggaaggggctggagtgggtctcggctattagtggcagtggtggcgctatatattatgcagacgccctagaacgggccggttcacctatttccagagacaattacgaagaacacgctgtatctgacaaagtggagagcctgagactcgacgacacggccgtactattattgtagttaaaggcgagcgtaggaacgtaccggggacccgggccgtacgttcgaaccctacggtcggggaccgagggggaccgcgtcggtccaccgttcctccctcgaccgtccctacccgaaccgaacgggcccctacgttcccggtcccttcccccgcggacccctacccctccctaccgaacgaccgcctacccgtcggtcggggaccacgacgccacgcccgtgggcctcgtccgtcggtacgaacgtacctaccttcctacgtacctctacgtcgtggacgggcgggtcgtacggacgtaacgggcacgagtagcgn

SEQ ID NO: 53803 - DNA, 737 bp, Homo sapiens
  misc_feature: GYAE6OF01C28X9.29.78.H01.1.454.CMB.1.raw
  modified_base (580)..(580): a, c, t, g, unknown or other
  misc_feature (580)..(580): n is a, c, g, or t
  modified_base (717)..(717): a, c, t, g, unknown or other
  misc_feature (717)..(717): n is a, c, g, or t
tcagatagagtactcacgaccggtgctcgatttagtgtgagtagtttgggtttggggtccgagccatggtgcagactccccagagctctcctcctcctccactgcacagggtctctctcccagcctgtgctgactcaatccgccctctgcctctcgccctcccgtgggacggctcggtacaaggtccacctgtactcgtggcagtaggacgacaacgacgacgacgtaccgtacccgtacgtccgtcgttcggtcgactaccgaggacgacgacgggaccacgtaacgaacggtcgggtccccgttacgttagttagagtacgaacacgtaaccaaactaaagtggtaagccggtacgacgtaccgaccgaaggacgggtaagggggaaccgggtactccttacgagtccgtccttcgtacacgtactccgaacggtcgtctcgggactggaacgccgtaccgttaacccacgtaaccctaacggttccccggtccccgggtaaccctttaccgacgggttaccgtaaggggtaagggacttacgggaacgttacccgagtttaactaacggttttaccnggtacgaccgggaccggttcgggtacgaccgtcggtactacgtttccgggaggttcccgtaccgggggaacccggtagtaccgcggtacccgtggtcccgacaccgtcccggaaccgtccccgaacctcgtctaccnccgttcgtccggtccccccc

SEQ ID NO: 53804 - DNA, 816 bp, Homo sapiens
  misc_feature: GYAE6OF01ASLWI.29.78.H01.1.454.CMB.1.raw
  modified_base (490)..(490): a, c, t, g, unknown or other
  misc_feature (490)..(490): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtcccgccgaggctccgagggaaggggctggagtgggtctcggctattagtggcagtggtggcgctatatattatgcagacgcccgtaggaacgggccggttcacctatttccgagacgactaagttacgaagaacaccgtctagtaatctgaacaaaacgttggaagacgtccgtaggacgacctcggaaccggacaccgggtccgtactttaacttagttagtgggttaaaaggacgtaggacctagggaaacggtccggggtaacccgggacccggtaactccggaaccgtaccggtggggaccggaaggggaccgtcgtacggtcctaccgccgtcctacgaaccncccgtaccctaacgacccggggtaccaccgttacccggtccccttcccccgttccgaccccgtacccttaccccgtaaccgtaaaccgaccgaccccgttaacccttaccgggccgggggtaacccgtccgaacccgggcccgtaaccggtccccggtacgggttaccccgtccgggtaccggttacccgggttaacggtaaacccggtaccctttaacccgttacccgtaaccggttacccttaccgttacgttacggacccggggtacggtaccgggtccgtacccggggaacgtaacccgggacggaccaagttaacggcagg

SEQ ID NO: 53805 - DNA, 607 bp, Homo sapiens
  misc_feature: GYAE6OF01EU1CD.29.78.H01.1.454.CMB.1.raw
  modified_base (576)..(576): a, c, t, g, unknown or other
  misc_feature (576)..(576): n is a, c, g, or t
  modified_base (603)..(603): a, c, t, g, unknown or other
  misc_feature (603)..(603): n is a, c, g, or t
  modified_base (605)..(605): a, c, t, g, unknown or other
  misc_feature (605)..(605): n is a, c, g, or t
tcagatagagtactcacgaccggtgctcgatttagtgtgagtagtttgggtttgggggcgcctgggtacggccgggggggtcgctgagactctcctgtgcggcctctggatttaagttttaggagtcatgccatgaactgggtccgccaggctccaggggaagggctggagtgggtctcggctattagtggcagtggtggcgctatatattatgcagaccgccctgaagggccgttcaccgtatttccagagacaattcgaagaacacgctgtatctgacaaatggagagcctgacgactcgacgaacgacggtccgtctagtttattggtagttaaaggcgagcgtagaacggtacgggacccggggccgacgttcgaccgacgtcggggcaggggacgcgtcggtaccaccgtctcccgtcgacgccctaccgaccgaacggccctaacgttccggtcccttcccccgtcggtcccctacccgtcctaccgaacgacgcctaaccgtcgtcggggcacgacggccgccgtggctcgcgtacggacacggacctacgtccagtcctctatcgtgngcggtgtcggacacggctacgaatcgngncg

SEQ ID NO: 53806 - DNA, 854 bp, Homo sapiens
  misc_feature: GYAE6OF01D6R83.29.78.H01.1.454.CMB.1.raw
  modified_base (144)..(144): a, c, t, g, unknown or other
  misc_feature (144)..(144): n is a, c, g, or t
  modified_base (841)..(841): a, c, t, g, unknown or other
  misc_feature (841)..(841): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccnccaggctccaggggaagggctggagtgggtctcggctattagtggcagtggtggcgctatatattatgcagacgccctggaagggtcccggttacacctattttcccgagtacgaactaagttcgaaagaacacgtctgtactctagctaaaagtggaagacgtcctgaacgtactacggaaccgaaccgtaccggccgttaccttaagttttaagtttggttaacgggtttaaaacggcgacggtcgttaacggggaaacgttacccggggggaaccccgggggtacccctagtttaccgaacccgtacggttccggggggaccgtaacggggggacgaccgtttcgggtaacccgtacccggttccttcccccgttgaaacccggttccccgtaaccccgaaacccggtaaaccgggggtccccctaacggttcccccgggtttcccctttcccccccggttcggggtaccccctacccccgttaccccgtacccgtaaaccggacccgtaaccgtaccccgttcgggtaccggggacctaacggaccgtaccgaccgtccccggtaggtcctacggtacccgtttggacccgtaaacgtaccgtaccgtttacctaaccgttacctacgtttaacgccggttacgggaccgggtcggtacccgggttaccgggaacggtaccgggtccggtaanaaccgttagcgac

SEQ ID NO: 53807 - DNA, 758 bp, Homo sapiens
  misc_feature: GYAE6OF01DFZED.29.78.H01.1.454.CMB.1.raw
  modified_base (182)..(182): a, c, t, g, unknown or other
  misc_feature (182)..(182): n is a, c, g, or t
  modified_base (221)..(221): a, c, t, g, unknown or other
  misc_feature (221)..(221): n is a, c, g, or t
tcagatagagtactcacgaccggtgctcgatttagtgtgagtagtttgggtttgggggagagaggagtccacccctgggatcttcaggtgttttcatttggtgatcaggacggaacagagagaactcaccatggagtttgggctgagctggtctttttcttgtggacttaattttaaaaggngtccagtgtgacgtgcgagttggtggagtcgtgggggcnccgtggggtacgggccgggggggtccgtgagacttctcctgtgcggcctgtggatttaagttttaggagtctatgaccagtagaacgtcgggtcccgccgaggcctaccggagggaagggcgtggaggtcgggtacgtcggcttagttaggtggtcgaggttggtggtcgacttagtattattagtcgcgaacgaccgtccgtagggaacgggtccggttacaaccgtactttaccgaagtaacgaactaacgttacgaaacgaacgacgtacttagtacttacgtacgactaaagtagggaacgtacgtaccgtagtaacgacgtacggaaccggaaccgtaccgggtacccttacgttaagtttacgttaacggtttaaggttaaacgggtacgggacggtaacggttaacggggtaaccggtaaccgggggaaccccggggtacccggttaacgttaccgggaacccgttacgggtaccgggggaccggtaaccgggggtacgtaccggttacggtacccgtacccggttcccg

SEQ ID NO: 53808 - DNA, 697 bp, Homo sapiens
  misc_feature: GYAE6OF01A9MC8.29.78.H01.1.454.CMB.1.raw
  modified_base (689)..(689): a, c, t, g, unknown or other
  misc_feature (689)..(689): n is a, c, g, or t
tcagatagagtactcacgaccggtgctcgatttagtgtgagtagtttgggtttgggggcgcctgggtacggccgggggggtcgctgagactctcctgtgcggcctctggatttaagttttaggagtcatgccatgaacgtgggtccgccaggctccgagggaagggctggagtgggtctcggctattagtggcagtggtggcgctatatattatgcagacgccctggaacgggtccgttacacctattccagagacaactcgaagaacacgctagtatctgacaaagtggaagacgctagagacgtccggaacgacgaccggtccgtcttaagttagtttgtaaggttaaaggcgaagtcggtaggtaaacggtacccgggggaccgggacccgtacgttacgaaccgtacggtcggggaccggaggggaccgtcgttacgggtacctaccgtcctaccgtacgaccgaccctccgaacccgtaacgggcccctaacgttcccggtaccttcccccgtaccggcccctacccgttcccaaccgaacgtacgtaccccgtacgtccggtaccgggcacgacgtacgaccgcccggtggccacggtcgtacggtacgaacggtacctaacgtccgtacgtcctacttacgtcgacgggcggaccggtcgtacgggacgaacggtcgaaccngtagagcg

SEQ ID NO: 53809 - DNA, 620 bp, Homo sapiens
  misc_feature: GYAE6OF01E2OT7.29.78.H01.1.454.CMB.1.raw
  modified_base (308)..(308): a, c, t, g, unknown or other
  misc_feature (308)..(308): n is a, c, g, or t
  modified_base (519)..(519): a, c, t, g, unknown or other
  misc_feature (519)..(519): n is a, c, g, or t
  modified_base (619)..(620): a, c, t, g, unknown or other
  misc_feature (619)..(620): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaacgggccgttcaccatttccagagacaattcgaagaacacgctagtactctgacaaatggagacgcctagagctacgacgacnccggtccgtctattattagtaggttaaacggcgagctaggtaactaccgggggacccgggcccgtacgttacgaccacggtcggggaccgaaggggcgcgtcggtccaccgtctcctcacgccctaccacccgaacggcccacgtccgtcccttcccccgcgcccctaccctccctaccgaacgcaccgtaccgtcgtcggggccacgacncgacgtcccgcggaccgtgtcccgtggtaccgaaggtaccttaccgtccagttacctctacgtcgtagacggcggtcgtcggacgtacggcgtagatagnn

SEQ ID NO: 53810 - DNA, 641 bp, Homo sapiens
  misc_feature: GYAE6OF01AUJW2.29.78.H01.1.454.CMB.1.raw
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaagtggagagcctgagactcgacgacacggccgtctattatgtagttaaaggcgagcgtaggaacgtaccggggacccgggccacgagtcgacccgacggtcgggggaccgagggggaccgcgtcggtccacccgttcctccctcacgccctaccaccgaacggccctacgtccggtcccttcccccgtggaccctacccctccctaccgaacgaccgaccgtacccgtcggtcggggacctacgacgcgaccgcccggtcggcctcggccgtcggacgtaacggtaccttaccgtcgtaacgttacctacgttacgtctacgggcggccgggtcgtcgggaccgaacgggcgtataccgtagc

SEQ ID NO: 53811 - DNA, 942 bp, Homo sapiens
  misc_feature: GYAE6OF01C4EKJ.29.78.H01.1.454.CMB.1.raw
  modified_base (236)..(236): a, c, t, g, unknown or other
  misc_feature (236)..(236): n is a, c, g, or t
  modified_base (940)..(940): a, c, t, g, unknown or other
  misc_feature (940)..(940): n is a, c, g, or t
tcagatagagtactcacgaccggtgctcgatttagtgtgagtagtttggggtttgggggcgcctggggtacgggccgggggggtcgctgagactctcctgtgcggcctctggatttaagttttaggagtcatgccatgaacgtcggggtcccgccaggctccggaggggaaggggctgggaggtggggtcgtcggtacttattaggtggcgaggttggtggcgctaatattattangcacgaccgcccgtaggaacggggtccggttacaacctactttaccgaaggaagtaactaaacgttacggaaaacgaaccgacggtacttaggttaactactacggaacaaaggtggtaacggacgtccgttaggaacgaccgtaccggaacgaccggtaccgggtaccgtttacgttaagttttaagtttacgggtttaaagggttaaacgggcggtaacggtacggttaaggggtaaaccgggtaacccggggggaccccggggtaccccgtaacggttaccggaacccgtacggggtaccgggggaacccgggtaacggggaccggtcgggttccggtaacccgtacccgggttacccttacccgtacggacccgtacccctacccggtaaacccggaccgggtaccccgttacggtttccccggttacccccgttttccccgccggtacccctacccgtcccctaacgaacgtaccgtaccggttacccggtacgggtaccggggaaccaacccggtcggacccgacccgggtccccggtaggggttccctaacccggggttcccgtaagggtacccttaaaacggggtcccttttaacccgtaaccgtacggttaccctacgtttaaccggtccgggtaggaaccggggttcgggtacccgtagggaaccccgggtagggtaccccgaggacttaggcncg

SEQ ID NO: 53812 - DNA, 841 bp, Homo sapiens
  misc_feature: GYAE6OF01ER0WF.29.78.H01.1.454.CMB.1.raw
tcagatagagtactcacgaccggtgctcgatttagtgtgagtagtttgggtttgggggcgcctggggtacgggccggggggggtcgctgagactctcctgtgcggcctctggatttaagttttaggagtcatgccatgaactgggtccgccaggctccgaggggaaggggctggagtgggtctcggcttagttagtggcaggtgggtggcgctatatattatgcagaccgcccgtggaacggggtccgttacacctactttccgagaacgaactaagttacggaaacgaacacgtactagtatctagacaagtaggagacgcgtagagacgtacggacgaccgtacgggtccgttacttattagttacgttaaggttaaacggcgtaggtcgtagggaacggtaccggggaccggtacccgtacgtacgaccgtacgggtcggggaccggacggggtaccgtcgtccggtacctacccggtcccttacccgaccgaacgtcccctaaccccggaaacccggaacccggggtacccctaccggttcccggttcccccgttcccccggtccggtaccccctaccccgtacccctaacccgaaccgtaccggtcccgtaacccggtcgggtaccgggggacctaaccgaccggaccgtacccggtcccgggtaccgggtccgttccgggtaccccgttacgggttaaccggtaaaccggttacccgtttaccttaaccccgggttacgttaaacccgttacgtttaccgtccgggttacgggtacggggtaccccgggcggggttacccgaaccgggtaaacggccggaactacggttagcacg

SEQ ID NO: 53813 - DNA, 621 bp, Homo sapiens
  misc_feature: GYAE6OF01E3GY4.29.78.H01.1.454.CMB.1.raw
  modified_base (185)..(185): a, c, t, g, unknown or other
  misc_feature (185)..(185): n is a, c, g, or t
  modified_base (222)..(222): a, c, t, g, unknown or other
  misc_feature (222)..(222): n is a, c, g, or t
  modified_base (374)..(374): a, c, t, g, unknown or other
  misc_feature (374)..(374): n is a, c, g, or t
  modified_base (385)..(385): a, c, t, g, unknown or other
  misc_feature (385)..(385): n is a, c, g, or t
  modified_base (424)..(424): a, c, t, g, unknown or other
  misc_feature (424)..(424): n is a, c, g, or t
  modified_base (440)..(440): a, c, t, g, unknown or other
  misc_feature (440)..(440): n is a, c, g, or t
tcagatagagtactcacgaccggtgctcgatttagtgtgagtagtttgggtttggggtctgagagaggagtccacccctgggatcttcaggtgttttcatttggtgatcaggacggaacagagagaactcaccatggagtttgggctggagcgtggctttttcttgtggctaatttttaaaaggngtccagtgtgacgtgcagttggtggagtctgggggcnccgtggggtaccggccgggggggtcctggagactctccgtgtgcggcctcgtgggatttaaggtttttaggagtcatgccatgaactgggtccgccaggctccaggggaagggcgtggaggtgggtctcggctagtagtggcagtggtggcntatagtattangcagacgccctggaacgggtccgttcacctattccaganacaattacgaagaacncgctagtactctagacctaaagtagggagacgcctaggagtactacgacgacgaccggccgtcttattagttgtagttaaaggcgtagtcgtaagggaacggaccggggtaccccgggggacccgtacgttcgacccgtaacggtcggggacccggaaggggtccggcgttcgggtacccg

SEQ ID NO: 53814 - DNA, 683 bp, Homo sapiens
  misc_feature: GYAE6OF01EV3V4.29.78.H01.1.454.CMB.1.raw
  modified_base (673)..(673): a, c, t, g, unknown or other
  misc_feature (673)..(673): n is a, c, g, or t
  modified_base (681)..(681): a, c, t, g, unknown or other
  misc_feature (681)..(681): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtagttaaaggcgagctaggaatacggggaccggggcccgacttcgaccaacgtcggggaccgagggggaccgtcgtcgggtaccaaccggtcttcccgtacgacgcccttacccaaccgtaacggggaccccagttacccggttcccgtttcccccccgtcgggacccctacccccgttcccgtacccaaacggtaacgacccgtaccccgtccggttcgggggaccaaccgtacggccacggtccccgtagggtcctacggtcccgtggtaccgaacggtacttaccgttccgaacgttacctcttaacgtccttagggacggtccgggtcgtaggaccgaaacgggccgaanacgtaggncg

SEQ ID NO: 53815 - DNA, 632 bp, Homo sapiens
  misc_feature: GYAE6OF01E32X7.29.78.H01.1.454.CMB.1.raw
  modified_base (395)..(395): a, c, t, g, unknown or other
  misc_feature (395)..(395): n is a, c, g, or t
  modified_base (629)..(629): a, c, t, g, unknown or other
  misc_feature (629)..(629): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgccaggctccagggaagggctggagtgggtctcggctattagtggcagtggtggcgctatatattatgcagacgccctgaagggccgttcaccatttccagagacaattcgaagaacacgctgtatctgacaaatggagagcctgagactcgacgacacggcgtctattattgtagttaaggcgagctggaatacgggaccgggccgacgttgaccgacgtcggggccagggggacgcgtcggtcaccggtntccctcacgccctccgaccgaacgggcccacgttccggttccttccccccgtcggccctacccttcctaccccaagacgccacccgtcgtgggggaccacgacgcacggccccgtgggccttcggtccgttcggtacgaacgggtaaccttaccgttacccagttaaccgtcttaacgttccgttaggacggtcccgggcgtacgggcccgtaaagggtccgactacgttaggntag

SEQ ID NO: 53816 - DNA, 769 bp, Homo sapiens
  misc_feature: GYAE6OF01EAILM.29.78.H01.1.454.CMB.1.raw
  modified_base (216)..(216): a, c, t, g, unknown or other
  misc_feature (216)..(216): n is a, c, g, or t
tcagatagagtactcacgaccggtgctcgatttagtgtgagtagtttggggtttggggagagctctggggagtctgcaccatggctcggaccccactcctcttcctcaccctcctcctccactgcacagggtctctctcccagcctgtgctgactcaatccgccctctgcctctgccctcccgtgggacggctcggtcaaggtccacctgtactcngagcaggtcggacacgacgcagcctacgccagtcgtctggctatcagcaggacgccaacgacgaccgggtcccttacgttacgtgatagaactacggtacaacgtaagtggtaactgggactacgtaccaacgagggaaccggggtaaagggggaccggtactcccgtaggtacgtccgtccttacgtactacggttcctaccgacggtcccgtcggtaccgggtcctacgggacgttacccgtaccctaacccgtacaaccgtaaccgtttccccgtcccggtaccgttacccgtacggtcggttacgggtaacgtaacggtcgggaacggtccgttaactaaccgtttaacgttcgtaaccggttacggaaccgggtacgggttcgggtacctaaccggttcggtaaccgttattaccggggtaccggttacccgggttaacccggggggaaaccgggtacccgttaacgggttccccggttaaccgggttcccggtacccgggtaccgaaacccggtaccccgtaaacggccccctaaccccggtaacgg

SEQ ID NO: 53817 - DNA, 700 bp, Homo sapiens
  misc_feature: GYAE6OF01AKMAV.29.78.H01.1.454.CMB.1.raw
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccgagggaagggctgggagtgggtctcggctagttagtggcaggtggtggcgctatatattatgcagaccgcctggaacgggccggttaccacctatttccagagactaattacgaagacacgctgtatctgactaagtggagcgcctgagactcgacgaccgaccggccgttcttaacttagttggtaggttaaacggcgagtcgtaggaacggtaccggggacccgggcccgtacgtcggacctacggtcggggaccgaaggggcgtctcgggtccaccgttcctcccgtacaccggtccctaccgacccggaaccgggtccctacgttccggtcccttccccgtcgggtcccctaccccgttcccaccgaacgcgaccctaccgtcggtacggggaccacgacgaccgtaccgcccggtggacccgtcgccggttacggtaacgaccggtacttaacccgtaccgtagtttaaccctcgttacgtccggtaggaccgggtcccgggacgttaccggacggaacgggtaccacggtactccgtgcg

SEQ ID NO: 53818 - DNA, 712 bp, Homo sapiens
  misc_feature: GYAE6OF01EZAR1.29.78.H01.1.454.CMB.1.raw
  modified_base (145)..(145): a, c, t, g, unknown or other
  misc_feature (145)..(145): n is a, c, g, or t
  modified_base (703)..(703): a, c, t, g, unknown or other
  misc_feature (703)..(703): n is a, c, g, or t
  modified_base (709)..(710): a, c, t, g, unknown or other
  misc_feature (709)..(710): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccnccaggctccgagggaaggggctggagtgggtctcggctattagtggcaggtggtggcgctatatattatgcagacgccctgaacgggccggttcaaccatttccagagacaattcgaagaacacgctgtatctgacaaagtggacgagccgtagacgactcgacgacgacggtccgtactaatttacgtgttaggttaaacggcgagtacgtaggaaacggtaccggggaaccgggtcccgacgttcgacccgacggtcgggggaccgaacgggggaccgtcgtgggtaccctaacccggtccttcccgaccgacggtacccctacccgaacccggaacgggtccccaaccgttccggttccccttcccccggtcggccctaccccgtcctaccgaacgacgaccctaaccgtcgtccggggaccacgacgccgacggcccgtgggtcctcggtcccgtacggtaccgaacggtacccttaccgttaccaccgttaacctacgttaccggtacgaacgggtcgggtccgtacggtaaccgacggtaccgactaaacgnggaccnncg

SEQ ID NO: 53819 - DNA, 827 bp, Homo sapiens
  misc_feature: GYAE6OF01CDVZO.29.78.H01.1.454.CMB.1.raw
tcagatagagtactcacgaccggtgctcgatttagtgtgagtagtttgggtttgggggcgcctgggtacggccggggggtcgctgagactctcctgtgcggcctctggattaagtttaggagtcatgccatgaactgggtccgcaggctccgagggaaggggctggagtgggtctcggctattagtggcagtggtggcgctatatattatgcacgacgcccgtaggaacgggccgttacaccgtatttccaggacgaactaattcggaaagtaaacacgtctgtactcgtgacaaagtggagacgtcctaggacgacctcggaacgaccgaccgggtccgttacttagtttacgttagttaaggtttaaagggccggaagtacgttagggaaacggtaccgggggacccgggtccccgtaacgttcgaacccgtaacggtcgggggacccgtacgggggaccgtccggttcgggtaccctaacccggttccgtcccgttacgaccggtaccccctaccgaaccccgggtaaaccggggccccgtaacgttccccggttccccgtttaccccccgtacgggtaccccttacccccgtaccgttaaccccgaaggtaccgaccgtaacccgttccgggtacggggaccctaacggacgtaccgtccggcccgggttcgggacccgtccgggtacccgttagggtaacccgtaacgggttaccctaaccggttaccgtaaccgttaccttacgttaccgttccggtacgggacgggtccgggtacggtaccggacgggttaacccgggacgaccgtaacgttgggcacgg

SEQ ID NO: 53820 - DNA, 742 bp, Homo sapiens
  misc_feature: GYAE6OF01CNDM1.29.78.H01.1.454.CMB.1.raw
  modified_base (153)..(153): a, c, t, g, unknown or other
  misc_feature (153)..(153): n is a, c, g, or t
  modified_base (213)..(213): a, c, t, g, unknown or other
  misc_feature (213)..(213): n is a, c, g, or t
tcagatagagtactcacgaccggtgctcgatttagtgtgagtagtttgggtttggagtctgcaccatggctcggaccccatcctcttcctcaccctcctcctccactgcacgagggtcctctctccagcctgtgctcgactcaatcccgcctntcgcctgtcgaccctccggtagggcgtccgtcggtacgaacggtccacgttcgtactcgngacgcgtaggacgaacacgacgctaacgtccgaacgcttacgtccgtctggaactccgagacgacgtaggaccgtaccgaagacccggtccggtacttacgttagtagacgttaacgaaccgttacaaacgtaaacggtataacggttcgaggtaaccgttaaccgacgaaccggtacgggaaccggggttaaacggggacgtaaccctttcggaggtaccttccggttacgtactacgtaaccgttccacggcgttcgccggttacggactccggacttaccaaccgttacccagtaccgtacctcccggtaccgtaccgtaccgtacggtgtacggtaggtacgacgggtacgttacgtacggtttaactagttccgttaacgacggttaaccgggcgttaccgggtaacgtcgtacgtacgtacgttacgggtaccgtcgggtaacccggaacggtacggtcgaccgtaccgtacggcctaacggcccgaccgaccgaccgctaacgtcactccgttccgtacccg

SEQ ID NO: 53821 - DNA, 714 bp, Homo sapiens
  misc_feature: GYAE6OF01DFUS5.29.78.H01.1.454.CMB.1.raw
  modified_base (146)..(146): a, c, t, g, unknown or other
  misc_feature (146)..(146): n is a, c, g, or t
tcagatagagtactcacgaccggtgctcgatttagtgtgagtagtttgggtttggggtccgagccatggtgcagactccccagagctctcctcctcctccactgcacagggtctctctcccagcctgtgctgactcaatcgccctntgcctctgcctccgtgggacgctcggtcaaggtcacctgtactctgagcagtcggacacagcagcctacgccagtccgtcttggcagtcgagcaaggagccacgaacgaccgggtcccttacgttacttagatagaactacgtacaaacgtaagtgacgtcgggactaacgtcaacgaggacgggaacggggggaaccggtcctcccgtagacgttcgtcttcgacgtacgtctcgacgtcgtccggtcggccgtaggaccgtccgacctaccgtacgtaacctacgttccccgtacccgtcccgtacgtacgtacggtaggacggtacgtggacggtacttacgttaaccttagttacgtcggttaccgaaccggtccggtcgggtacctacggtcggtacgttacgttacgggttaccggttaccggtaccggggaccgggtaacccgtaacgggtcccgtaccggtcgggttaaccgccggaacccgaacccggtaacccgtacccctaaccccgtacgtttacccgacccgtttaacccgttcccgttaccccgttaacccccg

SEQ ID NO: 53822 - DNA, 791 bp, Homo sapiens
  misc_feature: GYAE6OF01D6ZVP.29.78.H01.1.454.CMB.1.raw
  modified_base (788)..(788): a, c, t, g, unknown or other
  misc_feature (788)..(788): n is a, c, g, or t
  modified_base (791)..(791): a, c, t, g, unknown or other
  misc_feature (791)..(791): n is a, c, g, or t
tcagatagagtactcacgaccggtgctcgatttagtgtgagtagtttgggtttgggggcgcctgggtacggccgggggggtcgctgagactctcctgtgcggcctctggatttaagttttaggagtcatgccatgaactgggtccgccaggctccgaagggaagggctggagtgggtctcggctattagtggcagtggtggcgctatatattatgcagaccgcccgtaggaacggggtcccggttcaacctacttttccgaagacgaactaagttaccgaaagaaccaaccgcttacggtaacttcctaggtaacctaaaagtgggaacggacgtaccctaggaacggtacctaccggaaaccgaccgtaccgggtcccgttattaacgttttaagtttggttaacggtttaaaacggccgaaggtcgtaagggaaacggttacccggggggaccccggggtcccgtaagttccgaaccgtacggtcgggggaccgagggggacccgtcgtcggtacctacccgttcctcccgtacaccggtccctaccgaaccggtaaccggccctacgttacccggttccccttccccccggtggcccctaacccctaccgttacccgaaacgccgtacccgtaccgtccggggtcggggaccacggacgaccgtaccgggcccgttcggggaccctcggcccgttacgggaaccgtaacggtaccttacgttacccgaacgttcctactacggtccgtaggacggtccgggactcgggaacgacggtcagaacgncgn

SEQ ID NO: 53823 - DNA, 825 bp, Homo sapiens
  misc_feature: GYAE6OF01B1GA8.29.78.H01.1.454.CMB.1.raw
  modified_base (269)..(269): a, c, t, g, unknown or other
  misc_feature (269)..(269): n is a, c, g, or t
  modified_base (810)..(810): a, c, t, g, unknown or other
  misc_feature (810)..(810): n is a, c, g, or t
tcagatagagtactcacgaccggtgctcgatttagtgtgagtagtttgggtttggggtctgagagaggagtccacccctgggatcttcaggttgttttcatttggtgatcgaggacggaacagagagaactcacatggtagtttgggctgagcgtggtctttttcgttgtggtacttaagttttaaaaggtgtacctagtgtgacgtgcgtaggttggtggagtcggtgggggccgtccggttagggggtaccggggccgggggggtcncgtaggaacgtcctcctccgtggtcggccggtccttacgtagggttaattttaaagggttttaggacgttacgacgttcggacctaagtacggtaaccgttccgggttacccgccgtacgggtcctaccgggaagggggaacgggggtcgttaggggaacgggttcgggtaccgttcgggtacttaaggttacgggtggtacgtaggggttcgggtcggtacgtacttaagttaattacgttagcggaaccgaccggtaccgtccggtagggtaaaccgggtcccgttactaaccgtttacgttaccgaaggtaacggaaccttaaacggttaccggaaaacgtaaccgtaccgtacgttaagtacgtacgtacgaacgtaaggtaggacgtaacgtccgtaagaccgtaacgacggaaccgacgtaccggtaccttagttaacgtttagtaacggtaaggttacgacggtagacggtaagggaaccgggtcccggggaccggtacccgtcgacggacccgtcgggcgggacggtagggcnccggttcggtacccg

SEQ ID NO: 53824 - DNA, 673 bp, Homo sapiens
  misc_feature: GYAE6OF01CUFOS.29.78.H01.1.454.CMB.1.raw
  modified_base (527)..(527): a, c, t, g, unknown or other
  misc_feature (527)..(527): n is a, c, g, or t
  modified_base (572)..(572): a, c, t, g, unknown or other
  misc_feature (572)..(572): n is a, c, g, or t
  modified_base (581)..(581): a, c, t, g, unknown or other
  misc_feature (581)..(581): n is a, c, g, or t
  modified_base (672)..(673): a, c, t, g, unknown or other
  misc_feature (672)..(673): n is a, c, g, or t
tcagatagagtactcacgaccggtgctcgatttagtgtgagtagtttgggtttgggggcgcctgggtacggccgggggggtcgctgagactctcctgtgcggcctctggatttaagttttaggagtcatgccatgaactgggtccgccaggctccgagggaagggctggagtgggtctcggcttattagtggcaggtggtggcgctatatattatgcagaccgccctggaacggggtcccggttaccacctattttcccgaagacgaacaatttacgaaagaaccacgctagtatctgacaaagtggagacgcctagacgaccgtaccggaacgaccgaccgggtccgttacttattacgtttggttaaggttaaaacgggcgtaaggccgtaggtaaacggttaccgggggacccggggaccccgtattccgaccgtacggtcgggggaccgaggggaccgcgtcggtccaccgtctcctcgacgtccctccgaaccgacgggccctagttccgtcccttccccgngccctaccctccaacacgcgcctaccgtcgtcgggcctacgcgcnccgtcccgngggtcctcgtcgtcggtacaagtccttactaccgacgttacctaccgtacgtcgtggacggtccgggacgtcggacgaacgcgatgtacgnn

SEQ ID NO: 53825 - DNA, 673 bp, Homo sapiens
  misc_feature: GYAE6OF01A9PFG.29.78.H01.1.454.CMB.1.raw
  modified_base (670)..(670): a, c, t, g, unknown or other
  misc_feature (670)..(670): n is a, c, g, or t
tcagatagagtactcacgaccggtgctcgatttagtgtgagtagtttgggtttgggggcgcctgggtacggccggggggtcgctgagactctcctgtgcggcctctggatttaagttttaggagtcatgccatgaactgggtccgccaggctccagggaagggctggagtgggtctcggctattagtggcaggtggtggcgctatatattatgcagaccgcccgtggaacgggccggttcacctatttccgagagaacaagttcgaaagaacacgctagtatctgacaaagtggagacgccgtagagtactcgacgaccgacggccgtacttagttagttgttaaggttaaaggcgagtcggtaggaacgtacggggacccggggcccgtaagttcgaccgaacggtcggggaccgaggggaccgtcgtcggtacctaccgtcctcccgtcgaacgccctaccgaaccgacgggcccgtacgtccggtcccgttcccccgtgtccccacccgtcctaccgaacgccgaccgtacccgtcggtacgggaccacgacgccgacgcccgtcgggtccgtcgtaccggtcggtaccgtaacgtaccgttacctccgtacgttacctcttacgtcgtggacgggccggcgtcggaacgtacgggccgagagtagngag

SEQ ID NO: 53826 - DNA, 611 bp, Homo sapiens
  misc_feature: GYAE6OF01AFSOQ.29.78.H01.1.454.CMB.1.raw
  modified_base (555)..(555): a, c, t, g, unknown or other
  misc_feature (555)..(555): n is a, c, g, or t
  modified_base (604)..(604): a, c, t, g, unknown or other
  misc_feature (604)..(604): n is a, c, g, or t
  modified_base (606)..(606): a, c, t, g, unknown or other
  misc_feature (606)..(606): n is a, c, g, or t
  modified_base (611)..(611): a, c, t, g, unknown or other
  misc_feature (611)..(611): n is a, c, g, or t
tcagatagagtactcacgaccggtgctcgatttagtgtgagtagtttgggtttggtggtctctctcccagcctgtgctgactcaatcgccctctgcctctgcctccctgggaggctcggtcaaggtcacctgtactctgagcagtggacacagcagctacgccatcgcttggcatcagcagaggccagacacgggcctcgttacttgatgacagtcaaacaatgatggcagtcacgagaccggaaggggggacggactccctggatccgcttctcagtcctccgagccgtcgtgggcctgacgcgcctacctcacgtaactttccggcctccgagtctaggaggatggacggtctaggacttagttactgtacgacggtacgtggggcctacgtcggtctaaggtttcgagggttccttaccgggaaccggggtaccaacggtccgaccggtcggtaccgaccgacgtacccgaacggccccaaccccgtatacggtacctacgttacccttccggttacccccaccttcccgtactaacggttacctcgttacncgtacggtacggccggtagtccgggactaaacggcgtacccaaagtcgntnacgtn

SEQ ID NO: 53827 - DNA, 628 bp, Homo sapiens
  misc_feature: GYAE6OF01EF98H.29.78.H01.1.454.CMB.1.raw
  modified_base (543)..(543): a, c, t, g, unknown or other
  misc_feature (543)..(543): n is a, c, g, or t
  modified_base (568)..(568): a, c, t, g, unknown or other
  misc_feature (568)..(568): n is a, c, g, or t
  modified_base (574)..(574): a, c, t, g, unknown or other
  misc_feature (574)..(574): n is a, c, g, or t
  modified_base (618)..(618): a, c, t, g, unknown or other
  misc_feature (618)..(618): n is a, c, g, or t
  modified_base (624)..(624): a, c, t, g, unknown or other
  misc_feature (624)..(624): n is a, c, g, or t
  modified_base (626)..(628): a, c, t, g, unknown or other
  misc_feature (626)..(628): n is a, c, g, or t
tcagatagagtactcacgaccggtgctcgatttagtgtgagtagtttgggtttggtggtctctctcccagcctgtgctgactcaatcgccctctgcctctgcctccctgggaggctcggtcaaggtcacctgtactctgagcagtggacacagcagctacgccatcgcttggcatcagcagaggccagacgacgggccctgttacttgatgacagtacaaactaatgatggacagtcaacgaggacggaaaggggggaccggactcccgtgactcgtcttctcgactctccagtcctcgtcgggcctggacgccgtacctacctacgaactacgtcccgtcccggcctaccgagtccgtaggaacggagtggacggtctacgtaacttaattacccgtgttaccgacgggtaccgtgggggacctacggtggtaccttacgttaccggtacggggttacccggttaccgggggaacccggggtaccgtaaccgggtccgtacccggttcggtcccgtacgacccgacccgaacgccccaaccncttcgcctacgtctccgttcccccnccttcncctagtcctctactcgacggtggcggtcgacggccgaaggtccntaacgngnnn

SEQ ID NO: 53828 - DNA, 780 bp, Homo sapiens
  misc_feature: GYAE6OF01EFYFW.29.78.H01.1.454.CMB.1.raw
  modified_base (225)..(225): a, c, t, g, unknown or other
  misc_feature (225)..(225): n is a, c, g, or t
tcagatagagtactcacgaccggtgctcgatttagtgtgagtagtttgggtttggggtccgagccatggtgcagactccccagagctctcctcctcctccactgcacagggtctctcctccagcctgtgctagactcaatccgccctctgcctctgcctccgtgggagctcggtacaaggtcactgtactctgagcaggtggacacgagcagtctacgccatcgngttggcactcagcagacggccagaccgccggtacccttcgttacgtgataggaactactacaactaagtgagtggacacgtcaaccgaggacgggaacggggtacggaccttaccgtgtaccgttcggtaccttcgtaccgtagttcccgtaccgaaggtcctaccgggtcgggtcccgtagggacccggtacccggttaccttaccccttaccaaaccgttacccgtacccgttcccccgggtacccttaccgtaacggttacggtagggtacggaacttacgggtaccggtacgttaacgttaacgtttaacgtttactacggtacgtaccgggtaccggtcgggtaccttacggtacggccgttaaccggttccggttaacggttcccggggttacccggggtaaccccggggtaaccggtaaccgggtacccgtacccggttaccgggtacccgggtacccgaacccggtaacccccggaaaccgggtaccccctaaacccccggtcgttacccgtaccgtaaccttcccggttacccgttacccccccgg

SEQ ID NO: 53829 - DNA, 671 bp, Homo sapiens
  misc_feature: GYAE6OF01BJ0RT.29.78.H01.1.454.CMB.1.raw
  modified_base (221)..(221): a, c, t, g, unknown or other
  misc_feature (221)..(221): n is a, c, g, or t
  modified_base (248)..(248): a, c, t, g, unknown or other
  misc_feature (248)..(248): n is a, c, g, or t
  modified_base (343)..(343): a, c, t, g, unknown or other
  misc_feature (343)..(343): n is a, c, g, or t
  modified_base (393)..(393): a, c, t, g, unknown or other
  misc_feature (393)..(393): n is a, c, g, or t
tcagatagagtactcacgaccggtgctcgatttagtgtgagtagtttgggtttggggtctgagagaggagtccacccctgggatcttcaggtgttttcatttggtgatcaggacggaacagagagaactcaccatggagtttgggctgagctggtctttttcttgtggcttattttaaaaggtgtccagtgtgacgtgcagttggtggagtcgtgggggcnccgtggggtaccgggccgggggggtcncgtggagtactcctccgtgtgccggtcctcgtggtatttaaggttttaggagtcatgccatagacgtggtcccgcaggcctacgaggggacgggngtggaggtcggtcgtcggcttagttacggtcggcgtaggtggtacgggcncgttatagttattagtcgcgtaacggacccgtcccgtaggtaacggggtcccgttacccgacccgttacgtttacccgagtacgaactaacgtacgaaacgaacgacgtcttagtactcgagactaagtggagacgtcgtagacacgtcgaaccgacgtaccgtccttacgttatttagtagtagtaaacggcgtagcggtaggaaccggtccggggtacccgggaccgtcgtacggaccgtacgggcgggccgggacgggacgtcggtcgtacccgg

SEQ ID NO: 53830 - DNA, 735 bp, Homo sapiens
  misc_feature: GYAE6OF01A2C5O.29.78.H01.1.454.CMB.1.raw
  modified_base (245)..(245): a, c, t, g, unknown or other
  misc_feature (245)..(245): n is a, c, g, or t
tcagatagagtactcacgaccggtgctcgatttagtgtgagtagtttgggtttggggtctgagagaggagtccacccctgggatcttcaggtgttttcatttggtgatcaggacggaacagagagaactcaccatggagtttgggctgagctggctttttcttgtggctattttaaaaggtgtccagtgtgacgtgcagttggtggagtcgtgggggcgccgtggggtacgggccgggggggtcnctgagactctcctgtgcggcctctggattaagttttaggacgtcatgccatgaacgtggggtcccgccgaggcctccgaggggaacgggggctgggacggtggggttcgtccgggcttagttaggtgggctaggtggtggcgactatatattagtgcagccgcccgtggaacgggtccgttacaccgtatttcccagacgactaagttacgaaacgaacacgtctaggttacttccgtagacctaaaagtcgggaaacgtacgtacccgttaggaacggtaaccgttccgggaaaccggtaaccgaacccgggtccgtttaccgttaaattttaaccggttgggttaacggtttaaaacgggccggtaaacggttccggtaacgggtaaacgttacccgggggggaccccgggtaccccgtacggtttaccggaacccgtaaccgggtcgggggaccccgaaggggggtacctccggttcgggtaccccg

SEQ ID NO: 53831 - DNA, 680 bp, Homo sapiens
  misc_feature: GYAE6OF01AW6VD.29.78.H01.1.454.CMB.1.raw
  modified_base (324)..(324): a, c, t, g, unknown or other
  misc_feature (324)..(324): n is a, c, g, or t
  modified_base (556)..(556): a, c, t, g, unknown or other
  misc_feature (556)..(556): n is a, c, g, or t
  modified_base (678)..(678): a, c, t, g, unknown or other
  misc_feature (678)..(678): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaacgggtccggttcacctactttccagtacgacaattcgaagaacacgctgtatctgacaacgtggagacgcctgacgtactcggacgtacgcggccgtntacttattgtaggttaaaggcgagtcgtaggaaggtaccggggacccgggaccgtacgttcgaccgtacggtcggggaccgagggggaccgtcgtcggtacctaccgtctcccgtacgacgtcccctacccgaccgaaccgggccctacggtccggttcccgttcccccgtcggcccctacccgttcctaacccgaacgaccgcctacccgtcggtccgggggccacggacnccgacgtccccggtgggtcctcgggtcctacgggtacgtaacggtaccttaccgtaccgttacgtacctactacgttcgtacggcgggcccgggtcgtcgggacgacgggacaccgatacgncg

SEQ ID NO: 53832 - DNA, 717 bp, Homo sapiens
  misc_feature: GYAE6OF01B6V99.29.78.H01.1.454.CMB.1.raw
  modified_base (151)..(151): a, c, t, g, unknown or other
  misc_feature (151)..(151): n is a, c, g, or t
  modified_base (478)..(478): a, c, t, g, unknown or other
  misc_feature (478)..(478): n is a, c, g, or t
tcagatagagtactcacgaccggtgctcgatttagtgtgagtagtttggggtttgggggtccgagccatgggtgcagacctccccagagctctcctcctcctccactgcacgagggtctctctcccagcctgtgctgactcaatcgccctntgcctctcgccctcccgtggggaggctcggtcaaggtcaccttgtactcgtgagcaggtggacacgagcaagctaccgccagtcgcgttggcatcgacgcgaggacggccaacggaccgaccgggtcccttacgttacttgataggaactgtacaaactaagtcgatgggactagtaccaacggagggacgggaaacggggggacggacgtccgtagtacgtccgtcgttactacgtacgtcctaccgtacgtcgttccggtcgggcctcggacgccgtacctacccgtacacgtaccgtaccggtcccgtcctaccgtgttaccgnggaacggtctaggcggtctacgtaacttagtacgtcgtacgtaccggtacggcgggtacctacggtacggtctacgttaccgggtacggttcccggggttaaccggggaccccgggaacgttaccgggtacccggtaccggttaccgggtccgggtaccaacccgggaacccggtaaaccggaccccctaaacccgggtcttccggtaacctttccggttcctaccccggtttaccccc

SEQ ID NO: 53833 - DNA, 724 bp, Homo sapiens
  misc_feature: GYAE6OF01A12MM.29.78.H01.1.454.CMB.1.raw
  modified_base (222)..(222): a, c, t, g, unknown or other
  misc_feature (222)..(222): n is a, c, g, or t
  modified_base (246)..(246): a, c, t, g, unknown or other
  misc_feature (246)..(246): n is a, c, g, or t
  modified_base (523)..(523): a, c, t, g, unknown or other
  misc_feature (523)..(523): n is a, c, g, or t
  modified_base (536)..(536): a, c, t, g, unknown or other
  misc_feature (536)..(536): n is a, c, g, or t
tcagatagagtactcacgaccggtgctcgatttagtgtgagtagtttgggtttgggggagagaggagtccacccctgggatcttcaggttgttttcatttggtgatcaggacggaacagagagaactcaccatggagtttgggctgagcgtggtctttttcttggtggctaatttttaaaaggtgtccagtgtgacgtgcagttggtggagtcgtgggggcnccgtgggtacgggccggggggtcncgtgagctctcctgtgcggcctcgtggtaatttagtttaggagtcatgcctagtcgaacgtcggggtcccgccgaggtcctaccggagggggaaggggtcgtgggtaggtcggggttcctccgggcttaagttcgggtggtcgtaggtgggtcgggaccgtacgtttaagtattagtttaagtcggacgaggtacccgtacccgtagggtaacggggtcccgttcctaacccgtactttaccgaagacgaacgttaagtacgaaagaactacgtctntacgtctacgaanaacgttggacgacgcccgtagacgacgtacgaccgacgaccggtaccgttacttagttacttgggttaacgtaaggaccgaggtcgtaacggtaacggtacccgggggacccggtaccgttacgtaccggaacccgtaccgggcggggaccgacgggggtaccacggtccggtcccgtaccggtcccg

SEQ ID NO: 53834 - DNA, 850 bp, Homo sapiens
  misc_feature: GYAE6OF01EOQ6M.29.78.H01.1.454.CMB.1.raw
  modified_base (83)..(83): a, c, t, g, unknown or other
  misc_feature (83)..(83): n is a, c, g, or t
  modified_base (150)..(150): a, c, t, g, unknown or other
  misc_feature (150)..(150): n is a, c, g, or t
  modified_base (171)..(171): a, c, t, g, unknown or other
  misc_feature (171)..(171): n is a, c, g, or t
  modified_base (182)..(182): a, c, t, g, unknown or other
  misc_feature (182)..(182): n is a, c, g, or t
  modified_base (203)..(203): a, c, t, g, unknown or other
  misc_feature (203)..(203): n is a, c, g, or t
  modified_base (262)..(262): a, c, t, g, unknown or other
  misc_feature (262)..(262): n is a, c, g, or t
  modified_base (300)..(300): a, c, t, g, unknown or other
  misc_feature (300)..(300): n is a, c, g, or t
tcagatagagtactcacgaccggtgctcgatttagtgtgagtagtttgggtttgggggcgcctgggtacggaccggggggtcnctgacgacctctacctgtcgccggacctctggatttaagtttagagtcatcgccatgaactgggccnccagctcgagggagggctggngtggtcgtcgnttagtagtgcagtggtggctntagtatagtactgacacgaccgccgtggaaccgggtccgtacactcgttaccgaggtanaacctaagttcgaaagtaccgacgtcgtagttaccgtntacgaacgtaaggtaggacgtaccgtacggtacggaacgtaccgtaccggaaccggtaaccggtacccgggtactttagttaggtttacggttaaggttaacggttaaacgggcgtacggtacggtaacgggtaacccgggtaaccccggggacccggtacccgtaacgtaacggaaccggtacgggtaccggggaaccgggtacggggtacccgtaccggtccgtacccgtaccgttacgtaccccgtacgtaccccgtacccgtaacccggtaaacccggtacccgtacccgtaccgttacccggttaccccgttaccccggtaccggtacccctacccgtaacccgtaacgaccgtaccgtacccgtaccggtacgggtaccggaccgtacggaccgtaccgtaccggttcccgtcggtacccgtccgtacggttacggtaacccggtaacgttaaccgttaccgtaccgtaccgttaccgtacgttaccgttacggtacgtaccgggtccgtacggtccgacggtacgccgtagtcgacgtcgtcg

SEQ ID NO: 53835 - DNA, 780 bp, Homo sapiens
  misc_feature: GYAE6OF01AZ61Q.29.78.H01.1.454.CMB.1.raw
  modified_base (202)..(202): a, c, t, g, unknown or other
  misc_feature (202)..(202): n is a, c, g, or t
  modified_base (221)..(221): a, c, t, g, unknown or other
  misc_feature (221)..(221): n is a, c, g, or t
  modified_base (285)..(285): a, c, t, g, unknown or other
  misc_feature (285)..(285): n is a, c, g, or t
  modified_base (471)..(471): a, c, t, g, unknown or other
  misc_feature (471)..(471): n is a, c, g, or t
tcagatagagtactcacgaccggtgctcgatttagtgtgagtagtttgggtttgggggcgcctgggtacggccggggggtcgctgagactctcctgtgcggcctctggattaagtttaggagtcagtcgccatgaactgggtcccgcaggctccgagggaagggctgggagtcgggtctcggctattagtggcaggttgggnggccgctattagtacttancgtcacggcgacccgttggaacgggtccgtaccacgtattccgagaagacctaacgttcgaaanaacgacgtcttaggtaactcgtagacaacggttaggacacgtaccgtaggacgtaacctccggaacgaccgtaccgggcctttacgttatttacggtagtacggtaaacgtcggaacgtctagggtaactaccggggccggaaccgtcgtaacggacctacgggtcggtacccggaggggtacccncggttcggaaccgtccgccgttccgcctacgtcccacccgacgtaaacccgggcccgtacggtcccggtacccgttaccccgccggtaccccctaccgtaccccgtccgtaaaccgcggtacccaccggttcccggtaccgggaccacccgtagacccggtaccgtcccggtcggtaccggtccggcccggtttacgggaccgttaaccggggtaaccttcccggtaagtaccgttaccgttaacccgttgtaccgtacggacggttccggaccggtggaacccggtcgaccggacgtactaggccgta

SEQ ID NO: 53836 - DNA, 788 bp, Homo sapiens
  misc_feature: GYAE6OF01A61KN.29.78.H01.1.454.CMB.1.raw
  modified_base (144)..(144): a, c, t, g, unknown or other
  misc_feature (144)..(144): n is a, c, g, or t
tcagatagagtactcacgaccggtgctcgatttagtgtgagtagtttgggtttgggggcgcctgggtacggccggggggtcgctgagactctcctgtgcggcctctggatttaagtttaggagtcatgccatgaactgggtccnccaggctccgagggaagggctggacggtgggtctcggctagttgtggcaggtggtggcgctattatattagtgacgagtaccgcccgtagggaacgggtcccggttacaaccttacgttttaccgaaggtaacgaaacctaagttaccggaaaagaaccgtacgtacgttaggttaactccgttagaaccgtaaaaggttcggaaggaacgtccgtagaacggtactacgactaccgacggtccgtattattagtgtaggttaagcgtagacgtaggaacggtacccggggaccggtaaccgtcggttacgaccgtacgggtaggggaccggacggggactcggttcggaacccgtaccggttcctcccgtaacgtccgacccgttacccgaaaccggaaccgggtacccgtaccggttacccgttacccgttccccgtaccggtccccgtacccgtacccgtaaccgaacggaccgacccgtaccgtaccgggttacggggaccacgggacgtaccgaccggtccggtaccggtccgtccggtaccgttacggtacgtaacggtactaccgtcctaacgtcttacgtacgttcgagaccggtcgggacgaacgggtaccggtaacggaccgtagaagtgtgac

SEQ ID NO: 53837 - DNA, 765 bp, Homo sapiens
  misc_feature: GYAE6OF01EMEWR.29.78.H01.1.454.CMB.1.raw
  modified_base (145)..(145): a, c, t, g, unknown or other
  misc_feature (145)..(145): n is a, c, g, or t
  modified_base (202)..(202): a, c, t, g, unknown or other
  misc_feature (202)..(202): n is a, c, g, or t
  modified_base (643)..(643): a, c, t, g, unknown or other
  misc_feature (643)..(643): n is a, c, g, or t
  modified_base (762)..(762): a, c, t, g, unknown or other
  misc_feature (762)..(762): n is a, c, g, or t
tcagatagagtactcacgaccggtgctcgatttagtgtgagtagtttgggtttgggggcgcctggggtacggccgggggggtcgctgagactctcctgtgcggcctctggattaagtttaggagtcatgccatgaactgggtccncgaggctccgagggaagggctggagtgggtctcggctagttagtgcagtggtggcgntatattattatgcacgaccgcccgtaggaaggccggttacactacgtttccagtaagactaatcgaagaacagctgtatcgtcagaaagtggaagcgtaccgtgaacgaccgtcggaacgaaccgaccgggtccgttacgtttaacgttagtttggttaacggtttaaaacgggtcgtaacggtccgtttaaagggaaccggttaaacccgggggccccgggggtacccccgttacgtttaccggaacccgtaccgggtaccggggacccggacgggggaaccgtccggtacggttaccgaccgttcccgttccctacggacctcccgacccgtaaccgaaccgggtaccctaccggttacccgttccccgtccccctcgggccccttaccccgtaccctaccgaacgaccgtccgtaacccgtcgggtgggacctacgancccgacgtcccggtaggctccggctacgggttaacgaacgtaccctttaccgtacctacgttcctcgttaacgtcgtagccggaccgggtgtccgggaatacccgggagtgaacgtggnacg

SEQ ID NO: 53838 - DNA, 735 bp, Homo sapiens
  misc_feature: GYAE6OF01DCLV6.29.78.H01.1.454.CMB.1.raw
  modified_base (731)..(731): a, c, t, g, unknown or other
  misc_feature (731)..(731): n is a, c, g, or t
tcagatagagtactcacgaccggtgctcgatttagtgtgagtagtttgggtttgggggcgcctgggtacggccgggggggtcgctgagactctcctgtgcggcctctggatttaagttttaggagtcatgccatgaactgggtccgccaggctccgagggaaggggctggaggtgggtctcggctattagtggcagtggtggcgctatatattatgcagaccgcccctggaacggggcccggttacacctactttccaagagacaattacgaaagaacacgctgatctgacaagtggagacgcctgacgactacgacgacgaccggccgtactacttattggtaggtaaaggcgagtcgtaggaacggtaccggggacccgggaccccgtacgtcgtaccgacggtcggggaccgacgggggaccgtcggtcgtaccgaccggttccctcccgtcgaccgtccctacccaaccgaccgggcccctaacgtccccggttcccccttcccccgtccggacccctacccctacctaacccgaacgaccgtcctaaccccggtcgggtaccggggcctaaacggcgtcccgtaccggccccggtgggtcccgtccggtaccgtcggtaacgtaaccgggttaccttaaccgttacccgacgttacctacgtacgttaccgtacgggtcgggcccgggtacgttcggggaaaccgtacgggaccgtaccgagtcgngtac

SEQ ID NO: 53839 - DNA, 715 bp, Homo sapiens
  misc_feature: GYAE6OF01B3LW0.29.78.H01.1.454.CMB.1.raw
  modified_base (714)..(714): a, c, t, g, unknown or other
  misc_feature (714)..(714): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtcatttatgtacgttaaaaggcgaagctagggaataacggggacccggggaccccgaacgtttcggaacccaacgttggggggacccaaggggggaccgctgggttccaacccggttctacccgtcaacggcccctacccgaacccgaacgggccccaagttcccgggttccctttcccccccgtcgggcccaccccttccctacccaaacggaccgccgtaacccgtccggttcggggggccaaccgaacgccgaaccggtccccgttacgggggcccttcggcccgttcgggtaccgaaacgggtaccttaaccctttccgtaaacggttaacccttccttaaccgttccgttacgggacggtcccggggccgttgggacccgaaagggccggacaactaggcng

SEQ ID NO: 53840 - DNA, 894 bp, Homo sapiens
  misc_feature: GYAE6OF01AM9IS.29.78.H01.1.454.CMB.1.raw
  modified_base (187)..(187): a, c, t, g, unknown or other
  misc_feature (187)..(187): n is a, c, g, or t
  modified_base (892)..(892): a, c, t, g, unknown or other
  misc_feature (892)..(892): n is a, c, g, or t
tcagatagagtactcacgaccggtgctcgatttagtgtgagtagtttgggtttgggggcgcctgggtacggccgggggggtcgctgagactctcctgtgcggcctctggattaagtttaggagtcatgccatgaactgggtccgccaggctccgagggaagggctggagtgggtctcggctattagnggcagtggtggcgctatatatatgcagacgcctgaacgggccgttcacctatttccgagtagaaccaattcgaagaacacgtctgtatctaggactaaaagtcgggaagagtcccgtggtaacgacctccggaaccgtaaccggtaaccgggtcccgtttacgtttaaatttacggttaaccggtttaaaggtttaaaaccggggaccggtaagggtcccgttaaggggtaaaccggttacccgggggggaaccccgggggttaccccgtaacgttttaccgggaaccccgtaacggtacgggggggtacccgaaacggggggtccttaccggtcgggtaccctaacccgggttccctaccgttaccggacgtacccccgttaccggaacccgaaacggggggccccttaacggtcccgggttaccccgttcccccgtacgggtacccctaccccgttaccctaaccggtaacgtacccggaccctaacccggtccgggttacccggggtacccacgtaacgtaccgaacccgggccccggtttacggggcccgttaccgtcccggttaccgggtaacccggtaacggttacccttaaaccgttccgtaacggttacccttacgttaccgttaccgggtgtaacggggtccggttaccgggtacggaaccggttaacgggccttaaaccggactttaccgggacncg

SEQ ID NO: 53841 - DNA, 655 bp, Homo sapiens
  misc_feature: GYAE6OF01AY9YU.29.78.H01.1.454.CMB.1.raw
  modified_base (654)..(655): a, c, t, g, unknown or other
  misc_feature (654)..(655): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccgagggaaggggctggagtgggtctcggctattagtggcagtggtggcgctatatattatgcagacgccctgaagggtccggttcacctatttccagagacaattcgaagaacacgctgtatcgtgacaaatggagagcctgacgactcgacgacgacggccgtcttatttacgttgttaggtttaaaggcgaggtcgtacggaacgtaccggggacccggggccccgtacgttcggaccgtacggtcggggccgaacgggggacgcgtcggtccgtaccgtctcctcacgccctccgaccgacggtcccacgttcccggtccccgttcccccgtcggtacccctaccccgtccctacccaacgaccgcctacccgtcggtcggggaccacgacgaccgacgcccgtcggcgtcgtccgtacggtacaacggtacttaccgtacacgttcctaccttacgtcgtaggcggccggacgtcggacgtaacgggctacgagtgnn

SEQ ID NO: 53842 - DNA, 660 bp, Homo sapiens
  misc_feature: GYAE6OF01BFL85.29.78.H01.1.454.CMB.1.raw
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaagggctggagtgggtctcggctattagtggcagtggtggcgctatatattatgcagacgccctgaagggccggttcaccatttccagagacaattacgaagaacacgctgtatctgacaaagtggagagcctgagactcgacgacacggccgtctattaattgtagttaaaggcgagtcgtaggaagtaacggggcccggggacccgacgttcgaccgacgtggggccgaggggacgcgtggtccgaccgtctcctcgacgtccctcccaccgaaccgggccctacgtccggttcccttcccccgtcgggacccctaccccgtcccgtaccgaacggtaccgacccgtaaccgtccggttcgggggaccaccgtacgacccgtaccgcccggtccgggtctcggccccgttaggtacgaacggtacctaccgtttcgaaccgttacgtaccttacgttcgaggacggtccgggcgcggtaccgaacggcgactagagtgcg

SEQ ID NO: 53843 - DNA, 809 bp, Homo sapiens
  misc_feature: GYAE6OF01B9TMZ.29.78.H01.1.454.CMB.1.raw
  modified_base (269)..(269): a, c, t, g, unknown or other
  misc_feature (269)..(269): n is a, c, g, or t
  modified_base (273)..(273): a, c, t, g, unknown or other
  misc_feature (273)..(273): n is a, c, g, or t
  modified_base (803)..(803): a, c, t, g, unknown or other
  misc_feature (803)..(803): n is a, c, g, or t
tcagatagagtactcacgaccggtgctcgatttagtgtgagtagtttgggtttgggggcgcctgggtacggccgggggggtcgctgagactctcctgtgcggcctctggattaagtttaggagtcatgccatgaacgtgggtcccgccaggctccgagggaagggctggagtggtctcggctagttagtggcagtggtgcgctatatattatgcagaccgcccgtaggaacggtccgttacacctattccagagaactaattacgaaanaacncgtctagtactctagacaaagtggagacgtctagacgtactacgaccgacgccggtcctattattagttagtaggttaaaggcgaaggtcgtagggaaaccggtacccgggggacccgggtacccgtacgttaccggaacccgtacgggtccgggggaccgggtaacggggaccggtcgtacgggtacccgtacccgttccgtacccgttaccgaccgtcccccgtaccccgaacccgggtaaccgggtaccccctacggtttcccccggtttcccccgtacccccggtacccggtccccctaaacccccttccgtaaaccccgacggtaacccgtcccctaacccgggtcgggggtaccggaaccacccggacgacccggtccggtccccgggttcggtccgttaaccgggtcccgggtaacggtaaccgtaaccggttccttacccgtagttaaccgttacctaccgttcgtcggaccggggtaccgggtcgggttaccgtacggggaacctacgggtccgattaggngcgtcg

SEQ ID NO: 53844 - DNA, 672 bp, Homo sapiens
  misc_feature: GYAE6OF01EJMNX.29.78.H01.1.454.CMB.1.raw
  modified_base (251)..(251): a, c, t, g, unknown or other
  misc_feature (251)..(251): n is a, c, g, or t
tcagatagagtactcacgaccggtgctcgatttagtgtgagtagtttggggtttggggagagctctggggagtctgcaccatggctcggaccccactcctcttcctcaccctcctcctccactgcacagggtctctctcccagcctgtgctgactcaatccgccctctcgcctctgccctcccgtggggaggctcggtcaaggtccaccttgtacctcgtgagcagtggacacagcagctacgccagtcgnttggcatcagcaggacggccagaccgacgggtccttgttactgatcgacagtacaacagtgagtggacacgtacacgaggaccgggaaagggggtccggtaactcccgtagaccgttcgacctttccgcgacgttcccacgacggtcttcggaccgggtcctagggaccgcgtacccgtaccacgtaactaacttcccgtacccgtccctacgacgttcgtaggaggacgtcggtacgcgtacgtacttacttaccgagtaccgacgtccggtggggacctacgtacggacttaccgttacggacgggttccgggtaacccggggtaaccgggtaacccgttaacgggtcccgtacccgggtttcccggtccggtaacccgacccggaccccggtaaaccggaccccctaaccccgtacgg

SEQ ID NO: 53845 - DNA, 691 bp, Homo sapiens
  misc_feature: GYAE6OF01AGNGM.29.78.H01.1.454.CMB.1.raw
  modified_base (273)..(273): a, c, t, g, unknown or other
  misc_feature (273)..(273): n is a, c, g, or t
  modified_base (591)..(591): a, c, t, g, unknown or other
  misc_feature (591)..(591): n is a, c, g, or t
  modified_base (652)..(652): a, c, t, g, unknown or other
  misc_feature (652)..(652): n is a, c, g, or t
  modified_base (691)..(691): a, c, t, g, unknown or other
  misc_feature (691)..(691): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaacgtgggtccgccaggcctccgaggggaaggggcgtggagtgggtctcggctattagtggcagtggtggcgctatatattatgcagaccgcctggaacgggccgttcacctatttccgagagacaattacgaagaacncgtctagtactctagactaagtggacgacgccgtagacggtacctacggaccgacgaccggtaccgttacttaacttagttgttacggttaaaggacggagtcggtaggtaacggtaccggggacccgggtacccgtacgttacgaccgtacggtcggggaccgacgggggaccgtcgtcggtcctaccgtctacctacgtaccgccccgtaccgaaccgtaccgggaccctaccgttcccggtccccttacccccggtcgtacccctaccccttaccgaccgacgaccgccgtacccgtcgggacgggaccacgacnccgacgcccggtggccctcgtacgttcgacgagtacctccgttacgaccttccttcgtacncgtaggtccggcggtcgtcggacgtacggcgactgtcgn

SEQ ID NO: 53846 - DNA, 782 bp, Homo sapiens
  misc_feature: GYAE6OF01D9412.29.78.H01.1.454.CMB.1.raw
tcagatagagtactcacgaccggtgctcgatttagtgtgagtagtttgggtttggtggtctctctcccagcctgtgctgactcaatcgccctctgcctctgcctccctgggagctcggtcaaggtcacctgtactctgagcagtggacacagcagctacgccatcgcttggcatcagcagacgccagaccacgggcccttgttacttgatcgacagtacaaactaatgatggcaagtccacgaggacggaaggggggacgtactcccgtggactcgtcttctcacgtcctccagtccgtcgtcgggcctaggacggtacctccttaaccgtacaacgtaacttcccgtaccggcccttaccgagttccgttaggaaggtagtcgggtaaggtccttaacggtaactttaacgtttaccgtacggttaccgaacgggttacccggttcggggaccttacggttacggtacccgttaacgtttaccgggttaaccgggtttaccccgggttaaccggggggaaaccccgggttaacccgaaacggggttccccgtaacccgggtttccggtaccggtaaccgaccggtaaccccgaaccgggtacccccaaacccgtcgtaccgttacccgtaccgtttacccgttcccgttacccccctaccttccccgttacgtaaccgttacccgtttacgtaaaccgttccggtaccggtaaccggggtccggttcccgggtaaccgggtaacccggtaacccggtccgtaagtacgacggtagtccacg

SEQ ID NO: 53847 - DNA, 679 bp, Homo sapiens
  misc_feature: GYAE6OF01CK0XY.29.78.H01.1.454.CMB.1.raw
  modified_base (155)..(155): a, c, t, g, unknown or other
  misc_feature (155)..(155): n is a, c, g, or t
  modified_base (278)..(278): a, c, t, g, unknown or other
  misc_feature (278)..(278): n is a, c, g, or t
  modified_base (331)..(331): a, c, t, g, unknown or other
  misc_feature (331)..(331): n is a, c, g, or t
  modified_base (424)..(424): a, c, t, g, unknown or other
  misc_feature (424)..(424): n is a, c, g, or t
  modified_base (444)..(444): a, c, t, g, unknown or other
  misc_feature (444)..(444): n is a, c, g, or t
  modified_base (472)..(472): a, c, t, g, unknown or other
  misc_feature (472)..(472): n is a, c, g, or t
  modified_base (484)..(484): a, c, t, g, unknown or other
  misc_feature (484)..(484): n is a, c, g, or t
  modified_base (513)..(513): a, c, t, g, unknown or other
  misc_feature (513)..(513): n is a, c, g, or t
  modified_base (563)..(563): a, c, t, g, unknown or other
  misc_feature (563)..(563): n is a, c, g, or t
  modified_base (587)..(587): a, c, t, g, unknown or other
  misc_feature (587)..(587): n is a, c, g, or t
tcagatagagtactcacgaccggtgctcgatttagtgtgagtagtttgggtttggggtctgagagaggagtccaccccgtgggatcttcaggttgttttcatttggtgatcgaggacggaacagagagaactcaccatggtaggtttgggctggngcgttggttcttttttcgttggtggtacttaagtttttaaaaggtcgtccaggttgtggacgtgcgtaggtttgggtggaggtcggtgggggctccggtgggggtaccggggccggggggtcncgtgacgtacctcgtcgtggtcgccggtcctgtagtagtttaaggttagagtnagtcgcgagtacggaacgtcgggtccgcgacggtcctcgggaaggggtacgggtcgtaggcgggtcggtccgtcgtagttagttggcggtcgnggtggcgctatatatcgtangacgacgcgcgtacggacggtccgtacncgttatcgaagngactagtacaatacgactctatactgtanacaaggtggacgtacgcgtagacgtacgtggaaccgtacgcggtaccgtnttagttagtagtaggtacgacggngaccggtagggtacggacccgggtaccgggcctacggtaccggtaaccgacgggtccgggtaccggaccgggtacgtccggtcgtaccccgg

SEQ ID NO: 53848 - DNA, 723 bp, Homo sapiens
  misc_feature: GYAE6OF01DZCL8.29.78.H01.1.454.CMB.1.raw
  modified_base (148)..(148): a, c, t, g, unknown or other
  misc_feature (148)..(148): n is a, c, g, or t
tcagatagagtactcacgaccggtgctcgatttagtgtgagtagtttgggtttggggtccgagccatggtgcagactccccagagctctcctcctcctccactgcacagggtctctctcccagcctgtgctgactcaatccgtccctntgcccttctcgcccttcccgtggggaggtccgttggtacaaggtcaccgttgtactcgtagagcagtcggacacagcacgcctacgccatcgtcttggcagtccagacgaggacggaccgacgaccgccgggtaccctacgttaacgttgacgtagtaccgaacggtaaccaaacgtaacgtagtaagcggacgtaggacgaacggacggacgggtaacggggggacgtacgttccgtagtacgttcgtcgttacctcgtacgtacctaccgcgtcgtaccggtcgggcgtacggcgtaccgaccgttaccacgtaaacgtccgttccgtacccggtccctaacggtacgtcgtaggaacgttagcgtacggtctacggttaacttacgttacgtacgtccggtacgaccgggtcggtaacctcggtacgtacgttacgtttacggtacgggttcccggttaccggggaaccggacccggttaacggtcccgtaacgggttcccggtccggtacgaccgaccccgaccggtacccaacccgtccgtacgtcctacctccgttcccgttaaccccg

SEQ ID NO: 53849 - DNA, 762 bp, Homo sapiens
  misc_feature: GYAE6OF01EUI2T.29.78.H01.1.454.CMB.1.raw
  modified_base (143)..(143): a, c, t, g, unknown or other
  misc_feature (143)..(143): n is a, c, g, or t
  modified_base (759)..(759): a, c, t, g, unknown or other
  misc_feature (759)..(759): n is a, c, g, or t
tcagatagagtactcacgaccggtgctcgatttagtgtgagtagtttgggtttgggggcgcctgggtacggccggggggtcgctgagactctcctgtgcggcctctggattaagtttaggagtcatgccatgaactgggtccnccaggctccgaggggaagggctggagtgggtctcggacttattagtggcaggtggtggcgactatatattatgcagacgccctggaacgggccgttcacctatttccagagacaattcgaagaaccacgctagtatcgtgactaaagtggagacgtcctagacgactcgacgacgaccggtccgtctagttacgtggtaagttaaacggcgagtccgttaggaaacggtacccgggggacccggggtaccctacgttaccggaccggtaaccggtcgggggacccgaagggggtaccgacggttcggtaacccgtaccggtcctaccccgtacgacggtaccccgtacccgaacccggaaaccggggtccctaacggtttcccggtaccccttcccccgttacgggcccctaaccccgtacccgtaccgaaacggtaccgaccctacccgttacgggtacggggaccaaccgtacggtacctaacggtccccggttacggggcctacggtacccgttacggtaaccgtaacgggtaccttaccgttaccgtacgttaccttacgttacgtccgtaggacggtcggtccgtaggaaccgtaacggccgactagtagngtc

SEQ ID NO: 53850 - DNA, 728 bp, Homo sapiens
  misc_feature: GYAE6OF01D2VRG.29.78.H01.1.454.CMB.1.raw
  modified_base (155)..(155): a, c, t, g, unknown or other
  misc_feature (155)..(155): n is a, c, g, or t
  modified_base (181)..(181): a, c, t, g, unknown or other
  misc_feature (181)..(181): n is a, c, g, or t
  modified_base (216)..(216): a, c, t, g, unknown or other
  misc_feature (216)..(216): n is a, c, g, or t
  modified_base (239)..(239): a, c, t, g, unknown or other
  misc_feature (239)..(239): n is a, c, g, or t
  modified_base (418)..(418): a, c, t, g, unknown or other
  misc_feature (418)..(418): n is a, c, g, or t
tcagatagagtactcacgaccggtgctcgatttagtgtgagtagtttgggtttgggtctgagagaggagtccacccctgggatcttcaggttgttttcatttggtgatcaggacggaacagagagaactcaccatggagtttgggctgagcgtgngttttctaggtggctaatttaaaggntcagtgtgacgtgcagttggtggagtcgtggggcnccgtgggtacggccggggggtcnctgagctcgtcctgtcgcgcctctggaatttaagtttacggagtcatgacctagtcgaacgtcggggtaccgcgaggcctaccggaggggtaacggggctagggtaggttcgggtacgtcgggacttaaggttaggcggacgtaggtgggtcgggccgtattaagttaataacgtttancggtacgaaccgggtaccgtcccgttaacgggtaaacgggtcccggtttaccaaccccgttaagttttaccccgaaaggtaccggtaactaaacgtttaaccggaaaacgtaaccgaacgtaccgttagttaacgtacgtacgtaactaaggtacggaaagcgaccttggaactaccgacaaccggaccgtaccgcgttacgtattattaggtacgttaagcgtaagacgtaggaacggtcccgggaaccgggtccgtacgttacgaacccagggtaccggggtacgaacggggcctcgtacggtacccg

SEQ ID NO: 53851 - DNA, 762 bp, Homo sapiens
  misc_feature: GYAE6OF01BZY5Q.29.78.H01.1.454.CMB.1.raw
tcagatagagtactcacgaccggtgctcgatttagtgtgagtagtttgggtttggggtccgagccatggtgcagactccccagagctctcctcctcctccactgcacagggtctctctcccagcctgtgctgactcaatccgccctctgcctctcgccctcccgtgggacgcctcggtacaaggtccacctgtactctgagcagtgacacagcagctaccgcctagtcgtcgttggcatcacgcgacggacggaccgagaccgaccgggtcccttacgttacttgactacgacgagtaccaaactaagtaggagtcggactacgtacgacgaagggtacgggaacggggacgtaccgttccgtgtactccggtccttaccgtacgtaccgtcctacccgtacggtccgttccggtacgggtccgtacggtaccgtcccgtaacccgttaaccctaaccgaacgttaacccgttccccggtacccgtacccttccgtaacggttccgtagggaacggtaacgtgggaaccgttcgtaacgttaaccgtttacgttaccgttacgtacccggtacggtaccgggttaggacctacggtacggtacttaccggttacggttaccggtacccggttacccgggaaccgggtaccgttacggtacccggtaccggttccggtaccgtaccggaccccggtacccgaacccgacccccgtaaccgtccggtacctacccgttaccgttcccgttaccccggttccccc

SEQ ID NO: 53852 - DNA, 693 bp, Homo sapiens
  misc_feature: GYAE6OF01B0V4D.29.78.H01.1.454.CMB.1.raw
  modified_base (144)..(144): a, c, t, g, unknown or other
  misc_feature (144)..(144): n is a, c, g, or t
  modified_base (198)..(198): a, c, t, g, unknown or other
  misc_feature (198)..(198): n is a, c, g, or t
  modified_base (393)..(393): a, c, t, g, unknown or other
  misc_feature (393)..(393): n is a, c, g, or t
tcagatagagtactcacgaccggtgctcgatttagtgtgagtagtttgggttgggtccgagccatggtgcagactcccagagctctcctcctcctccactgccacaggtctctctccagcctgtgctgactcaatccgccctcncgcctctcgccctccgtagggacgcgtcggtacaaggtcctaccgtgtacctgngacgcgagcggacacgagcagctacgctatcgtcttgcatcgagcgaagcggacacgccgaccggtccttacggttatacgactcgacgacgtacaactagttagagtcggactacggtacgaacgagggtaccggaagggggccgtaaccgtcccgtagtacgtcccggttacttacgtcgtaacgtcgtaccncgtctacggtcgacgtcgacgcctcgtaactcgactaccgtccgtccgtacctacgtacgtacgtagaggtacgacggagtcgtacgtacgttaactacgtcgtaacgtaccggtaccgtcggactacggttcgacgttaccgttaccggtcgggttacccggtaccgggaaccggggttacggaaccgtccggtaaccggtcccggttacggaaccctacccgggtacccaaacccgggtacccttaaacccggtccgaccgttaccctaaccggtttccccgtcccgggttacccccc

SEQ ID NO: 53853 - DNA, 767 bp, Homo sapiens
  misc_feature: GYAE6OF01EF9WS.29.78.H01.1.454.CMB.1.raw
  modified_base (272)..(272): a, c, t, g, unknown or other
  misc_feature (272)..(272): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccgaggggaaggggctggagtgggtctcggctattagtggcagtggtggcgctatatattatgcagaccgccctaggaacgggccgttcacctatttccagagactaattcgaagaaccncgtctgtactctagactaaagtggaagacgcctgacgactcgacgaaccgaccggtcctcgttaacttagttcggttaaggttaaacggcgagtacgttagggaaacggtaccgggggacccggggtacccgtacgttacggaaccgtacggtcgggggacccggtagggggaccgtcgttcgggaccctaccgttctcccgtcgaccgtccctaccgaaacccggaaccgggtcccctaacgttccccgggttcccccctttcccccggtacggcccccttaacccccttccgtaaaccgaaacggtccaccccgtaaccgttccggggtacggggaaccaacgacgccgtaccgggtccccgttgggcctcccgtaccggttgggaacctaaccgggtacctttacccgtaccgtaacggtttcctaccttaacggtccggtaggggcccggttacggggcccgtagggaaaccgttcgggacagtaagtgca

SEQ ID NO: 53854 - DNA, 633 bp, Homo sapiens
  misc_feature: GYAE6OF01B0H5M.29.78.H01.1.454.CMB.1.raw
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacaccggccgtctattattgtagttaaaggcgagctaggaataccggggacccggggcccgacgttcgaccgacgtcgggggccgagggggaccgcgtcggtccaccgtctccctcacgccctccaccgaacgggcccagtccggtccttcccccgtcggcccaccctccctccaacgcgccacccgtcggtcgggggccaacgcgaccacggcccgtacgggcctcgtcccgtcggtaccgaacggtacctaccgttacccgaacgttcctaccgttacgtccgttggacggtccgggccgttacgggaccgtaacgggccagacgtgcgtg

SEQ ID NO: 53855 - DNA, 749 bp, Homo sapiens
  misc_feature: GYAE6OF01DXOXW.29.78.H01.1.454.CMB.1.raw
  modified_base (190)..(190): a, c, t, g, unknown or other
  misc_feature (190)..(190): n is a, c, g, or t
  modified_base (746)..(746): a, c, t, g, unknown or other
  misc_feature (746)..(746): n is a, c, g, or t
tcagatagagtactcacgaccggtgctcgatttagtgtgagtagtttgggtttgggggcgcctgggtacggccgggggggtcgctgagactctcctgtgcggcctctggatttaagttttaggagtcatgccatgaactgggtccgccaggctccgagggaagggctggagtgggtctcggcttattagnggcagtggtggcgctatatattatgcagaccgccctaggaacgggtccgttacacctatttccagagactaattacgaaagacacgctgtatctgacaagtggagacgtacctggaacgtaccgtacggaaccgaccgtaccggtccgttacttatttagtttgttaacggttaaaggcgaacgtcgtagggtaacggaccgggggacccgggaccctacgtacgaaccgtacggtcgggggaccgacgggggacgtcgtcggtaccctaccgttccctaccgtcgaccgtccctaccgaacccggaaccgggtccctaccggtcccgttccccgttccccccggtgtacccctaccctcccgtaaccgaacgtaccgacccgtacccgtccgggtgggaccccacgacgtcccgaccggtcccggtcggtaccgtccgtccgtacggtaccgaaaccgttcccttacgttacctacggttaccttacgttacgttccggtacgggaccgggccgggtaacggtcccggggaaacgccggggaactacgactacgngag

SEQ ID NO: 53856 - DNA, 606 bp, Homo sapiens
  misc_feature: GYAE6OF01D78EX.29.78.H01.1.454.CMB.1.raw
  modified_base (570)..(570): a, c, t, g, unknown or other
  misc_feature (570)..(570): n is a, c, g, or t
  modified_base (600)..(600): a, c, t, g, unknown or other
  misc_feature (600)..(600): n is a, c, g, or t
  modified_base (606)..(606): a, c, t, g, unknown or other
  misc_feature (606)..(606): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgccaggctccagggaagggctggagtgggtctcggctattagtggcagtggtggcgctatatattatgcagacgccctgaagggccggttcaccatttccagagacaattcgaagaacacgctgtatctgacaaatggagagcctgagactcgacgacacggccgtctattattgtagttaaaggcgagctggaaagtacggggacccggggcccgacgttcgaccgaacgtcgggggccgagggggaccgcgtggtccgacccgtctccgtacacgccctcccaaaccgaccgggaccctacgtccggtcccttcccccgtcggccccacccctccctaccgaaacggacgccgtaccgtcgtcggggaccacgacgcacgcccgtggcctcgtccgtggacaacggacttaccttaccatacctntacgtctgacggcggctggacgacggacgnagtggn

SEQ ID NO: 53857 - DNA, 765 bp, Homo sapiens
  misc_feature: GYAE6OF01CV8G1.29.78.H01.1.454.CMB.1.raw
  modified_base (648)..(648): a, c, t, g, unknown or other
  misc_feature (648)..(648): n is a, c, g, or t
  modified_base (659)..(659): a, c, t, g, unknown or other
  misc_feature (659)..(659): n is a, c, g, or t
  modified_base (752)..(752): a, c, t, g, unknown or other
  misc_feature (752)..(752): n is a, c, g, or t
  modified_base (758)..(758): a, c, t, g, unknown or other
  misc_feature (758)..(758): n is a, c, g, or t
  modified_base (765)..(765): a, c, t, g, unknown or other
  misc_feature (765)..(765): n is a, c, g, or t
tcagatagagtactcacgaccggtgctcgatttagtgtgagtagtttggggtttgggggcgcctggggtacgggccgggggggtcgctgagactctcctgtgcggcctctggatttaagttttaggagtcatgccatagaacgtggggtcccgccgagggcctaccgagggggaaggggcgtagggaggttggggtcgtcggcgtagttaggtggcgaggtgggtggcgactattattattatgcacgaccgcctaggaacgggtcccggttacaactactttccgaagaacgaacaacgttacgaaagaaccaacgtctagtactcgtagactaagaggaagacgtccgtagagacctacgacgacgtaccggccgttacttattacgttaggttaaggttaaggcgaggtacgtaacggtaacgggaccgggggacccgggtaccgtacgtacgtaacccggcggtacggggacggacgggggcgtccgtaccggtaccgtccggtaccttcccgtaccgtccgcccgaccgaacccgggacccggtaccccggtaccggtcccggtttcccccgtacccccggttcgggaccccttaaccccctccgtaaccgacgacgtcccgcggttacggcggaccaaccgnaccggtacccnccgggacggctccggtacgtacggtacaaccgggttacctaccgtcttaaccggcttctaaggtccgtagggcggccggttccggataccggngtaccngtatcgn

SEQ ID NO: 53858 - DNA, 683 bp, Homo sapiens
  misc_feature: GYAE6OF01BKLYO.29.78.H01.1.454.CMB.1.raw
tcagatagagtactcacgaccggtgctcgatttagtgtgagtagtttggggtttggggagagctctggggagtctgcaccatggctcggaccccactcctcttcctcaccctcctcctccactgcacagggtctctctcccagcctgtgctgactcaatccgccctctgcctctgcctccgtgggagctcggtacaggtcacctgtactctgagcagtgacacagcagctacgcatcgcgttggcatcgagcgagacggccagaccgaccggtcctacgttactgatgactacgtacaacagtgagtggactacgtacaacgaggacgggaagggggaccggtacgtcccgtagtacgtcgtcgttcgtcgtacgtcctaccgtacgtcgttcggtcgggcgtacggacgcccgtaccttacccgtactaccgtaccgttcccgtaccccggtcctaccgtacggttcgtagggtacgtacggtcgacggtacgttacgtaaccgtttagttaccgtaggtacccgtagggtcccgggtacgggtccacgggttacgtacttacggttacgtccgggtttacccgggtaccggggaacccgggtacgaacgggttcccggaaccgggttccggtaccggtaccgacccggaacccgaacccggtacccccgtaaccgtaccgg

SEQ ID NO: 53859 - DNA, 852 bp, Homo sapiens
  misc_feature: GYAE6OF01BWTB3.29.78.H01.1.454.CMB.1.raw
tcagatagagtactcacgaccggtgctcgatttagtgtgagtagtttgggtttgggggcgcctgggtacggccgggggggtcgctgagactctcctgtgcggcctctggatttaagttttaggagtcatgccatgaactgggtccgccaggctccgagggaaggggctggagtgggtctcggctattagtggcagtggtggcgctatatattatgcagaccgccctggaacgggccggttcacctatttccagagacaattacgaaagaacacgctgtatctgacaaagtggaagacgccgtagacgacgtacgaaccgacgacccggtccgttacttatttagttagtaggttaaaggcgtagcgtaggaacgtaccggggacccgggacctacgttcgaccgtacggtcggggaccggacgggggaccgtcgttcgggtacccgtacccggttcctcccgtaccgtaccgacccccttaaccccggaacccggtaacccggggtcccctaaccggtttcccccgggtttcccccgttcccccccggttacgggtaccccccctacccccgtttaccccgaacccggtaaacggacccgtaccccgttaccccggttaccggggttacccgggggaccctaaaccgggaccgggtaacccgtacccgggtacccccgggttagggggtccccgttcccgggtaaccccgggttagggttaaacccggtaaaccgggttacccctttaacccggttaacccgtaccggttttaacccttacgtaccggttcggttaccgggaccgggtccgggtacgtaccgggacgtaaccgggcgagttaacgtgcgtcg

SEQ ID NO: 53860 - DNA, 708 bp, Homo sapiens
  misc_feature: GYAE6OF01EZIY0.29.78.H01.1.454.CMB.1.raw
  modified_base (704)..(704): a, c, t, g, unknown or other
  misc_feature (704)..(704): n is a, c, g, or t
tcagatagagtactcacgaccggtgctcgatttagtgtgagtagtttgggttgggggcgcctgggtacggccgggggggtcgctgagactctcctgtgcggcctctggattaagttttaggagtcatgccatgaactgggtccgccaggctccaggggaaggggctggagtgggtctcggctattagtggcagtggtggcgctatatattatgcagacgccctgaagggccggttcaccatttccagagacaattcgaagaacacgctgtatctgacaaatggagagcctgagactcgacgacacggccgtctattagttgtagttaaaggcgagctaggaacgtacggggacccgggtcccgacgtcgaccacgtcggggccgagggggacgcgtcggtcacccgtcgtccctcgacgccctccgaccgacgggtcccacgttccggtccccttcccccgtcggcccctaccccgttccctacccgtaaacgaccgccgtacccgtccgggttcgggggacctacgacgaccgaccggtccccgtacggggccgttaccggtcccggttacgggtaacccgaaacggggtaacccttaacccgttacccgtaaccggttaacctacccgttaacgtccggttagggtaaccgggcccggggttacggtagggaccggtaaacgggtcccgaagtaggtaacgngtac

SEQ ID NO: 53861 - DNA, 634 bp, Homo sapiens
  misc_feature: GYAE6OF01CPG2C.29.78.H01.1.454.CMB.1.raw
  modified_base (632)..(632): a, c, t, g, unknown or other
  misc_feature (632)..(632): n is a, c, g, or t
  modified_base (634)..(634): a, c, t, g, unknown or other
  misc_feature (634)..(634): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgccaggctccgagggaaggggctggagtgggtctcggctattagtggcagtggtggcgctatatattatgcagacgcctgaaggccgttcacctatttccagagacaattcgaagaacacgctgtaatctgacaaagtggagagcctaggacgactcgacgacgaccggccgtacttattagtgtagttaaaggcgagcgtagaacgtacgggaccgggcctaacgttgaccacgtcggggacgaggggactcgtacggtccaccggttcctcctcgtaacgccctacccgaacgaaccgggcccaacgttccggtcccttcccccgtcggccctaccccgtcctaccgaacgacgccgtacctccggtcggggcaacgacgaccacggtcccgtcgggtcctcggtccgtacggtacaacgggtacctaccgtaccacgtacctactactcgtagacggcggtcgtcggacgtacggcgacgagtcgngn

SEQ ID NO: 53862 - DNA, 946 bp, Homo sapiens
  misc_feature: GYAE6OF01CI6LI.29.78.H01.1.454.CMB.1.raw
tcagatagagtactcacgaccggtgctcgatttagtgtgagtagtttgggtttgggggcgcctgggtacggccgggggggtcgctgagactctcctgtgcggcctctggatttaagttttaggagtcatgccatgaactgggtccgccaggctccgagggaagggctggagtgggtctcggacttattagtggcagtggtggcgctatatattatgacagaccgcccgtaggaacgggccgttacacctattccagagaacaattcgaaagacacgtctagtactcgtagactaaagtggaagacgtccgtaggacgtacctaccggaccgacgaccgggtccgttactttaagtttacgtttaggttaaacggtttaaacgggccggtaacggtaccggttaaggggtaaaccgggttaaaccccggggggacccccgggggtaccccgtaacggtttacccggaaaccccggtaccggggttaccggggggacccgggtaaacgggggggtacccgtaccgggtttacgggtaccccgtaaccccggtttcccttaccccgttaccggacccgttccccctaacccccggaaccccggtaaaccgggggtacccccttaccgggtttaccccgggttttaccccccgttaccccccggttcccggggtaccccccttacccccgttacccccgtaaaccggtaaccgacccgtacccggttacccgtaccgggtcggggaacccaaccggtaccgacccggtccggtaccccggtcgggtcccgtaccgggtacccgttacgggtaacgtaacccgggttacccttaacccggttacccgtaaccgtttacttaccccgtacgtttacccggagggtaccggggtcccgggtaccggttacgggaacccggtaaacgggtacccggacttaaacgtaggagtcg

SEQ ID NO: 53863 - DNA, 1025 bp, Homo sapiens
  misc_feature: GYAE6OF01CHU3M.29.78.H01.1.454.CMB.1.raw
  modified_base (142)..(142): a, c, t, g, unknown or other
  misc_feature (142)..(142): n is a, c, g, or t
tcagatagagtactcacgaccggtgctcgatttagtgtgagtagtttgggtttggggtccgagccatggtgcagactccccagagctctcctcctcctccactgcacgagggtctctcctcccagcctggtgctgactcaanccgccctctcgcctctcgcccgtcccggtggggacggcctacgggtacgaacggtccaccgtgttacctcgtggacgacgtaggtacggaacacgaggcacgtaccgtaccggtacctacgttccggtcgttacgggactacgtcgaacgaccgaacgggaccggaaccgaacggaacccggtaccccgggtacccgtttacggtttaaccgttaggaacgttaccggaaccgtaacggttaacctaaaacgtacggttacggacggtcgggacctaacggtaaccgaaccggtaacggggaacgggtaaaccggggggtaacccgttaccgttaccccggtaggttaacccgtccggttactttacccgtacggtaaccgtttcctaaccgaccgggttacccgtttacggggtaccgggtacccgtaacggggtaccccgtacccgtttaccccgttaacccgtacccggttaaaccggtaccggttcccccggttaccccggttaacccgttaccgggtttaaggttacccggggtaaggtaacgggtacggtaacgggtaaccggttaccgttaaccgttaaaaccggtttccgttaaccgtttccggtaaccgggtaacccgggtaccgggttaccggggtaaccgttaaccgggtaccggtccgttttaaccggtcccgggtttaccggggtaaccggggtttacccggggaacccggggttaacccgtaaccgggtttaccccgggtaccgttcccggggttaaacggtacccccggtaaccgggaaccccgtaaaccccgggtaacccccgaacccgttacggtttacccctaaccccttaccccgtttaaccgggtccccccttaacccccggg

SEQ ID NO: 53864 - DNA, 672 bp, Homo sapiens
  misc_feature: GYAE6OF01E1SSP.29.78.H01.1.454.CMB.1.raw
  modified_base (647)..(647): a, c, t, g, unknown or other
  misc_feature (647)..(647): n is a, c, g, or t
  modified_base (663)..(663): a, c, t, g, unknown or other
  misc_feature (663)..(663): n is a, c, g, or t
tcagatagagtactcacgaccggtgctcgatttagtgtgagtagtttgggtttgggggcgcctgggtacggccgggggggtcgctgagactctcctgtgcggcctctggattaagtttaggagtcatgccatgaactgggtccgccaggctccagggaaggggctggagtgggtctcggctattagtggcagtggtggcgctatatattatgcagacgccctgaagggccggttcaccgatttccagtagacaattcgaagaacacgctgtatctgacaaagtggagacgtcctagacgtactcgacgaccgacggccgtctaattagttcgtagttaaaggcgtagctggaacgtacgggacccggggacccgacttggacctaacgtcgggggaccagggggtaccgacgtcgggtaccaacccggttcctcccgtacgacggaccccttcccgaaacccggaacggggtaccccaacgttccggttaccccttccccccgtcggaccctaacccctccctacccgaacggacgtcccgaacccgttcggtcgggggaccacgtacgcgtacgcccggtgggtcctcggtccgtcggtacaacgggcttaccttccgacgtactacttcgtctaggacggtcggngtcggacacggtacanacgtgatcg

SEQ ID NO: 53865 - DNA, 634 bp, Homo sapiens
  misc_feature: GYAE6OF01B7WMX.29.78.H01.1.454.CMB.1.raw
  modified_base (475)..(475): a, c, t, g, unknown or other
  misc_feature (475)..(475): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaagggctggagtgggtctcggctattagtggcagtggtggcgctatatattatgcagacgccctggaagggccgttcacctatttccagagactaattcgaagaacacgctagtatctgacaaagtggagagccgtgaacgtactccggacgacgaccggtccgtactattatgtagttaaggcgagcgtaggaacgtacgggggacccgggaccgtacgttcgacctacggtcggggccgaggggacgtcgtcggtaccaccggtctccgtcacgtccctaccaccgacgggccctacgtccgtcccttcccccgnggccctacccgtcctaccgaagcgccaccgtcggtaggggcacgcgacgacgccgtgggcctacggtccgtggaacgtaacgtacctccgttaccacggttacctcctagtccgtaggaccggtccggcttcgggactaacggcacgtagtaggctacg

SEQ ID NO: 53866 - DNA, 844 bp, Homo sapiens
  misc_feature: GYAE6OF01BGO37.29.78.H01.1.454.CMB.1.raw
  modified_base (151)..(151): a, c, t, g, unknown or other
  misc_feature (151)..(151): n is a, c, g, or t
  modified_base (226)..(226): a, c, t, g, unknown or other
  misc_feature (226)..(226): n is a, c, g, or t
  modified_base (533)..(533): a, c, t, g, unknown or other
  misc_feature (533)..(533): n is a, c, g, or t
  modified_base (568)..(568): a, c, t, g, unknown or other
  misc_feature (568)..(568): n is a, c, g, or t
  modified_base (844)..(844): a, c, t, g, unknown or other
  misc_feature (844)..(844): n is a, c, g, or t
tcagatagagtactcacgaccggtgctcgatttagtgtgagtagtttggggttgggggcccggcctggggtacggccgggggggtcgctgagactctcctgtgcggcctctggtattaagttttaggagtcatgccatgacgtgggtcccncgaggctccgagggagggctggaggtgggtctcggacttagttagtggcaggtggtggccgcttatattaagttntgacacggaccgtcccgtaggaacgggtccgttacaacctatttccgaagacgaactaaacgttacggaaacgaacacggtcttacggtatccgttagaactaaagttcgggaagacgtccgtagtacgaccgtacggacgaccgaccggttactacgtttatttcgtaggtttaaggtaacggtcgagtacgggtaacggaccgggttacccggggacccgggtaccgtacggttacggaccggtaacgggccggggtacgggacgggggtaccgtacggttcggaacccgtcccgtcgttacccncgtacggcccctaacccggaccggacccgttaccncgtttcccggtacccccgttccgcccgggtacccctaccccttacggacccgttaaacggcccgtacccgtacccgggttacgggtcccgggacaaacccgccggaacctcccggggtccgggttcggtccgtacccggtaccggttaccgtaaccggtacgggtaaccccttaccggttcgtaaccgtttaccgtttaaacccgttcggtccgggtaaaggcccgggttacggaccggtttaggaccggttaccggcgacgttaacggcgtacgn

SEQ ID NO: 53867 - DNA, 765 bp, Homo sapiens
  misc_feature: GYAE6OF01CG9QN.29.78.H01.1.454.CMB.1.raw
  modified_base (180)..(180): a, c, t, g, unknown or other
  misc_feature (180)..(180): n is a, c, g, or t
  modified_base (186)..(186): a, c, t, g, unknown or other
  misc_feature (186)..(186): n is a, c, g, or t
  modified_base (194)..(194): a, c, t, g, unknown or other
  misc_feature (194)..(194): n is a, c, g, or t
  modified_base (214)..(214): a, c, t, g, unknown or other
  misc_feature (214)..(214): n is a, c, g, or t
  modified_base (235)..(235): a, c, t, g, unknown or other
  misc_feature (235)..(235): n is a, c, g, or t
  modified_base (286)..(286): a, c, t, g, unknown or other
  misc_feature (286)..(286): n is a, c, g, or t
  modified_base (389)..(389): a, c, t, g, unknown or other
  misc_feature (389)..(389): n is a, c, g, or t
  modified_base (395)..(395): a, c, t, g, unknown or other
  misc_feature (395)..(395): n is a, c, g, or t
  modified_base (423)..(423): a, c, t, g, unknown or other
  misc_feature (423)..(423): n is a, c, g, or t
tcagatagagtactcacgaccggtgctcgatttagtgtgagtagtttgggtttggggtctgagagaggagtccaccctgggatcttcaggtgttttcatttggtgatcaggacggaacagagagaactcaccatggtagtttggctgagcgtgtcgtttctaggtgctaagtttaaaggntcagtngtacgtgnagttcggtgatcgtggggcncgtggggacgggcgggggtcncgtagagtctcctgtggcgtacgtcctgtaggtatttaaggttttaacggnttacacgtagtacctagtcgtaacggtcggggtcctaccgcggtccgtaaccggagggggtaacggtcgtagggtgttcggtaccgcgggtacttagttacgngtacgnggttcggtgacgtactattataacgttnggtacaggtacccgtcggtagtaaccggggtcctttacgacgtaccttagaccggtaataactaacggttacgaaaagtaccgtcgtaactagtaacgtctaaggaacgtaggttaacggacggtaacgcccggttaaggaccgttacccgtacgggaccgttaacccgggtcccggttacggttaaacctttatttaaaccggggtttacggtaacggttaacgggtacggttaggacccgttaaaggggtaccgggtaccgggaccccggttacgttccggaacccggacgggttccggggaaggtccgggtacgggaccttcggggttacccggacccg

SEQ ID NO: 53868 - DNA, 789 bp, Homo sapiens
  misc_feature: GYAE6OF01BTPJ8.29.78.H01.1.454.CMB.1.raw
tcagatagagtactcacgaccggtgctcgatttagtgtgagtagtttgggtttggggtccgagccatggtgcagactcccagagctctcctcctcctccactgcacgagggtctcctctcccagcctgtgctgactacagtccgccctctcgcctcgtcgccctcccggtgggacggtccgtcggtacgtaacggtccgtaccttacgtacgtcgtgtacgcgtaggacggacacgagacacgtactaccgacctagtccgtcgttggactagtctaacgccggaaggacggcccgaaacggacccggtaccgggttcccctttacggtttacgttcggaacgtacgtaacgaacgttaaccaaaagttacggacgtagtccggacgacgtacgacggaggaacgggaacggggtacgcctcgtataccgttcgtctaccgtcgaccgttctacgcgtccgtcggtccgtcgcgtacgcctaccgtccaacgacttaccgtcccgtacccgtcgtaccgtggttacgtacgtacggtacgttacggtacgtcgttaacgttacgtttaaccttaccgggtacgacgggtaacccgggtcggtcggaccgacgttttccgaacgttacggttccgggtacggtaccccgggtacgggtaaccggtaccgtaccgggtaccgtaaccgggtcccgtaacgggtacccccgaccgggtaacccaacccgtacccctaacccggttaccgtaccggttaccccttccgttccccgtttaaccccggtcccccc

SEQ ID NO: 53869 - DNA, 724 bp, Homo sapiens
  misc_feature: GYAE6OF01BIVYC.29.78.H01.1.454.CMB.1.raw
  modified_base (215)..(215): a, c, t, g, unknown or other
  misc_feature (215)..(215): n is a, c, g, or t
  modified_base (715)..(715): a, c, t, g, unknown or other
  misc_feature (715)..(715): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccgagggaagggctggagtgggtctcggctagttagtggcagtggtggcgctatatattatgnagcgccgtgaacgggtccgttcacctacttaccagagactaagttcgaaagaacacgctgtaactctgacaaagtcggaagacgtcctagacgtacgtacgacgaacgtaccggtaccgtattatttagttgtaagttaaggcgtaggtaggaagtaccgggaccgggaccgtacgttagaccgtaggtcgggacgaggggacgcgtcggaccgtaccgtcctacgtcgacgaccttacccgaaccgtaaccgggaccctacggttccggttacccttcccccgccggaccttaccccctaccgtaaccgaaacggtcgtaccctaaccgtcgggtacggggaccctaacgcggaccgaccgggtacccgtgggaccctcggacccgttacggaacgaacgtaaccccgttacttacccgtacgttaccgtacgttacgtacccgtagggtaccgggtcgggtaccgtagggaccgtaaacggcccgtaagttaaaccgngtagtcacg

SEQ ID NO: 53870 - DNA, 862 bp, Homo sapiens
  misc_feature: GYAE6OF01DME04.29.78.H01.1.454.CMB.1.raw
tcagatagagtactcacgaccggtgctcgatttagtgtgagtagtttgggtttggggtccgagccatggtgcagactccccagagctctcctcctcctccactgcacgagggtctctcctcccagccgtgtgctagactactaactccgcccttctcgcctctcgtccctccggtagggacgtcgtacggtacgaaggtcctaaccgttgtaccttgtacgagtacgtaggtacgaacactaacggacaacgacctaaccggcctacgtccgttcgtcgactacgtaccgacggacgaaggaaccggtaccgaaaccggtacccggtacccggggtaccctttaacgtttaacgttcgttaagtaaccgaagttaaccgtaaacaaagtaaagttcggtaaacggttcgggaaacctaggttaaaccgaaacgggtaacggggaaaccgggggtaaacggggtaaccgttaccgtaacggtacgttaaccgtccggtttaacttccgtacgttacgtacgtacccggacgtaccgttccggtcggggaccttacggcgtaacccgtactaaccttacgaacgttcctacccggtctacccgtacgttcgggtctaaggtaacgacggtacgttaagcccggttaaagttaacccgttaacttaacggtcgtacgggttaactaccgggtacgtacgtacggtcgtttacggtacgttccggggttaacggtacccgggttaacccggggtaaccggaacccgtttaggacccgggttccttaaggggacccgtaccgaacccgacgtaaacccgtacccaccggtactacccgtccgttaaccttcccgtaccgttaccccg

SEQ ID NO: 53871 - DNA, 674 bp, Homo sapiens
  misc_feature: GYAE6OF01BANPH.29.78.H01.1.454.CMB.1.raw
tcagatagagtactcacgaccggtgctcgatttagtgtgagtagtttgggtttggggtccgagccatggtgcagactccccagagctctcctcctcctccactgcacagggtctctctcccagcctgtgctgactcaatccgccctctgccctctcgccctcccgtggggacggcttcggtacaaggtccacctgtactctgagcagtcggacacagcagctacgccatcgcttggcatcagcaggacggaccaaggaccgaccgggtcccttacgttacttgatgacagtacaaacaatgagtcggacagtacaacgaggacgggaaagggggacggactcccgtgactcgtccttctacgtacgtcctcgagtcctacggtcgggcctaggacgtccgtacctaccctacaactaccttccgtccccggtaccctaccgtacgtcgtaggaaggacttggacggtctagtaacttaagttacgtcgtacgaacggtcgggtcggggacctaacggtggaccttacggttcggtaacggttccggttaccggggaaacccggggtaacctaacgggtaccgtacccgggtcggtccggtaccgaccggtaccccgaaacggacccccaacccgtacgtcggtaaccctaccgttcccgtcccgttaacccccc

SEQ ID NO: 53872 - DNA, 944 bp, Homo sapiens
  misc_feature: GYAE6OF01E2A5Y.29.78.H01.1.454.CMB.1.raw
  modified_base (183)..(183): a, c, t, g, unknown or other
  misc_feature (183)..(183): n is a, c, g, or t
  modified_base (221)..(221): a, c, t, g, unknown or other
  misc_feature (221)..(221): n is a, c, g, or t
  modified_base (247)..(247): a, c, t, g, unknown or other
  misc_feature (247)..(247): n is a, c, g, or t
tcagatagagtactcacgaccggtgctcgatttagtgtgagtagtttgggtttggggggagagaggagtcccacccctgggatcttcaggttgttttcatttggtgatcaggacggaacagagagaactcaccatggagtttggctgagcgtgtcgtttctaggtggacttaattttaaaggngtccagtgtgacgtgcagttggtggagtgtgggggccncggtgggtaccggggccggggggtcncgtagacgtctctcgtggtcgccgtcctcgtaggttaagttttaagggtttacggacgttacgtacgtaccggtacctaaggtacggtaaccgggttccgggtaccccgaccggtaccggtacccggtaaccgggggaaaggggggtaaccgggggttccgggttacggggggtaacgggggtttccggggttacccggttaaccggggtttacgtttaaacgggtttacggggttacgggtacgggtttaggggtttcgggggtacgggtaccggttaactttaaagtttaagtttaaacggttacggtacggaacccgggtaacccgggtaccccggttacccgggtaacggggtaaaccccggggttccccgttaacccgttaaaccccgtttaccgtttaaacccggaaaggtaaaccgtaaacgttaaaccggttaaaccggaaacggtaaacccgttacgtacggttaacgttacgttaacgtaacgtaaacgttaaaggtacgggaacgtcgtaccgacgtaaccgtacgtaccgaaccggaccggtaccgtacgttacgttagttaggttagtaaggtacggtacgtagtacgggaacggttaccgggacccgggacccggtaccgtacggtacggtaccgtacgggccgggtaacggacgggtacgtacggttcgtcccgtccgtccg

SEQ ID NO: 53873 - DNA, 708 bp, Homo sapiens
  misc_feature: GYAE6OF01E2T07.29.78.H01.1.454.CMB.1.raw
  modified_base (179)..(179): a, c, t, g, unknown or other
  misc_feature (179)..(179): n is a, c, g, or t
  modified_base (539)..(539): a, c, t, g, unknown or other
  misc_feature (539)..(539): n is a, c, g, or t
  modified_base (616)..(616): a, c, t, g, unknown or other
  misc_feature (616)..(616): n is a, c, g, or t
tcagatagagtactcacgaccggtgctcgatttagtgtgagtagtttgggtttggggtctgagagaggagtccacccctgggatcttcaggtgttttcatttggtgatcaggacggaacagagagaactcaccatggagtttgggctgagcgtgtcttttctgtgctaattttaaaggngtcagtgtgacgtgctagttggtggagtcgtgggggccgccggtggggtaccgggccggggggtcgcgtgagacctctccgtgtcgcggcctcgtaggtagtttaaggtttgagtcatcggaccagtcgaacgtcggtccgcgacggctacggaggggacgggcgtggtaggtcgggtcgtcggtctagttggtggcgtaggtggtacggcgtacgtattaacgtattgtagcgacgaccgtcccgtagggaaccgggtcccggttactaccgtacttacgaacggagtaactaacgttaacggaacgaacccgcgtaccgttagtacttcgtaacgtacgtaacgttaggacgttaccncggtacgaaggtacccgtaggaaccgacccgtaccggtcgttacttaacgttgttaggttaacgtaaggcggtacgnggtaacgggtaccgaccgggggtaacccgttacccggtcgtaccgacggaccgggtacggggaccggacgggaccgttccgcgggtaccccg

SEQ ID NO: 53874 - DNA, 624 bp, Homo sapiens
  misc_feature: GYAE6OF01C3UA4.29.78.H01.1.454.CMB.1.raw
tcagatagagtactcacgaccggtgctcgatttagtgtgagtagtttgggtttggggtctgagagaggagtccacccctgggatcttcaggtgttttcatttggtgatcaggacggaacagagagaactcaccatggagtttgggctgagctggtctttttcttgtggctattttaaaaggtgtccagtgtgacgtgcagttggtggagtcgtgggggcgccgtggggtacgggccgggggggtcgcgtgagactctcctgtgcggcctctggatttaaggtttaggagtcatgccatgaactgggtccgccaggctccgaggggaaggggctggagtgggtctcggctattaggtggcaggtggtggcgctatatattatgcagaccgccctggaacggggccggttacacctatttccaagtagactaattcgaaagaacacgtactagtatctgacaaagtaggagacgcctagacgtacgtcgaacgaccgacccggccgttacttagttatttggtagttaaagggcgacgtcgtagggaacgtaccggggacccgggcccggtaacgttcgaacccgtacggtcggggacccgtagggggaccgtcggtcggtacccg

SEQ ID NO: 53875 - DNA, 799 bp, Homo sapiens
  misc_feature: GYAE6OF01EX3GA.29.78.H01.1.454.CMB.1.raw
  modified_base (209)..(209): a, c, t, g, unknown or other
  misc_feature (209)..(209): n is a, c, g, or t
  modified_base (793)..(793): a, c, t, g, unknown or other
  misc_feature (793)..(793): n is a, c, g, or t
  modified_base (798)..(798): a, c, t, g, unknown or other
  misc_feature (798)..(798): n is a, c, g, or t
tcagatagagtactcacgaccggtgctcgatttagtgtgagtagtttgggtttgggggcgcctgggtacggccggggggggtcgctgagactctcctgtgcggcctctggatttaagttttaggagtcatcgccatgaacgtgggtccgccgaggctccgaggggaggggctgggagtgggtctcggcttattagtggcagtggtggcntatatattagtgctagaccgcccgtaggaacgggtccggttacacctacttccgagaacgtaactaacgttacgaaacgaaccacgtctgtacttcagacaaagtggagacgtcctagacgtaccgtaccgacgacgtaccggtctacttagtttacgttaggtaggttaaacggcgtacggtacgtagggaacgggtaccggggaacccgggacctaccggttacgaccgtaacgggtccggggaccgaggggacgtcggtacggtccgtacccgtcctccgtaccgtaccgtacccgaccgaacccgggaccgggtacccgtaacccggttcccggttccccgttcccccggtccgtcccccgtaacccctccccgtaccgaacggacccgtacccgtacccgttccgggacggggtacccaacggacccggccggtaccggcccggttccgggtccgtaccggtaccggttccggtaacgaaccggttaccctttaccgtacccgtacgtttaccttaccgtacttccggtagggcgggttcccgggacgggtccgaacgggtaacggcggtacgtaacgngtcgng

SEQ ID NO: 53876 - DNA, 643 bp, Homo sapiens
  misc_feature: GYAE6OF01CJJWW.29.78.H01.1.454.CMB.1.raw
  modified_base (303)..(303): a, c, t, g, unknown or other
  misc_feature (303)..(303): n is a, c, g, or t
  modified_base (640)..(640): a, c, t, g, unknown or other
  misc_feature (640)..(640): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacncggccgtctattattgtagttaaggcgagcgtaggaagtacggggacccggggcccgacgttcgaccacgtcggggaccgagggggacgcgtcggtccaccgtctcctcacgccctccaccgaacgggcccacgtccggtcccttcccccgtcggacccctacccctcccgtacccaacgtacgcccgtacccgtccggtcgggggtccaccgacgaccgaccggcccgtacgggccgtacggtcccgttcggtaccgaacggtacctaaccgttccgacgttacctccgtacgtcgtagacgggcgggtccgtcgggcgaacgggccgacagtagntcg

SEQ ID NO: 53877 - DNA, 778 bp, Homo sapiens
  misc_feature: GYAE6OF01CR349.29.78.H01.1.454.CMB.1.raw
  modified_base (220)..(220): a, c, t, g, unknown or other
  misc_feature (220)..(220): n is a, c, g, or t
  modified_base (250)..(250): a, c, t, g, unknown or other
  misc_feature (250)..(250): n is a, c, g, or t
tcagatagagtactcacgaccggtgctcgatttagtgtgagtagtttggggtttgggggcgcctgggtacgggccgggggggtcgctgagactctcctgtgcggcctctggatttaagttttaggagtcagtgccatgaacgtgggtccgcaggctccgagggaagggctggagtgggtctcggcttattaggtggcaggtggtggcgtctatatattangcagcgccagacgggccgtcacattcaagnactatacgaagacagtctgtattcgtgacaaagtgggagacgtcctaggacgtaccgcggaacgacgaccgggtccgtatttaagttagtttaggtaagttaaagggcgtaacgtcgttaacgggaacggttaccgggggaccccgggtaccctacgtacggacccgacgggtcgggggaccgtagggggcgtacgtacgggtcccgacccgttcctccgacgaaccggtccctacccgaaccgggtaccgggtcccctagggttccccggtccctttccccccgaggtccccctaccccgttacctaacccggaaggaccggtccgtaaccccggttcggggtacgggggaccctaaccggacgaccccggtcggtacccccgggtttcgggaccctttccgggaccccgttaagggtacccgtaacgggttacccccttaccgttaccgtaacggttccttcgtaacccgttggaacgggtcggcccgggcttacggggaccgacgggttcaaccggttgacgtgc

SEQ ID NO: 53878 - DNA, 833 bp, Homo sapiens
  misc_feature: GYAE6OF01BN9TX.29.78.H01.1.454.CMB.1.raw
  modified_base (145)..(145): a, c, t, g, unknown or other
  misc_feature (145)..(145): n is a, c, g, or t
tcagatagagtactcacgaccggtgctcgatttagtgtgagtagtttgggtttggggtccgagccatggtgcagactcccagagctctcctcctcctccactgcacagggtctctctcccagcctgtgctgactcaatcgccctntcgcctctcgcctccgtgggacgctcggtacaaggtcacctgtactcgtgacgcagtggaaccacgagacgacgtactaccgacctagtccgtcgttaggactacgtacgaacggacgaggaacggacctaaggaacccggtaaccggggtccctttacgtttaaccgttgaaattcggtaaacctacggttaaccaaaacgaaagttcggaacggttccggtaacgacggtaccaacggaacggtaccgggaaaacggggggtcgtaacctcccgtacggtaacttccggtaccttacgtccgtaacgttccgtacaggtccgtttcgggacggtcgtacgaccggtcctaaaccgttacctacgtaactaacgtcccggtacccggtcctacgtacggtacttacgggaagtacgtggtacgtacgtagtaacgttaaccgttcgtacgtacgtaaccgggtaccgttacgggccgttaccgttagggtaaccttacgggtttaacgggttaccggttacccgggtttaaccggggaaaccccgggacgtttaacccgggtaccgtaccccgggttaccgggttaccgggttacccgaacccggtaaccccggaaacccttaacccccggtaaacccctacggttacccgtaacccgttacccgttccggttccccccgttacccg

SEQ ID NO: 53879 - DNA, 955 bp, Homo sapiens
  misc_feature: GYAE6OF01EI6WQ.29.78.H01.1.454.CMB.1.raw
  modified_base (283)..(283): a, c, t, g, unknown or other
  misc_feature (283)..(283): n is a, c, g, or t
  modified_base (950)..(950): a, c, t, g, unknown or other
  misc_feature (950)..(950): n is a, c, g, or t
tcagatagagtactcacgaccggtgctcgatttagtgtgagtagtttgggtttgggggcgcctgggtacgggccgggggggtcgctgagactctcctgtgcggcctctggatttaagttttaggagtcatgccatgaactgggtccgcaggctccgaggggaaggggctggagtgggtctcggctattaggtggcaggtgggtggcgtctatattattatgcacgaccgcccgtggaacgggtccgttcacctatttccagagacaattcgaaagaacacgtntgtatctgacaaagtggagacgtccgtagagtaccgtcggacgacgaccggtccgtacttaatttagttcggttaaggttaaaggcgtaggtacgtaggaacggtaccgggggacccgggacccgtaacgttcccgaaccgacggtcgggggaccggtaacgggggacgtccgttcgggtacccgtacccggttccgtcccgtaccgacccggaccccctaaccccgtaaacccgggaaccggggtaccccgttaaccggttccccgggtttaccccccgtttcccccccggttacccgggtacccccttacccccccgttacccggtaaccccggtaaacgggacccggttaacccccgttaccccgggttacccggggtacccgggggggaaccctaacccgggtacccggtaaccccgggtaccccggtaacccccggggttccgggggttaccccggttaaccccgggtcccggtttaacccgggggtaaaccggttaaacccgggttaaccccgtttaaacccggtttccccggtaaacccgttttacccggtttaaacctttaccccggttaccggggtaaccgggttaccgggtccgggggtaccccggggtttacggggacccgtaaacgggggtacccctaacggtaacgttaacggngaccg

SEQ ID NO: 53880 - DNA, 702 bp, Homo sapiens
  misc_feature: GYAE6OF01B5A75.29.78.H01.1.454.CMB.1.raw
  modified_base (700)..(700): a, c, t, g, unknown or other
  misc_feature (700)..(700): n is a, c, g, or t
tcagatagagtactcacgaccggtgctcgatttagtgtgagtagtttgggtttgggggcgcctgggtacggccgggggggtcgctgagactctcctgtgcggcctctggatttaagttttaggagtcatgccatgaacgtgggtccgccaggctccgaggggaaggggctgggagtgggtctcggctattagtggcagtggtggcgctatatattatgcagaccgccctggaacgggccggttcacctatttccagagacaattcgaaagaacacgctgtatctgacaaagtggagagcctgagactcgacgacgcgcctctattatgtagtaagcgagcgtaggaacgtaccggggacccggggcccgtacgttacgaccgacggtcgggggaccgagggggaccgcgtcggtccacccggtcctccctcgaccgccccgtacccgacccgaaccgggccctaccgttcccggttccccttcccccgtcggcccctaccccgtcctacccgaacgacgcccgtaccgtccggtacggggaccacggacgaccgaccgcccggtcgggtccgtccgtcccggttacggtaaccgaacggtaccttaacccgttcccgtaacgttacccgttacgttaacgttccgtacggaccgggtaccgggtccggtacgggaccggaccggcggaacctaggtacgnta

SEQ ID NO: 53881 - DNA, 879 bp, Homo sapiens
  misc_feature: GYAE6OF01A9A1S.29.78.H01.1.454.CMB.1.raw
  modified_base (251)..(251): a, c, t, g, unknown or other
  misc_feature (251)..(251): n is a, c, g, or t
  modified_base (861)..(861): a, c, t, g, unknown or other
  misc_feature (861)..(861): n is a, c, g, or t
tcagatagagtactcacgaccggtgctcgatttagtgtgagtagtttgggtttgggtctgagagaggagtccacccctgggatcttcaggtgtttcatttggtgatcaggacggaacagagagaactcaccatggacgtttgggcctgagctggtctttttcttgtgcttaattttaaaaggtcgtaccagtgtagacgtgcgtagttggtggagtcgtggggcgcccgtggggtaccggccggggggtcncgtgagacctctcctggtgaccgcctcgtaggtaagtttaagttttaggacgttacaagtcgaccgtagtacgtaaccggttcggggtaccccgaccgtaccgggtaccgtaccccgggaagggggtaaacgggggtcgtacgggttacgggtttcgggtaccgttccgggtactttaacggttacgggtacgggtacgttaacgggttgggggtaccggtacccgggttacctttaagttaacgttttaacgtttacgggtacgaaccggtaagggtaacccccggttcccggtaacggggtaacccgggttaccccgggtaccctaaaccgttcccgtttaacgacggtaaacgtaaccgtaaacgttaccggaaaggaacccgtacgtacgttagtaatccgtagaacgtaggtacggaagccgtaccgtaagaactccgacggtaccgaaccgtaccggtaccttacttacgtttagttacggttaacgtaacggggctacgggaccgttaagggaaaaccggttccccgggggaaccccgttaccgtcccggttaaacggcccccggtaacggtaccccgggggtacggaaccgggttaccccgngggttccggtaacccccg

SEQ ID NO: 53882 - DNA, 987 bp, Homo sapiens
  misc_feature: GYAE6OF01BL2UL.29.78.H01.1.454.CMB.1.raw
  modified_base (985)..(985): a, c, t, g, unknown or other
  misc_feature (985)..(985): n is a, c, g, or t
  modified_base (987)..(987): a, c, t, g, unknown or other
  misc_feature (987)..(987): n is a, c, g, or t
tcagatagagtactcacgaccggtgctcgatttagtgtgagtagtttgggtttgggggcgcctgggtacggccgggggggtcgctgagactctcctgtgcggcctctggatttaagttttaggagtcatgccatgaacgtgggtcccgccgaggctccgaggggaagggctggaggtgggtctcggcttagttaggtggctaggtggtggcgtacttaattattatttagtcgacacgaccgcccgttagggaaccggggtcccggtttaccaacccttacgttttacccgaaggtaaacgtaacctaaaacgtttaccggaaaaacggtaacccgaaccgggtacctttagggttaacttacccgttacgggtaaaacctaaaaaggttaggggaaacggtaccggtacccgtaagggaaaccggtaaccccgttaacccgggaaacccggaaaccccggtaacccggggttaccccgtttaccgttttaaagttttaaccgggttttacgggtttaaaacggggtttaaaaacggggcccggtaacgggtaccggtttaaacgggggtaaaaccgggttaaccccgggggggtaaccccccggggtaccccccggttaaccggtttaacccggaaccccggtaacccggggtaccggggggacccgggaaccggggggtacctcgggttaacccgggtccccgttaacccgttcccgttacccgtccgaacccggtacccccgtaacccgaacccgggtaaccccgggtccccgttaaccggttccccgggtttaccccccgttccccccgtagggtacccccctacccccgttacccgtaaccggtaaccgaccgacccgtaccggtcggtaccgggaccacggtaccgccgtaccgccggtcggtccgcgtccgtacggtaacacgtactccgtactacgtctacgtcgtgcggacggtcgcgacgacgcgacgatagtgngn

SEQ ID NO: 53883 - DNA, 826 bp, Homo sapiens
  misc_feature: GYAE6OF01DF28N.29.78.H01.1.454.CMB.1.raw
  modified_base (220)..(220): a, c, t, g, unknown or other
  misc_feature (220)..(220): n is a, c, g, or t
  modified_base (681)..(681): a, c, t, g, unknown or other
  misc_feature (681)..(681): n is a, c, g, or t
  modified_base (822)..(822): a, c, t, g, unknown or other
  misc_feature (822)..(822): n is a, c, g, or t
  modified_base (826)..(826): a, c, t, g, unknown or other
  misc_feature (826)..(826): n is a, c, g, or t
tcagatagagtactcacgaccggtgctcgatttagtgtgagtagtttgggtttgggggcgcctgggtacgggccgggggggtcgctgagactctcctgtgcgcctctggattaagttttaggagtcatcgccatgaactcgggtccgccgaggctccgagggaaggggctgggagtgggtctcggctattagtggcaggtggtggcgactatatatttangacacgaccgccccgtaggaacggggtcccggttacaaccttactttaccgaaggaacgaaactaacgttacgaaacggaaccacgtcgtagttaactctagaactaaggtaggaggtaacgtcgttggaacgacgtaccggacaaccgaccgggttaccgtttacttagttttacgttaggttaaggttaaacgggcgtagtacgtagggaacggttaccggggacccggtacccgacgttacgacccgtacggtcggggaccgtacggggccgtacgttaccggtccgtccgtacctccacccgtaccgtacccgaccgtaaccggaccggtacccgtaccgttcccggttcccctttacccccgtacccggtaccccttaccccgtaccgtacccgaaacgtcccggaccctaccggttcgggacgggtacaaccggtacgcccgacccgggttcccnccggggtcccgtaccggtccggttacggaccggtaaaccggttccttaacccgttccgttacggtaccccttacgttaccgtcggtaacggggacgggtcccgggtacgaacccgggaacggttaccggcgtaacgacgtnacgn

SEQ ID NO: 53884 - DNA, 821 bp, Homo sapiens
  misc_feature: GYAE6OF01BT0DM.29.78.H01.1.454.CMB.1.raw
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccgaggggaaggggctggagtgggtctcggctattagtggcagtggtggcgctatatattatgcagacgccctggaacgggccggttcacctatttccagagacaattcgaagaacacgctgtatctgacaaagtggagacgcctagagactcgacgacaccggccgtctattattaggtagttaaaggcgaggtcgtagggaacgtaccgggggacccggggtacccgtacgttcggaaccgtacggtcgggggaccggaacgggggaccgtcgtcgggtaccctacccggttccctcccgtaccgacggtcccctaccccgaacccggaaccgggggtccccctaaccggttccccgggttcccccgtttccccccccggtacgggtacccccgtaacccccgttaccccgttaacccgaaaccgggtacccgtaccccgttaacccggttcccggggttaccggggggacccaaccggtaccggacccggacccgggtacccccgggttcggggtccgttaccgggtcccggttacgggttaaccgaaccggtacccgttacccgttacccgtacggtttaccctaccgttaccgtccgtacgggaccggggtccgggtacccggtagggaacccgtaacggggtacctacggtacgtggctacgg

SEQ ID NO: 53885 - DNA, 672 bp, Homo sapiens
  misc_feature: GYAE6OF01E4OMF.29.78.H01.1.454.CMB.1.raw
  modified_base (277)..(277): a, c, t, g, unknown or other
  misc_feature (277)..(277): n is a, c, g, or t
  modified_base (669)..(669): a, c, t, g, unknown or other
  misc_feature (669)..(669): n is a, c, g, or t
tcagatagagtactcacgaccggtgctcgatttagtgtgagtagtttgggtttgggggcgcctgggtacggccgggggggtcgctgagactctcctgtgccggcctctggattaagttttaggagtcatgccatgaactgggtccgccaggctccagggaaggggctggagtgggtctcggctattagtggcagtggtggcgctatatattatgcagacgccctggaacggggccggttcaccatttccagagacaattcgaagacacgctgtatcngcaaagtggagacgcctagagactacggacgacgacggccgtcttaattattgtaggttaaacgggacgacgcgtagggaacgtaccggggacccggggcccgtacgttcgaccgacgtgggggacccgagggggaccgcgtcggtccaccgtctcctcgacgccctaccgaacccgaacgggcccacgtccggttcccttcccccgtcgggacccctacccctccctacccgaaacgaccgccacccgttccggtacggggaccacgacgaccgacggcccgtcgggaccgtcggtccgtacgggtacgtaacggtacctaccgttacctacggtacctacgttacgtcgtaggcgggtcgggccgtcgggaaccgacggccgagcgtagnacg

SEQ ID NO: 53886 - DNA, 798 bp, Homo sapiens
  misc_feature: GYAE6OF01A7JA5.29.78.H01.1.454.CMB.1.raw
  modified_base (147)..(147): a, c, t, g, unknown or other
  misc_feature (147)..(147): n is a, c, g, or t
tcagatagagtactcacgaccggtgctcgatttagtgtgagtagtttgggtttggggtccgagccatggtgcagactccccagagctctcctcctcctccactgcacagggtctctctcccagcctgtgctgactcaatccgccctntgcctctcgcctcccgtgggaggtctcgggtacaaggtcacctgtactcgtgagctagtggaacacagcacgctacgacagtcgcttggactactcgagacaggacggaccaagaccgaccggtccctacgttactgactagaactagtaaccaaactaagtggtaacgtcggtacctaacgtaccgaacgtaacgggtaaccggggtaaacggggggaccggtaacctcccgtaagaccgttaccgtcgtttacctagaccggttctaccgaacggtccttaccggtcgggtacctagggacgtaccgtaacctacccgtaacaacctaacgtcccgtacccggtaccctacgtaaggttcgaacgggtaacggtagtacgggtaggtaaccgtacggttaaccctttaaagttaccggtacgtaacgtaaccggtaaccgggtaggaccgtaacgttacgggtacttaacggtttaccgggtacgggttaccggtacccggggaacccgggttaaaccgtaaccggttcccggtaaccggttcccgggtaaccggtaacccgtaaccggaaaccccgggaaacccgtaacccccgaaacccgttccgtaccggttaaccctaccggttcccgttccccggtaccccccg

SEQ ID NO: 53887 - DNA, 768 bp, Homo sapiens
  misc_feature: GYAE6OF01BDA3Z.29.78.H01.1.454.CMB.1.raw
  modified_base (146)..(146): a, c, t, g, unknown or other
  misc_feature (146)..(146): n is a, c, g, or t
tcagatagagtactcacgaccggtgctcgatttagtgtgagtagtttgggtttgggggcgcctggggtacggccgggggggtcgctgagactctcctgtgcggcctctggattaagttttaggagtcatgccatgaactgggtccncaggctccgagggaagggctggagtgggtctcggctattagtggcagtggtggcgctatatattatgcagaccgcctggaacgggtccgttacaacctagtttccagagactaagttcgaaagacacgctagtatctgacaaagtggagacgctgagactcgacgacgacggcgtctattagtgtaggttaaagcgagcgtaggaacgtacggggaccgggcctaagttcgaccgtacggtcggggaccgtaggggaccgtcgtcggtaccaccggtctccgtaccgacggtcccctacccgaaccggtaaccgggcccctacggttcccggttccccttacccccgtaggtaccccctacccgttcccgtaaccgaaacggaccgtaacccgtacccgttccgggtaccgggggacctaaccggtacggaccgtaccggtcccccgggtaggggtacccgttaccgggtcccggtttaacggggtaacccgtaaaccgggtaccctttaaaccgtacccgttaagggttaacccttaccggttaaccgtccggttaagggaccggggtccgggtacggtaccgggaacggtaaccgggccggtaacgacggtggaaccgtg

SEQ ID NO: 53888 - DNA, 828 bp, Homo sapiens
  misc_feature: GYAE6OF01BVVN7.29.78.H01.1.454.CMB.1.raw
  modified_base (827)..(827): a, c, t, g, unknown or other
  misc_feature (827)..(827): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgcaggctccgagggaggggctggagtgggtctcggctagttagtggcaggtggtggcgctatatattatgcagacgccctggaacgggccgttcactattccagagacaattcgaagaacacgctgtaatctgacaagtggagagtccgtgaacgtaccgtacggaaccgacgtaccgggtaccgtacttaagtttagttacggttaaggttaaacggccgtagacgtagggaaacgtaccgggggaccgggtacccgtaacgttacgaccgtacggtcgggggaccgaacggggggtaccgtcgtacgggtacctaacccggttcctcccgtacgtaccgtacccgttaacccgaacccggaaaccggggtcccctaacggttccccggtttcccccgttcccccggttacgggacccccctaaccccgttacccttaacccggaaggacccgtaccgtacccggtttcccgggtacgggggacccaaccggacgggacccgtaccgggtaacccccgggttgggtacccggtacccgggtacccggttaggggttaacccgtaaaacgggtacccctttaacccggtttacccgttaaaccggtacccgttaccttacggtcccgttagggaccgggttacccgggcgtacgggaaccgtaacgggccaatacggtaagcng

SEQ ID NO: 53889 - DNA, 695 bp, Homo sapiens
  misc_feature: GYAE6OF01DM1B3.29.78.H01.1.454.CMB.1.raw
  modified_base (152)..(152): a, c, t, g, unknown or other
  misc_feature (152)..(152): n is a, c, g, or t
  modified_base (280)..(280): a, c, t, g, unknown or other
  misc_feature (280)..(280): n is a, c, g, or t
  modified_base (309)..(309): a, c, t, g, unknown or other
  misc_feature (309)..(309): n is a, c, g, or t
  modified_base (359)..(359): a, c, t, g, unknown or other
  misc_feature (359)..(359): n is a, c, g, or t
  modified_base (433)..(433): a, c, t, g, unknown or other
  misc_feature (433)..(433): n is a, c, g, or t
  modified_base (689)..(689): a, c, t, g, unknown or other
  misc_feature (689)..(689): n is a, c, g, or t
tcagatagagtactcacgaccggtgctcgatttagtgtgagtagtttgggtttgggggtcggcctgggtacggccgggggggtcgctgagactctcctgtgcggcctctggatttaagttttaggagtcatcgccgattgaactgggtcccnccaggcctcccgagggaaggggctggagtgggtctcggctattagtggcagtggtgcgactatatattatgcagaccgccctggaacgggccggttcaacctatttccaagagtataattccggaaanaacacgctagaatcctagactaaagtganacgcctagagactacgacgacgacggtcctatattatgtagttaagcganccggaatacgggaccgggccgatcgacacgtcgggaccgacgggacgcgtggtacctaccgtccgtacccgtanaccggtaccctccctaaaccgaacgggtccccaagttcccggtacccttcccccgtaggaccctaccccttacccgtaaccaaacgtacgtccgacccgtttcggaccggggaacctaacgaccgacgaaccgtccccggtagggtacctcggttacccgtagggttaacccaacgggtaaccttaccgtacccgtagtaacctacgtatccgtagacggcggtacacgggtcaaccgggtcaaccgagttaacgngtactg

SEQ ID NO: 53890 - DNA, 913 bp, Homo sapiens
  misc_feature: GYAE6OF01ARGN6.29.78.H01.1.454.CMB.1.raw
  modified_base (273)..(273): a, c, t, g, unknown or other
  misc_feature (273)..(273): n is a, c, g, or t
  modified_base (670)..(670): a, c, t, g, unknown or other
  misc_feature (670)..(670): n is a, c, g, or t
tcagatagagtactcacgaccggtgctcgatttagtgtgagtagtttgggtttgggtctgagagaggagtcccacccctgggatcttcaggttgttttcatttggtgatcgaggacggaacagagagaactcaccagtggtagtttgggctgacgtcgtggttctttttcttggtggtacttaattttaaaaggtgtcctagtgtgacgtcgtcgtaggtttgggtggacgttcggtgggggcgccggtaggggtaccggggccggggggtcncgtgacgtcctccgtccgtggtcgccggtcctcgttggtaattttaaaggttttaggatcgagtcgaccgtagtacggtaacggtccgggtcccgaccgtacggccgttaccggaagggggtaaggggtccggttggggtagggtcgggttcccgttacgggtactttaaggtttcgggtgggtaccgtgggttcgggtaggcgttactaagttaattagttaacgtcggtaaccgacggtacccgtccggttaacggaacggggttccccgttaccgtaaccttacgttaccgaacgtaacgtaactaacgtttaccggaaacgtacgaccggttcgttaaacgtacgttacgtaaacgtacgtaaacggttggtaacgtaggtaccccggttaanaaccgtacccgggttacccggaaacggtacccgggttaacccggtttcccttaaagggttttactttaacgggtttacgggttaacggtaaaacgggtccgggttaaagtcccgggtaaacggtaaaacccgggggttccccgggggaaccccggggttaccccgttagggtacccccgaacgggttacccgggtaccggggggaacccggtacgggggcccgttcggttcccgggtaacccg

SEQ ID NO: 53891 - DNA, 780 bp, Homo sapiens
  misc_feature: GYAE6OF01D8W1M.29.78.H01.1.454.CMB.1.raw
  modified_base (186)..(186): a, c, t, g, unknown or other
  misc_feature (186)..(186): n is a, c, g, or t
  modified_base (280)..(280): a, c, t, g, unknown or other
  misc_feature (280)..(280): n is a, c, g, or t
tcagatagagtactcacgaccggtgctcgatttagtgtgagtagtttgggtttggggcgcctgggtacggccggggggtcgctgagactctcctgtgcggcctctggattaagtttagagtcatgccatgaactgggtccgccagctccgagggaagggcgtggagtgggtctcggactagttagnggtcaggttggtcggcgactaatatattatcgacagaccgccctggaacgggtcccggttcaccgtatttccagacgacaacttacgaagaacncgtactgtacttgcgacaacgtaggagacgcctagacgacgtcgacgacctaccgggccgttacttaagttttacgttggttaaggtttaaacggaccgtacggacgttagggaaaccgtaccgggggaccccgggacccgtaccgtttcggaaccgtacggtacgggggccgaacggggtaccgcgttaccgggtaccgtacccgtaccgtccccgtacgtaccggacccgttacccccgaaaccggaacccggccccgtaaccgttcccggttcccccgtttacccccggtacgttaccccctacccgttccctaaccgaaccggaccgtacccggttacccgtcgggtacggggacctaaaccggtccggacccgacggtcccggtaccgtacggtccgtaccgttcggacgaaccgtactaccgtacgtacgttacctaccgtcgtacgcggtacgggtcgacggacgaccgtacgggacgacttagaccgtgacg

SEQ ID NO: 53892 - DNA, 787 bp, Homo sapiens
  misc_feature: GYAE6OF01EBPDO.29.78.H01.1.454.CMB.1.raw
tcagatagagtactcacgaccggtgctcgatttagtgtgagtagtttgggtttggggtccgagccatggtgcagactccccagagctctcctcctcctccactgcacgagggtctcctcctcccagcctgtgctgactcaactccgcccttctcgccttccgtcgcccgttcccggtggggacggtcgttccggtacgaacggttccaccttgtactcgtggacgtcgaggtacggaccaacgagcgacgtcctaacgcctacgtcgtcttcggctatcgaggacaacggacggaccacggaccgtaccgggtcccttacgtttacgtgactacgactaacgtacaactatgagtcggctacgcaacgacggacgggaacggggcgtactccggtagtactcctcttcctacgtacgttcctacgtaccgtcgttacggccggtacgtacggtaccgtaccctaccgtaacccttaccaaccgttaccgtccccggttaccccggtacccttaccgggtagttaccgggtaggtaaacggttccgtagggtaacccgtcgtttaaccgttaacgttttacgttaccggtacccggtacgggaaccggttccgggtaccgggaccttacggtaccggtacgttaccgttaccggggttaccggttacccggggtaaccggggaacccgtacccggtaacgttccccgggaccggttcgttacccggacgacccggacccgaccgtacccctaaccgtctaccgtaccgtccttcccgtcccgtccccg

SEQ ID NO: 53893 - DNA, 818 bp, Homo sapiens
  misc_feature: GYAE6OF01BDY4D.29.78.H01.1.454.CMB.1.raw
  modified_base (146)..(146): a, c, t, g, unknown or other
  misc_feature (146)..(146): n is a, c, g, or t
  modified_base (297)..(297): a, c, t, g, unknown or other
  misc_feature (297)..(297): n is a, c, g, or t
  modified_base (809)..(809): a, c, t, g, unknown or other
  misc_feature (809)..(809): n is a, c, g, or t
  modified_base (814)..(814): a, c, t, g, unknown or other
  misc_feature (814)..(814): n is a, c, g, or t
tcagatagagtactcacgaccggtgctcgatttagtgtgagtagtttgggttgggggcgcctgggtacggccgggggggtcgctgagactctcctgtgcggcctctggtattaagttttaggagtcatcgccatgacgtgggtccnccgaggcctcgagggagggcgtggaggtgggtccgtcggcttagttggtggcgtaggtgggtggcgtcttatagttattagtgcgtacggaccgccgtaggacgggtcccgttacaccttattaccgagtacgaacgtactacgaagaacnccgtctagtctacgtagacgtaaaggcgggaagtacgccgtagacgaccgtacggaaccgtacggacccggtacctttacggttaattttagtttaggttaaagggttaaaccggtcggaacggtacggtaagggaaccgggtaacccggggggtaccccggacccgttgtaaccggaccggtacgggtcggggaccggtacgggacgtcgtccggtactaccggtcccgtcctacgacccgtcccgtacccgaacggtaccggacccgtccgttacccggttcccccttcccccggtcgtacccccgtaccccgttaccgaacccgaaccggacccgtcccgtaaccccgggtccggtaccggggacccgaacgccggtaccgcccgggtacccggtcggtccggtccggtacccggtacggtaaccgaccgtaccttccggtaactccggtttaacctcgttactccgggacgtacgggtccgacgggtacgaaccggtcgacgttacgngttcncgta

SEQ ID NO: 53894 - DNA, 710 bp, Homo sapiens
  misc_feature: GYAE6OF01DZ4TY.29.78.H01.1.454.CMB.1.raw
  modified_base (706)..(706): a, c, t, g, unknown or other
  misc_feature (706)..(706): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgccaggctccgagggaaggggctggagtgggtctcggctattagtggcagtggtggcgctatatattatgcagacgccctgaagggccggttcaccatttccagagacaattcgaagaacacgctgtatctgacaaagtggagagcctgagacctcgacgacgaccggccgtctagttattggtagttaaaggcgagtactagggaaagtaccggggaccggggaccccgtattcggaacctacggtcgggggaccgagggggacgtcgtggtaccaccgtctcctacacgccctaccgaaccgtaacggacccacgtccggtcccttcccccgtcggaccctaccccgtcccgtaccaacggacgaccctacccgtccggcgggggtccaaccgacgtaccgacggtaccccgtcggggtcccgtcggtcccgttacgggttacccgaaacggggtaccctttaaccgttaccccgttaaacggttacccttaccgttacgttaccgttacggaacgggtccgggtaccgttacgggaccgtaacgggccggactaacgtgngtcg

SEQ ID NO: 53895 - DNA, 727 bp, Homo sapiens
  misc_feature: GYAE6OF01BS0D3.29.78.H01.1.454.CMB.1.raw
  modified_base (513)..(513): a, c, t, g, unknown or other
  misc_feature (513)..(513): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaagggctggagtgggtctcggctattagtggcagtggtggcgctatatattatgcagaccgcccgtggaacgggtccggttcacctatttccagagacaattcgaagaacacgctgtatctgactaaagtggagacgcctgagacctacgacgacaccggccgtactatttagtggttaggttaaacggcgtaaggtcgtagggtaaacgtaccgggggacccgggacccgtacgttacggaccgacggtcggggaccgagggggaccgtcgtacgggtacctaccggtcctcccgtcgacgtcccgtaccgacccgtaacgggcccctacgttcccggttcccttaccccccgnggacccctaccccgtcctaccgaacgtcgcccgtaccgtccgggtaccggggtaccaccgacgtccgacggtccccggtagggtcccgccggtacccgtgggaccgtaacggtacccttacccgtacgtaccgttactacccgttagtcccggtaggtaccggggtccgggtaccggtaggacccggtaacgggtccgaagtacgaacgcgacg

SEQ ID NO: 53896 - DNA, 927 bp, Homo sapiens
  misc_feature: GYAE6OF01EKQLK.29.78.H01.1.454.CMB.1.raw
  modified_base (146)..(146): a, c, t, g, unknown or other
  misc_feature (146)..(146): n is a, c, g, or t
  modified_base (193)..(193): a, c, t, g, unknown or other
  misc_feature (193)..(193): n is a, c, g, or t
  modified_base (313)..(313): a, c, t, g, unknown or other
  misc_feature (313)..(313): n is a, c, g, or t
  modified_base (922)..(922): a, c, t, g, unknown or other
  misc_feature (922)..(922): n is a, c, g, or t
tcagatagagtactcacgaccggtgctcgatttagtgtgagtagtttgggttggggcgcctgggtacggccggggggtcgctgagactctcctgtgcggcctctaggatttaaggttttaggagtcatgccatgaacgtgggtccncgaggctccgagggaagggctggagtgggtctcggacttagttaggnggtcgtaggtggtggcgtacttatattagttatgacgtacgaccgccgtaggaacgggttccgttaccaccttactttcccgagtaacgaacttaacgttacggaaacgaaccgtaccgngttagttactacgttacgactaaagttaggaagtcgtaccgtagacgtaaccgtacccggaccgaaccccggtaccgggttacccgttaacgtttaagttttaacggtttaggttaaaacggtttaaccgggtaccggaagtttaccgggtaaacgggtaaaccgggtaaccccggggggacccggttaccccggtaccgttaccgaaccggtaccgggtcgggaacccgggtaggggacccgttcggtaccggtacccgttaccgtacccgtaccgtacccgtaaccggtccccctaacccggaaccgggtaacccggtaccccgttccggttaccccccgggtttcccttccccccggtcccggtaaccccccgtacccccgttacccgtaaccgaaacggtacccgaacccccggttaacgggtcccggggtaacgggccctaaccggacggaccgtaccgggtcccgggttagcccgtttccggaccggttaccggtaacgtaaccgttacgttacccggttaacccacgtttaccaccgttacgttcggaaccggtcgggtaccgggtaccgaccggttaaacgggaaccgcgtacgtaaacgngtcga

SEQ ID NO: 53897 - DNA, 740 bp, Homo sapiens
  misc_feature: GYAE6OF01BNHW6.29.78.H01.1.454.CMB.1.raw
tcagatagagtactcacgaccggtgctcgatttagtgtgagtagtttgggtttggggcagggtgtacacctgtggttctcggggctgccctttggctttggagattggtttttctcgagtggggggctggggagggtctttttggttggagaccttgctactttgtacctccttgccattcagccagtcctggtgacaggacggtgaggacgctgaccacgacggtcgtgcttgttcgtactgcctcctccgcggtctttgtcttggctattagcgccacctccgacgtcccgtaccacgtacctaggttacgtaacttcgacctcgtacggttcttcggtcggtctccgtaccgtcccaccgaccacgcatcgtcgtaccgtcggacggggtccggagagtcgagtggagggttcgttcgggtttaggggtttacgggggaagtaaggtaacgtaccgtacggacccggtaccccgaggtacgttgacgggtcgcgtagggcgacgggtggacgtagttgtggttacgttagtttcgtacgtaacgtaagttcgtttgggtaccttaccgttaacgttttccgttacgttacccgttacgggttttcggttagtttcggtacggttggttacgtttggtagttaccgttacggtcggttacgtagtaaggttcgtttaacgggttcggtttacggttacggggtaccctaacccggttaggtcccgttcgggtacgggg

SEQ ID NO: 53898 - DNA, 701 bp, Homo sapiens
  misc_feature: GYAE6OF01BKGR6.29.78.H01.1.454.CMB.1.raw
tcagatagagtactcacgaccggtgctcgatttagtgtgagtagtttgggtttggggtccgagccatggtgcagactcccagagctctcctcctcctccactgcacgagggtctctctcccagcctgtgctgactcaagtccgccctctcgcctctcgcccgtcccgtgggacgcgtcggtacaaggtccacgttgtactcgtgacgcgaggtcggacacacggctacgacctaccgcctagtcgtcgttcggactaacgcgaagaccgaacgggaccggacccgaacggacccggtacccggggttcccttacggttttacgtagtacgtacgacgtaacgtacaaactaagtgagtcggactacgacgaacgacgggtaacgggacggggtacgtcgtaccgtgtaccgtctacttacgtacgtcgtacccagtcggtcctaggtccggctaacggccgtccctactaacccgtacacgttacctcccggtacccgtctacgtacgtgtacgtaggttagtaccgtctacgacttcgttacgcggacgtacggaccgttcgggacttaccggtgttacctacgggttggacccgggttcggaacccggggtacgacccgtaggtacccggtccgtcggtacggaccgtaccgaccgtaacccgccaacttcgcgtacttccctccctaccgtacccgtc

SEQ ID NO: 53899 - DNA, 844 bp, Homo sapiens
  misc_feature: GYAE6OF01B7ED0.29.78.H01.1.454.CMB.1.raw
tcagatagagtactcacgaccggtgctcgatttagtgtgagtagttttgggtttggggtccgagccatggtgcagacctccccagagctctcctcctcctccactgcacgagggtctctcctcccagcctgtgctgactcaactccgtccctcgtcgcccttctccgtcccgttcccggtaggggcggtccgttccgggtacgaacggtcccaccgttgtacctctggacgcgtaggcggaacacgacgtccgacgtaccgtaccgacctacgttccgtcgttcggacttaacgcgacgagacggccgaccgaacggacccggtaccggttcctttacggtttactagaacgtcggaaacctggtaaaccaaaacgaggttcgaacgttcgggacaacgtcgaaacgggaacggaaccggggggtaagggtaccgttaccgtacggtacgttaccttccgtaccgtttaccgacgttacgtcccgtacaccggtccgtttacgggccgggttacacggtccctaccctaactaccccggtaataacctcccggttcccgaccccgttaccgtcgtaacggttcgggtacgaacgggttacgcggttacacgtttaacgtattaccgttaagtcccggtaacggttccggacccgggttagggtacccgttacgtcgggtaaccttcgggttaaaccggtccgggggtttaccggaccgggtaaaccgtacggtaccggttcggtacccgggtaccgtccggtaacccggacccggaaacccggaccctaaaccccgggtcttaaccggccttaccccgtacccgttcccgtaaccccgtccccg

SEQ ID NO: 53900 - DNA, 721 bp, Homo sapiens
  misc_feature: GYAE6OF01CTS76.29.78.H01.1.454.CMB.1.raw
  modified_base (715)..(715): a, c, t, g, unknown or other
  misc_feature (715)..(715): n is a, c, g, or t
  modified_base (718)..(718): a, c, t, g, unknown or other
  misc_feature (718)..(718): n is a, c, g, or t
  modified_base (720)..(721): a, c, t, g, unknown or other
  misc_feature (720)..(721): n is a, c, g, or t
tcagatagagtactcacgaccggtgctcgatttagtgtgagtagtttgggtttgggggcgcctgggtacggccgggggggtcgctgagactctcctgtgcggcctctggatttaagttttaggagtcatgccatgaactgggtccgccaggctccgagggaaggggctggagtgggtctcggctattagtggcaggtggtggcgctatatattatgcagaccgccctggaacgggtccggttcacctatttccagagacaattcgaaagaacacgctgtatctgacaaagtggagacgcctgagactcgacgacgacggccgtactattacgttgtaggttaaaggcgtagcgtagggaaacgtaccgggggacccggggaccccgtacgttacggacccgtacggtcgggggaccgaacgggggaccgtcgtcgggtccgaccgttcctcccgtacgacgtcccctacccgaacccggaacgggccccctacggttcccggttaccccctttccccccgtcggacccctaccccctcccgttaacccgaacgtaccgacccgtacccgttccgggcgggggtaccaaccggtacgaccgtacccggtaccccggtcggggtcccgtacgggtcccgttacgggtaccgtaaacggtccttaccgttaccgtacgtaccttcgtatcgtggacggccgggcgtggacgtacggcnagngnn

SEQ ID NO: 53901 - DNA, 861 bp, Homo sapiens
  misc_feature: GYAE6OF01DGMP6.29.78.H01.1.454.CMB.1.raw
  modified_base (859)..(859): a, c, t, g, unknown or other
  misc_feature (859)..(859): n is a, c, g, or t
tcagatagagtactcacgaccggtgctcgatttagtgtgagtagtttgggtttgggggcgcctgggtacggccgggggggtcgctgagactctcctgtgcggcctctggatttaagttttaggagtcatgccatgaactgggtccgccaggctccgagggaagggctggagtgggtctcggctattagtggcagtggtggcgctatattattatgcacgaccgccctaggaacgggtccggttaccacctactttccaagacgactaattacgaacgaacacgctgtactctagacaaagtggagacgtcctagagactcgaacgacgacgtccgtattattattcggtaggttaaggcgagcgtaggaacggtaccggggacccgggacccgtacgtcgaccgtacggtcgggggaccgtagggggaccgtccgtcggtccgtacccgtcccgttcccgtacgaccgtccccgtacccgaacccggtacccggggaccccgtaacgtttcccccggggttcccccttttacccccccgggtcggtaccccccgttaacccctaccccgttaacccgaaaccggtaccggtaacccccgtaacccggttcccggggtacgggggaaccccaacccggtacggtaaccccgggtaccggtcccccccgggttagggtccccgttaccgggttccccggttaacggggttaaaccccggtaaacgggtttaacccccttttaccggttacccgttaaaacccgtttcccggttacccgttaaacggtttcccggttagggaacccggggtccggggtaacccggttcggggaaccgtacgggtacgaaccgtaagtcggancg

SEQ ID NO: 53902 - DNA, 676 bp, Homo sapiens
  misc_feature: GYAE6OF01ANFS1.29.78.H01.1.454.CMB.1.raw
  modified_base (674)..(674): a, c, t, g, unknown or other
  misc_feature (674)..(674): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaacctgggtccgccaggctccagggaaggggctggagtgggtctcggctattagtggcagtggtggcgctatatattatgcagacgccctgaagggccggttcaccatttccagagacaattcgaagaacacgctgtatctgacaaatggagacgcctgacgactaccggacgaccgacggccgttacgttaattagttagtaggtttaaaggccgtaagcgtaggaacggtaccgggggaccgggtacccggtacttacggaccgacggtcgggggaccggtagggggaccgtcgtcggtcctaaccggttccctcctacgacgtccctaccaccggaacgggccctacgttcccggtacccgttccccccgtcggacccctacccttcctaccgaacgacgcctacccgtcgtcggggtaccacgtacgcgtacgccgtaccggcgtcgtaccgtcggacgtaacgtacctaccgtactacgtacctacgtgtacgtacggcggtccggtacgtcggacgaacggtccgatacgtgtncg

SEQ ID NO: 53903 - DNA, 966 bp, Homo sapiens
  misc_feature: GYAE6OF01AWAGX.29.78.H01.1.454.CMB.1.raw
  modified_base (185)..(185): a, c, t, g, unknown or other
  misc_feature (185)..(185): n is a, c, g, or t
  modified_base (254)..(254): a, c, t, g, unknown or other
  misc_feature (254)..(254): n is a, c, g, or t
tcagatagagtactcacgaccggtgctcgatttagtgtgagtagtttgggtttggggggaagaggaagactgacggtccacccctgggatcttcaggtgttttcatttggtgatcaggacggaacagagagaactcaccatggagtttgggctgagctggtctttttctgtggctatttaaaggngtccagtgtgacgtgctaggttggtggagtcgtgggggcgccgtggggtaccgggccggggggggtacncgtggacgtacgtcttccgtggtcggccggtaccttcgtagggtaattttaaggttttaggagtcagttcggccagttggaaccgttggggtcccgaccgtaggaccttaccggaagggggaacgggggtccgtagggaggtcggggttcctaggggtccgttaaggtttaggtggccgtagggttgggtacggacggtcttaagtaattaagttagtggacgtaacggacccggtccgtaggtaaacccggggtccgtttaccaacccgttactttcccggaaagtaacgtaaccgtaaacgttccggaaacggtaaaccgtaccggtactttacgggtaacttaccgtaggtaaccgtaaaaggttaggggaacgtacgggtaaccggtagggtaaccggtaaccgtaaccgggtaacccgaaaccgggtaaccccgggtttacccgtttaaccgtttaaacgtttttaacggtttaacggggtttaaacggggttaaacggggtacccggttaacgggttaccggtaaaccggggggttaaaacccggttaaccccggggggggtaaccccccggggggttacccccggtttaacgggttaaccccgggtaaccccggttaacccgggggtcccggggggggtaaacccccgggtagggggggggttacccccttaccgggggttaacccgggggttaacccccccggg

SEQ ID NO: 53904 - DNA, 756 bp, Homo sapiens
  misc_feature: GYAE6OF01BBZEG.29.78.H01.1.454.CMB.1.raw
  modified_base (146)..(146): a, c, t, g, unknown or other
  misc_feature (146)..(146): n is a, c, g, or t
  modified_base (749)..(749): a, c, t, g, unknown or other
  misc_feature (749)..(749): n is a, c, g, or t
  modified_base (754)..(754): a, c, t, g, unknown or other
  misc_feature (754)..(754): n is a, c, g, or t
tcagatagagtactcacgaccggtgctcgatttagtgtgagtagtttgggtttgggggcgcctgggtacgggccgggggggtcgctgagactctcctgtgcggcctctggattaagttttaggagtcatgccatgaactgggtccncaggctccgagggaaggggctggagtgggtctcggactattagtggctagtggtggcgctatatattatgcagaccgcctggaacgggtccggttaccactactttccgagtacgacaattacgaaagaaccacgctagtatcgtgaacaagtggaagacgtcgtagaacgacctacggaaccgaccgaacccgggtccgttacttacgttttaagttacggtttaaggtttaaacgggcggtaaggtacgttagggaaaccgggttaccgggggaccccgggggtacccgtacgttaccggaccgtacgggcggggacccgggtacggggacgtcgtcggtaccgtaccgttccgtaccctacgccggtaccccacccgaaaccgggtaccgggaccctaaccgtttccggttaccccgttcccccgtacgggaccccccttacccctaccccgtacccgtaacgaaccggtccctaacccggttcgggacccgggggtacaccgaccggaacccgcggtcccgtacggtctccgtcgtacggacgtacgactaacgtcctacgtcctatacgtcgtggccggcggcgtacggacgcgcganagcgngc

SEQ ID NO: 53905 - DNA, 914 bp, Homo sapiens
  misc_feature: GYAE6OF01CLU1A.29.78.H01.1.454.CMB.1.raw
  modified_base (529)..(529): a, c, t, g, unknown or other
  misc_feature (529)..(529): n is a, c, g, or t
tcagatagagtactcacgaccggtgctcgatttagtgtgagtagtttgggtttgggggagagaggagtcccacccctgggatcttcaggttgttttcatttggtgatcgaggacggaacagaggaacgaactcaaccgagtggtaggtttcgggctggacgtcgttcggttctttttttcgttggtggtacttttaaagtttttaaaaggtcgttaccaggttggtcggtaccgtgcgtaggtttaggggtgggaacggttccgggtcgggggggtcccgtacccggggttacggggggtacccgggggggtcccgggggggggttcctaccggttaggaacggttacccgttcccgttccggtttacgggtcgggtcccggtaccccgttggttaacgggtttaaagtttttaaacgggttttaggaacggttactagtcgacctagtacgttaccggtcgggtcccgccgtacggtcgtaccgggaggggacggcgtagggtcggtcggtcgtacggtcttagtggngacgtggtggtggtcctagtaattcgtatttagcggtactaacggaccgtcccgtagggtaaccggttccgtaactacgtacttacgagtaactaagtactaaacggaacgtacgtaccgtatcgtactacgtacgaacgtaaggttaggatccggtaacgtcggaacgtaccgtaacggaaccggtacgtacccgttaccggttattaccggttagttaagtaacgggttaacccgagttaacggaccggtacggggtaaacccgggtacccgggggtaacccgggtcccgttaaccggaccgggttaacccgggtcgggggtaacccgggacccggggtaggttacccgttaccgggttcggtacccccgtccggttaccccg

SEQ ID NO: 53906 - DNA, 761 bp, Homo sapiens
  misc_feature: GYAE6OF01EYY6I.29.78.H01.1.454.CMB.1.raw
  modified_base (208)..(208): a, c, t, g, unknown or other
  misc_feature (208)..(208): n is a, c, g, or t
  modified_base (223)..(223): a, c, t, g, unknown or other
  misc_feature (223)..(223): n is a, c, g, or t
  modified_base (248)..(248): a, c, t, g, unknown or other
  misc_feature (248)..(248): n is a, c, g, or t
tcagatagagtactcacgaccggtgctcgatttagtgtgagtagtttgggtttggggtctgagagaggagtcccaccctgggatcttcaggtgttttcatttggtgatcaggacggaacagagagaactcaccatggagtttgggctgagctggtcttttttcttgtggtcttaattttaaaaggtgtcagtgtgacgtgcagttggnggagtcgtgggggcnccgtggggtacgggccgggggggtncgtgagtactctcctgtcgccggctcgtggtatttaaggttttaggagtcatcgccatcgaacgtcgggtccgccaggccttccgaggggtaacggggcgtgggtaggtcggtcgtcggtcttaggttaggtggcgtaggttggtcggtcgcgttaatacgttatttagtcggtacaggaccgtccggtaggaacgggtcccggttactaccgtagtttaccgaaggtacgaactaacgtttacgaagaactacgcgttagtactacgttacgacgtaaagtcgggaagtacgtccgtagaccggtaccgtacggaaccgacgtacccgggtacgttacttaaacgtttagttcggtaaggttaaaccgggcgtacggttaaccgtaacgggggttaacccggtaacccggggggtacccccggggtacccgtaccggtttaaccggaacccgacccggggttacgggggggaacccgacggggggtaaccgtcccgttaggggtaacccccg

SEQ ID NO: 53907 - DNA, 866 bp, Homo sapiens
  misc_feature: GYAE6OF01ADU3I.29.78.H01.1.454.CMB.1.raw
  modified_base (143)..(143): a, c, t, g, unknown or other
  misc_feature (143)..(143): n is a, c, g, or t
  modified_base (866)..(866): a, c, t, g, unknown or other
  misc_feature (866)..(866): n is a, c, g, or t
tcagatagagtactcacgaccggtgctcgatttagtgtgagtagtttgggtttggggcgcctgggtacggccggggggtcgctgagactctcctgtgcggcctctggattaagttttaggagtcatgccatgaactgggtccnccaggctccagggaagggctgggagtcgggtctcggcttagttagtggcaggtgggtggcgctaatatattatggcagccgccctggacgggccgttcgaccctatttccgagacgaactaattacgaacgaaccacggtcttaggtattcgtacgacaagttgggagacgccgtagacgacgttcgacgacaccgggtcctacttattgttgtacggttaaggccgtagccgtagggaacgttaccggggaccggggtaccccgtacgttcggaccgtaaccgggtccgggggacccggacgggggtaccgaccgggtttacgggtacccgtaacccggttccgtaccccgtaccgaccgggtccccccttaacccggaaccccgggaaaacccgggggtcccccttaaccgggtttcccccgggtttacccccccgtttacccccccgggtaccgggttccccccctaacccccgttcccccgttaaacccgaaccgggtacccgtacccgtaaccccggtccggggtcgggggtacccaccggtaccgacccggacccggtaccccgggtcgggtacccgtccggtaaccccggtcggggtaacccgtaacccgggtaccctttacccgtaccgtccgttacttacccgttacgtaccggtcgggaccggtcccgggtacgtacgggacccggtacggtccggtaaccaaggttcgcggn

SEQ ID NO: 53908 - DNA, 798 bp, Homo sapiens
  misc_feature: GYAE6OF01BNZUP.29.78.H01.1.454.CMB.1.raw
  modified_base (467)..(467): a, c, t, g, unknown or other
  misc_feature (467)..(467): n is a, c, g, or t
  modified_base (792)..(792): a, c, t, g, unknown or other
  misc_feature (792)..(792): n is a, c, g, or t
tcagatagagtactcacgaccggtgctcgatttagtgtgagtagtttggggtttgggggcgcctggggtacgggccggggggggtcgctgagactctcctgtgcggcctctggatttaagttttaggagtcatgccatgaactgggtccgccgaggctccgagggaagggctgggagtgggtcgtcggctattaggtggcaggtggtggcgctatatattagtgacacggaccgtcccgtaggaacggggtccggttacaacctagtttaccgaagagaactaaagttacgaaagaaccgacgtctagtactcgtacgaacaaaagtcggaagtagcctaggacgacgtcgaacgaacgtacggccttacttaattacgttagtacggttaaacggcgagtcgtaggaaacggtaccgggacccggggaccgtagttccgaaccgtacggtcgggaccgaggggacncgtcggactaccgctacgcgacgacccaccgaaccggaacggcccgtaacgttaccggttcccgttaccccgtggaccccacccgttcctaaccgaaacggccgaccgtaacccgtcgggtaccgggggaccaacccgtaaggtacccgaccggggtaccccggttggggcccgttaccggtacccggttacgggtaaaccggtaaaccgggttaaccctacccggtttaaaccgtaaccggtttaccttaaccggttaacgtttccggtagggtacgggcccgggtaccgtacgggtaacgggtaaggacccgtaagtaaacgngactcg

SEQ ID NO: 53909 - DNA, 747 bp, Homo sapiens
  misc_feature: GYAE6OF01BUARL.29.78.H01.1.454.CMB.1.raw
  modified_base (336)..(336): a, c, t, g, unknown or other
  misc_feature (336)..(336): n is a, c, g, or t
  modified_base (743)..(743): a, c, t, g, unknown or other
  misc_feature (743)..(743): n is a, c, g, or t
tcagatagagtactcacgaccggtgctcgatttagtgtgagtagtttgggtttgggggcgccgtgggtacggccgggggggtcgctgagactctcctgtgcggcctcgtggtaatttaagttttaggagtcatgccatgaacgtgggtcccgcaggtctccgaagggaaggggtcgtgggaggtgggtctcggacttaagttaggtggactaggtgggtcggcgtacttataattattagtcgacgacggtaccgcccgtagggaaccgggtcccggtttacaaccttagtttacccgaagtaagaactaagttacggaaaacgaaccgaccggtntagttaactcgtaacgaataaaggtgggaacgcgaccgtagaacgtaccgtacggaacgacgtaccggtcgtattaagtttagtgttaaggtaacggtcgagtcggtacggaaacggtcccggggacccggaccgtaagtcggaccgtagggcgggacggacgggacgtcgtcggtacctaccgtcgtcccgtacgaccgtccctaccgaccggacgcctacgtcccgtcctcccgtcgaccctccctacacgtaacgccgccgtacggtcggacgacgacgagccgacggtccgtacgtcgtacggtccgtaggaccgtaaccgtaccttaccgtacgtacgttacctacgttacggtcgtacgggacgtcgggtcgaaggtaaccgggacgtcggaatacggagngacg

SEQ ID NO: 53910 - DNA, 864 bp, Homo sapiens
  misc_feature: GYAE6OF01BWJ76.29.78.H01.1.454.CMB.1.raw
tcagatagagtactcacgaccggtgctcgatttagtgtgagtagtttgggtttggtggtctctctcccagcctgtgctgactcaatccgccctctgcctctcgcctccctgggaggctcggtcaaggtcacctgtactctgagcagtggacacagcagctacgccatcgcttggcatcagcagagccagacgacgggccctgttactgatgacagtcaacagtgatggctagtcaacgtaggacggaaagggggaccggtactccccgtaggtaaccttccggtcctttaccgtccgaacgttcctacccgagtccgttcggtcggggtccctagggacgtcccgtacccgttaacctaccaaaccgtaacgttccccggtaaccccggtccctttacccgaaggttacccttaggggaaaccgggtacgtacgggaaccgggttccttaacgggttaacctttaacgtttacccgtacggtttaaccgaaccggtaacccgggtttgggggacccttacggtacggggtaccttaaccgttttaccggggtaccgggtttaccccggggtaacccgggggtaaccccggggtaacgttaaacccggggtttccccgtaacccggggttttccgggtaacccggttaccgaaccccgggtacccccggtaaacggtaccccccgtaaaccccgttacgtccgttaaccccttaccgttaccccgtttcccgttaacccccccgaccgtttcctaaacccggtcgtttacccgttacccgttaacggtccggttaccggggaacccgggttccggacggttaccggacccgttaacggggcctacggtaagtaggcctaagccgg

SEQ ID NO: 53911 - DNA, 764 bp, Homo sapiens
  misc_feature: GYAE6OF01BS9O6.29.78.H01.1.454.CMB.1.raw
  modified_base (397)..(397): a, c, t, g, unknown or other
  misc_feature (397)..(397): n is a, c, g, or t
tcagatagagtactcacgaccggtgctcgatttagtgtgagtagtttgggtttggggtccgagccatggtgcagactccccagagctctcctcctcctccactgcacagggtctctctcccagcctgtgctgactcaatcgccctctgcctctcgccctccgtgggacgctcggtcaaggtcacctgtactctgagcaggtcggacacgagcagacctaccgccatcgtcgttggctatcagcaggacgccagaccgaccgggtcccttagtttacgtgagtacgaacgtacgtaacaaacgtaagtcggaagttcggacgacgtccaacggacggacggggaaacgggggaccgtacgtcccgtagacgttcgtccttcgtacgtacgttcctacncggtcctcgggtccggtccgttacggacggtccctaacccgttaaccgtacctaaccgtacgtttccccggtacccgtacccgtacgtaacggttcggtaggaacggtacgtcgggaccgttcgttaacgtaacctttacgtttacggcgtaaccgtacgggtaccggtcgggaacttcggtacggttaccgttaccggtttacgggtacccgggttacccgggtaacccggggtaacccgggtaaaccgtacggttaccccgggtacccggtttcgggtacccgtaacccggacccggtaaccccggaaaccggtaccccccaccgtacggttcccaacttcccgtttccgtaccccttacccccg

SEQ ID NO: 53912 - DNA, 746 bp, Homo sapiens
  misc_feature: GYAE6OF01DBCFT.29.78.H01.1.454.CMB.1.raw
  modified_base (248)..(248): a, c, t, g, unknown or other
  misc_feature (248)..(248): n is a, c, g, or t
  modified_base (744)..(744): a, c, t, g, unknown or other
  misc_feature (744)..(744): n is a, c, g, or t
  modified_base (746)..(746): a, c, t, g, unknown or other
  misc_feature (746)..(746): n is a, c, g, or t
tcagatagagtactcacgaccggtgctcgatttagtgtgagtagtttgggtttgggggcgccgtgggtacgggccgggggggtcgctgagactctcctgtgcggcctctggattaagtttaggagtcatgccatgaactgggtccgcaggctccgagggaagggctggaggtgggtctcgggcttattagtggcaggtggtggcgctatattattatgcagacgccctaggaacgggtcgttcacctnttccgagagactaagttcgaaagtacgacgtctagtatcgtgaacaaagtggagacgtccgtaggacgaccgtacgacgacgacggtccgtattacttagtgttaggtaagcgagtacgtagaacgggtaccgggaccggtaccgtacgtacgaccgtacggtccgggaccggaaggggacgtacggtacgtacccggtaaccgttccgtacccgtacgaccgtaccccgtaacccaacccgggtaaccgggtccctaaccggttcccggttacccccttcccccggtggaccccctaccccttaccgtaaccgaacgtaccgacccgtaccgtcgggtcggacccagtacggccgaccggtcccggttgggacccttcgggtaacccgttggtaaccgaaccgtttaccgtaccgttaaccctcggtaaacctcgtaacgtcgtacgggacggtccggtcggtaacggaaccgtacggtacgaactaaggttccngn

SEQ ID NO: 53913 - DNA, 909 bp, Homo sapiens
  misc_feature: GYAE6OF01DDWPZ.29.78.H01.1.454.CMB.1.raw
  modified_base (251)..(251): a, c, t, g, unknown or other
  misc_feature (251)..(251): n is a, c, g, or t
  modified_base (412)..(412): a, c, t, g, unknown or other
  misc_feature (412)..(412): n is a, c, g, or t
tcagatagagtactcacgaccggtgctcgatttagtgtgagtagtttgggtttggggtctgagagaggagtccacccctgggatcttcaggtgttttcatttggtgatcaggacggaacagagagaactcaccatggagtttggctgagctggtctttttcttgtggtcttaattttaaaaggtgtccagtgtgacgtgctaggttggtggagtcgtgggggcgccggtggggtacgggccgggggggtcncgtgagtactctccgtggtgccggtcctcgtaggtattttaaggttttaggaagtcgaagttcgcctagtacgaacggttcgggtcccggaccgacggtcctacccggaaggggacgggggtcgtgggtaggtcgggtcgtcggtcttagttagggtcggngtaggtggtcggtctacgtattattacgttatgtacacgaaccggtccgtaggaaccggggtccgttaccgtaacctactttaccgaacgtacggtaaccttaaacgtaccgtaaaacggtaaccgtaacggtcccttacggttaactttacccgtaaggtaaccggtaaaagttacggggtaaagtacccggttaaccggtaaggaaccggttaaccggttacccgggaaaccggtaaccccggggaaccggtttaccccgggtttatttaaacgggttttaacgttttaacgggtttaacgggtttaaaaaccggggtccggttaaaccgggtaccggggttaaacggggaaaccccggggtttaaccccggggggaaccccggggtaaccccggttaaccgggttacccgaaaccccgggttaccggggtacccgggggtaacccggggtaaccgggggtaacccggtcccggggtttcccgttaacccccggg

SEQ ID NO: 53914 - DNA, 693 bp, Homo sapiens
  misc_feature: GYAE6OF01CF1M3.29.78.H01.1.454.CMB.1.raw
  modified_base (60)..(60): a, c, t, g, unknown or other
  misc_feature (60)..(60): n is a, c, g, or t
  modified_base (82)..(82): a, c, t, g, unknown or other
  misc_feature (82)..(82): n is a, c, g, or t
  modified_base (188)..(188): a, c, t, g, unknown or other
  misc_feature (188)..(188): n is a, c, g, or t
  modified_base (274)..(274): a, c, t, g, unknown or other
  misc_feature (274)..(274): n is a, c, g, or t
  modified_base (278)..(278): a, c, t, g, unknown or other
  misc_feature (278)..(278): n is a, c, g, or t
tcagatagagtactcacgaccggtgctcgatttagtgtgagtagtttgggtttgggggcncctggggtacggccggggggtnctgagactctctgtgcggcctctggtattaagtttaggagtcatgccatagaactgggtccgccgaggctccgagggaagggctggaggtggtctcggctattagnggcagtggtggcgactatatattactgcagaccgcccgtaggaacggtccgttacactattcgagagaactaagttacgaagaacnccgnttgtaactctgaactaaacgtggaagacgtcctagacgacgtcggaaccgaccgacggtcctacttaagtttagtacgttaagggtaaaggcggagtacgtaggaaccggtaccggggaccgggtccctacgttacgaccgaggtcggggacgacggggactcgtacggttacccaccgttcctcctacgaccgtcccgtacccgaaccggaaccgggtccccgtaacgttcccggtccccgtttacccccgaccgtaccccgtaccctcccgtaccgaacgtcctaccgacccgtacggtacgggacctacgacggaccgtcgccgtcgtccgtcgcgtcgacgtacgtacctaccgtacgacgtactcctgtcctgggacgcggacgttggacgtacggcgagtacgtgcgtc

SEQ ID NO: 53915 - DNA, 839 bp, Homo sapiens
  misc_feature: GYAE6OF01BGGRP.29.78.H01.1.454.CMB.1.raw
tcagatagagtactcacgaccggtgctcgatttagtgtgagtagtttgggtttggggggcgcctggggtacggccggggggggtcgctgagactctcctgtgcggcctctggatttaagttttaggagtcatgccatgaactgggtccgccaggctccgaggggaggggctggagtgggtctcggctattaggtggctaggtgggtggcgctatattattatgcagaccgcccgtaggaaccggggtcccgttcaacctatttcccaaggtacgaactaagttcgaaacgaaccacgtctgtactctagacaaagtaggagacgtacgtgacgtacgtcgaacggaccgtaccggcgttacttaagtttagtttaggttaacggttaaagggcgacgtcggtaagggaaccggtaaccggggacccggggacccgtacgtacgaccggacggtccggggacggacggggggaccgtcggtcgggcctaccgtccctacccgacgtacctccctacccgaaacccggaccgggtacccgtacgttcccggttaccccgttacccccgtccggtaccccgtaccccgttacccaccggtaacggaccgtaccgtacccggtaccgggtacggggaccgaaccgtacgaccggaaccgtcccggtaccgggtccgttacccggtccggttaccgggtaaccggaaccggttaccgttaaccccgttaccgtaaccgtaaccgttaccttaaccggttcggtacccgggtacggggtaccgggtacccgggtacggggtaaaccggaacgggtaccgtaaccggtaacgttaacgggcgtacg

SEQ ID NO: 53916 - DNA, 641 bp, Homo sapiens
  misc_feature: GYAE6OF01BFC8L.29.78.H01.1.454.CMB.1.raw
  modified_base (622)..(622): a, c, t, g, unknown or other
  misc_feature (622)..(622): n is a, c, g, or t
  modified_base (633)..(633): a, c, t, g, unknown or other
  misc_feature (633)..(633): n is a, c, g, or t
  modified_base (639)..(640): a, c, t, g, unknown or other
  misc_feature (639)..(640): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcacctatttccagagacaattcgaagaacacgctgtatctgacaaatggagagcctgagactccgacgacaccggccgtctatttattgtagttaaagggcgagcgtaggaacgtaccggggaccccggggccccgacgtttacgacccgtacgtcgggggcccgaggggggaccgcgtgggtccacccgtctccctcacgccctcccgacccgaacgggccccacgttccggtcccttccccccgtcggtccccacccctccctacccgaagaccgcctaccctcgtcggggcacgcgccacgcccgtcgggcctcggtcccgtacggtacgaacggtacccttacttaccgtacgttacctactacgtcgtggacggtcgggcgnggacgacggcncgatgnng

SEQ ID NO: 53917 - DNA, 696 bp, Homo sapiens
  misc_feature: GYAE6OF01DBOVA.29.78.H01.1.454.CMB.1.raw
  modified_base (186)..(186): a, c, t, g, unknown or other
  misc_feature (186)..(186): n is a, c, g, or t
  modified_base (389)..(389): a, c, t, g, unknown or other
  misc_feature (389)..(389): n is a, c, g, or t
  modified_base (462)..(462): a, c, t, g, unknown or other
  misc_feature (462)..(462): n is a, c, g, or t
  modified_base (552)..(552): a, c, t, g, unknown or other
  misc_feature (552)..(552): n is a, c, g, or t
  modified_base (695)..(695): a, c, t, g, unknown or other
  misc_feature (695)..(695): n is a, c, g, or t
tcagatagagtactcacgaccggtgctcgatttagtgtgagtagtttgggtttgggggcgccgtgggtacgggccgggggggtcgctgagactctcctgtgcggcctcgtggatttaagttttaggagtcatcgccagtgaacgtcgggtccgcaggctccggagggaagggctgggagtgggtcncggtactagttaggtggctaggtgggtggcgtctattattattagtcggacaacggaccgcccgtagggaaccggggtccggttaccaccgttaatttaccgaagaacgaactaagttacggaaaacgtaacgacgtcttagtacttcgacgaataacgtggaagacgtccgtagacgaaccgacgacgtacgaccggtcctnttagttgttagtagtaggcagcgtaggacggtacggggccgccgtatacgcgtacggcgggacgtacgggacncggttcgaccgcttcgacctcgaccggcctccgaacgaccgccgtacgtccgttccgtcccgccggaccctaccgtcctacgacgtaccnccgtacggtcggtacgggacacgcgcgaccgccggtacggtcgtccgtacgtcggtaacgtaacccggtacttaccgtaaccttggtcccttaacgtcgtacggtcggacggcgggttcgacgacggacggacacaagtgacnc

SEQ ID NO: 53918 - DNA, 664 bp, Homo sapiens
  misc_feature: GYAE6OF01ADOLK.29.78.H01.1.454.CMB.1.raw
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctggaacgggccggttcaccatttccagagacaattcgaaagaacacgctgtatctgacaaagtggaagacgcctgagactcgaacgacaccggccgttctattattgtagttaaacgggcgagcgtaggaacgtaccggggaccgggcccgtacttgacctacggtcggggcccgaggggacgcgtggtccaccgtctcctcacgccctccaccgacgggccctagtcccggttcccttcccccgtggacccctaccccgttcccgtacccgaacggaccgccctacccgtccggtaccggggccacgacgccacgtccccgtcgggcctcggtcccgttgggtacccgtaacggacccttaccgttacccgagttaccctacttacgttcgtacggacgggcccgggtacgtcgggaccgtacgggcctacaacgtgcgtg

SEQ ID NO: 53919 - DNA, 821 bp, Homo sapiens
  misc_feature: GYAE6OF01DBOFU.29.78.H01.1.454.CMB.1.raw
  modified_base (350)..(350): a, c, t, g, unknown or other
  misc_feature (350)..(350): n is a, c, g, or t
  modified_base (383)..(383): a, c, t, g, unknown or other
  misc_feature (383)..(383): n is a, c, g, or t
tcagatagagtactcacgaccggtgctcgatttagtgtgagtagtttgggtttggggtctgagagaggacgtcccaccccgtgggatcttcgaggttgttttctatttggtgatcgaagggacggaacagagaagaactcaccagtggtaggttgggctgagtcgtggttctttttcgtggtcggtactttaaagttttaaaagggtcgtaccgtaggttgtaggtacggtcgacgtagggttgggtaggcggttcgggtgggggcctccgggtggggggtacccggggccggggggtcagtggacgtcctctcgtgcggccggtctcgtaggtaagtttaaggttaggntcgatcgtacctagtacggaccggtcgggcccncggtaacggtccgtaccgggggaagggggtaacgggtgtacgggtacgggtcggtccgtcgggtagttaagttacgggcggtaacggtgggtcgggtcgggacctatttaagtaacgtttactaggtcgaccgaaccggtacccggaccggtacggggaaccgggtttaccccgtacttaaccggttacttaccgggaaaggaaccgttaaccgtaaacgtaccggaaacgtaacggtaccgttaacgtacggttacttacgaagtaacgtaaaggtaggaggacctacgtacgaacggtacgacgacgaccgtcgtactttagtaatttcgtacggtaagaagtcgtagacggttaagggaacgggtaccgggtaccggaccgttacgcccggaaggccgggtaccggggacggtaccggggctcggtcggtacccg

SEQ ID NO: 53920 - DNA, 746 bp, Homo sapiens
  misc_feature: GYAE6OF01AHJ3X.29.78.H01.1.454.CMB.1.raw
  modified_base (177)..(177): a, c, t, g, unknown or other
  misc_feature (177)..(177): n is a, c, g, or t
  modified_base (180)..(180): a, c, t, g, unknown or other
  misc_feature (180)..(180): n is a, c, g, or t
  modified_base (183)..(183): a, c, t, g, unknown or other
  misc_feature (183)..(183): n is a, c, g, or t
  modified_base (186)..(186): a, c, t, g, unknown or other
  misc_feature (186)..(186): n is a, c, g, or t
  modified_base (190)..(191): a, c, t, g, unknown or other
  misc_feature (190)..(191): n is a, c, g, or t
  modified_base (197)..(197): a, c, t, g, unknown or other
  misc_feature (197)..(197): n is a, c, g, or t
  modified_base (206)..(206): a, c, t, g, unknown or other
  misc_feature (206)..(206): n is a, c, g, or t
  modified_base (225)..(225): a, c, t, g, unknown or other
  misc_feature (225)..(225): n is a, c, g, or t
  modified_base (231)..(231): a, c, t, g, unknown or other
  misc_feature (231)..(231): n is a, c, g, or t
  modified_base (278)..(278): a, c, t, g, unknown or other
  misc_feature (278)..(278): n is a, c, g, or t
  modified_base (353)..(353): a, c, t, g, unknown or other
  misc_feature (353)..(353): n is a, c, g, or t
  modified_base (553)..(553): a, c, t, g, unknown or other
  misc_feature (553)..(553): n is a, c, g, or t
  modified_base (714)..(714): a, c, t, g, unknown or other
  misc_feature (714)..(714): n is a, c, g, or t
tcagatagagtactcacgaccggtgctcgatttagtgtgagtagtttgggtttggggtcgtgagagaggagtccaccctgggatcttcaggttgttttcatttggtgatcaggacggaacagagagaacctcaccatggagtttggctgagcgtgtctttctgtgctaattaaagtntcngtntgngtgnngtgtgntcgtgggcncgtggtacggcgggggtcncgtganacgtctcgtgtcgtcgtacctcgtggtaactttaaggttttaacggngttaccgagttgcctaagtacgtaacgtcggtaccgccgtacggtaccctacggacggggagggtaccgttaggnggttccggtacgtcggtacgttaagttggtcggtcgaggttggtcggcacgtattacgttatagcgtaccgacgtaccgtccggtaggtaaccggttcccgtactaacccgtacgttacccgaggtaactacgttaaacggtccaaagaccgttacgttactaaggtttacaccgttagggtaaactaacgtccgggtanaaacgccgtttaaacgcgggtaaaccttcccgggaacgtaaccccggtccggtacccggtttatttttaacgaagtttacgggttaagtaaccggtggtaacgtaccgtaaggggtaacgggttccccgggacccggtttacggaccttacgaacccgggngggttaccggcggacggccgttgtccgtaccg

SEQ ID NO: 53921 - DNA, 899 bp, Homo sapiens
  misc_feature: GYAE6OF01E18F7.29.78.H01.1.454.CMB.1.raw
  modified_base (223)..(223): a, c, t, g, unknown or other
  misc_feature (223)..(223): n is a, c, g, or t
  modified_base (248)..(248): a, c, t, g, unknown or other
  misc_feature (248)..(248): n is a, c, g, or t
  modified_base (328)..(328): a, c, t, g, unknown or other
  misc_feature (328)..(328): n is a, c, g, or t
  modified_base (432)..(432): a, c, t, g, unknown or other
  misc_feature (432)..(432): n is a, c, g, or t
tcagatagagtactcacgaccggtgctcgatttagtgtgagtagtttgggtttggggtctgagagaggagtccacccctgggatcttcaggtgttttcatttggtgatcaggacggaacagagagaactcaccatggagtttgggctgagctggtctttttcttgtggcttaattttaaaaggtgtccagtgtgacgtgctagttggtggagtcgtgggggcnccgtggggtacgggccggggggtcncgtgacgactctccgtgtcgccggtcctcgtaggtaattttaaggtttggatcagtcgcctatggaacgtcgggtacccncgaggcctcggagggggaagggcgtaggtaggtcgggtcgttcgggacttagtttagggtcggtcgtagggttcgggtcgcgtacttagttaattacgtttagnggtaccgaacggtaccccggtaccccggttaagggaaacccggggggttccccgtttacccgaaacccgtttacgttttaaccccgaagggtaaacggttaactaaacggtttaaccgggaaaaccgtaaccgtaccggttacttaacgggttaactttcggttaacggaaccgttaaaaaggtcggggaaacgttacccggtacccggttaaggtaaacccgtaccggttaacggggaacccgtaacccggtaccccgggggtaccctttaacgttttaagtttaggttttacgggttaaacggttaaaccgggcgtacggttaaaccgggtaaggggtaacccggggttaccccggggggaaaccccggggttcccccttaaagggtttacccggaaccccggttaacgggggtcccgggggtaacccggaggggtacccccggttggtaccgggttaccccccg

SEQ ID NO: 53922 - DNA, 763 bp, Homo sapiens
  misc_feature: GYAE6OF01B6GBB.29.78.H01.1.454.CMB.1.raw
  modified_base (202)..(202): a, c, t, g, unknown or other
  misc_feature (202)..(202): n is a, c, g, or t
  modified_base (281)..(281): a, c, t, g, unknown or other
  misc_feature (281)..(281): n is a, c, g, or t
  modified_base (402)..(402): a, c, t, g, unknown or other
  misc_feature (402)..(402): n is a, c, g, or t
tcagatagagtactcacgaccggtgctcgatttagtgtgagtagtttgggtttgggggcgcctgggtacggccgggggggtcgctgagactctcctgtgcggcctctggatttaagtttttaggagtcatgccatgaactgggtccgccaggctccagggaaggggctggagtgggtctcggctattagtggcagtggtggngctatatattatgcagacgccctgaacgggccggttcacctatttccagagacaattacgaaagaacacgctgtatctnacaaagtggaagacgcctgacgactcgacgacgacggccgtactatttacttgttagttaaggacgagcgtagaagacgggaccgggccgtacgttgaccgacggtcgggcgacggggacncgtcgtccaccgtctcctcacgccctaccgaaccgaacgggccctacgtaccggttcccttccccccgtacgtaccccaacccttaccctacccgtaaacggacgaccccgtaccgtccgggttaacccgggggcaaccgtaacgggcccgaacgtccccgggtacggggtcccttaccggggtacccgttcggttaaccccggaagggtttaccccctttaaacccgtttacccccgttaaacgtttaaccctttacccgttaaccgtttaccggtaaccgggttaccggggcccggggttacggtttaccggggtaacccgaaacggggtacccgggtaccctaaaggtaccgcgtacg

SEQ ID NO: 53923 - DNA, 811 bp, Homo sapiens
  misc_feature: GYAE6OF01DJCL8.29.78.H01.1.454.CMB.1.raw
  modified_base (109)..(109): a, c, t, g, unknown or other
  misc_feature (109)..(109): n is a, c, g, or t
  modified_base (259)..(259): a, c, t, g, unknown or other
  misc_feature (259)..(259): n is a, c, g, or t
tcagatagagtactcacgaccggtgctcgatttagtgtgagtagtttgggtttggggtccgagccatggtgcagacctcccagagctctcctcctcctccactgcacgngggtctctcctcccagcctgtgctgactcgactccgcctctcgcctctcgccctccggtgggacggcgttacggtacgaacggtcaccttgtactcgtgagcgaggtaggacacgacgcacgcctaccgacctgtccgtcgttcgactanacgacgacgtacggaccgaccgacggtaaccggcccgggtccttttaacgttaacgtagagtaccggacctaacgtaactaaactaaggtcggacgtacggtactacgaccgaacggacgggaaccggggtaaagggggtacccggtaccttaacgtaccggtacggttccgttaccttctacccggtaccgttccaacctcgggttcctcgggtccggacgtgaccgtccgtactaccgaactacccgtacgttccccggtcccgtacccttacgtacggtcgtaggtaacggtacgtacggtacgttcgtactttaaccgttagtaccgtacggtaccgtacgggtacgtacgggtacttccgggtacgttacgttacgggttaccggttcgggttaacccggggtaacccgggaccggtaaccggtacgggttacccggtaccggttaccgggtaaccggtacccggaaccgtaccccggtaaaacccggccccctaaaccgtacccggttaccctaccggttcccgtttccccgtacgttccccccgg

SEQ ID NO: 53924 - DNA, 1136 bp, Homo sapiens
  misc_feature: GYAE6OF01BRP3W.29.78.H01.1.454.CMB.1.raw
  modified_base (145)..(145): a, c, t, g, unknown or other
  misc_feature (145)..(145): n is a, c, g, or t
tcagatagagtactcacgaccggtgctcgatttagtgtgagtagtttgggtttgggggcgcctgggtacggccgggggggtcgctgagactctcctgtgtcggcctctggattaagtttaggagtcatgccatgaactgggtccncgaggctccgagggaaggggctggtagtgggtctcggtacttaagttagtggacagtggtaggcgctatagtatagtgcgagaccgcccgtggaacggggtcccgggttcaccgatttcccgaagtacgactaaacgttcgaaaggtaaccacggtctaggttacttcgtacgactaaagtcggaggacgcgttagacgtacgtcggaaccgacgccggaccgtacgtaagtttcgttaggtacggttaaacgggccgtaaggtcgttagggaacggttacccgggggacccgggtacccgtaacgtttacggaacccgtaacggtcgggggtacccgaaacgggggggtacccgtacggtttaccgggtaaccgtaccccgggtttaccgtttaccccggtacccgggttaacccggtcccccggttaaaccccccgtaaaacccgggtaaccccgggggtaacccccgttaaaccgggttttacccccggggtttaaccccccgttttaaccccccccgggtttaaccgggggtaaaccccccccttaaaccccccgggtttacccccggttaaacccccggtaaaaacccggggttaccccgggtaacccccggtttaaaccccgggtttcccccgggggttaacccgggggggttaacccccaacccggggtaaaccccggggttaaccccgggaacccgggttaccccccgggggtttaaccgggggtaaccccggtttcccgggggttaaccccgggttaacggggttaaacccggttaaaccgggggttaaccccgtttaaccccggtttaaccccgggtaacccgttttaaacccggttcccggtttaaacccggttcccgggttaaaccgggggttaccccggggttacccgggggttaacccggtttaacccggggtaaaccgggtaacccggggtaacccgggtaaccccgtttaaagggtaaccgggtccgtaaaccgg

SEQ ID NO: 53925 - DNA, 801 bp, Homo sapiens
  misc_feature: GYAE6OF01EQMHC.29.78.H01.1.454.CMB.1.raw
  modified_base (107)..(107): a, c, t, g, unknown or other
  misc_feature (107)..(107): n is a, c, g, or t
  modified_base (196)..(196): a, c, t, g, unknown or other
  misc_feature (196)..(196): n is a, c, g, or t
  modified_base (798)..(798): a, c, t, g, unknown or other
  misc_feature (798)..(798): n is a, c, g, or t
tcagatagagtactcacgaccggtgctcgatttagtgtgagtagtttgggtttgggggcgcctgggtacgggccgggggggtcgctgagactctcctgtgcggcctntggtatttaagttttaggagtcatgccatgaacgtgggtccgccaggctccgaggggaaggggctggaggtggtcgtcggctattaggnggcgtaggtggtggcgtctatattattatgctagaccgcccgtaggaacgggtccgttacacctattaccaagtacgaactaagtacgaaagaacgacgtctagtactactagactaaagtcggaagacgaccgtagagacgtacgaacgaccgcggtccgtatttaagttacgttggttaaacggttaacggacggtagacgtagggaaacgtaccgggggacccgggtaccgtacgtacgaccgtaacggtcggggaaccggtaaggggcgtcgtacggtacacccggtctacccgtcgacgaccctaccgaccggaccggcctacggttccccgttacccgttccccggtacggtacccctaccccgtcccgttaacgaaaccgggtacccaaccgttacccggtacccgggtacggggacccaaccgtacgggacccgacccggtacccggttcggacccgttccggtaaccggttacggtaacccgaaacgggtttacccctttaaccggtccgtaaacgttccgtaccgttaggaccgttagggccgggtacgggttaccggagggtaaaccccgggaggacttaccggatacggntcg

SEQ ID NO: 53926 - DNA, 705 bp, Homo sapiens
  misc_feature: GYAE6OF01BVPTY.29.78.H01.1.454.CMB.1.raw
  modified_base (154)..(154): a, c, t, g, unknown or other
  misc_feature (154)..(154): n is a, c, g, or t
  modified_base (287)..(287): a, c, t, g, unknown or other
  misc_feature (287)..(287): n is a, c, g, or t
  modified_base (351)..(351): a, c, t, g, unknown or other
  misc_feature (351)..(351): n is a, c, g, or t
  modified_base (448)..(448): a, c, t, g, unknown or other
  misc_feature (448)..(448): n is a, c, g, or t
tcagatagagtactcacgaccggtgctcgatttagtgtgagtagtttggggtttggggggtcggcctgggtacgggaccgggggggtacgctgtagacctctcctgtcgcggcctctggattaagtttaggagtcatgccatgaactgggtccncaggtctccgaggggagggctggagtgggtctcggctattagtggcaggtgggtggcgctatatagttatgcgagaccgtccgtgggacgggtccgttcactacgttccgagtagactaagttcgaacgaacncgtctagtatctagaactaagtggtacgacgtcgtaggacgacgtcgacggacgccggaccgtnttacgttagttcggtaaggttaaacggcgtagtacgtaggaacggtaccggggaccggaccgtaatacggaccgtacggtcggggacacggggtacncggtcggacctcggtacctccgtacgacgtaccccgtacaaccggaacgggtacccacgttaccggttcccctacccgtcggtaccctaaccccgtctaccgaagggcctaccgtccggtacggtcggaccacgtacgaccgtacgtcccggtacggtctccgaccgtcgtacgaacggtactaccgtactaacgtcttatacgtcgtacgtcggtaccggtcgtacggaccggtacggcgtacgacgtcgcgtacg

SEQ ID NO: 53927 - DNA, 750 bp, Homo sapiens
  misc_feature: GYAE6OF01AM5Z6.29.78.H01.1.454.CMB.1.raw
  modified_base (187)..(187): a, c, t, g, unknown or other
  misc_feature (187)..(187): n is a, c, g, or t
  modified_base (205)..(205): a, c, t, g, unknown or other
  misc_feature (205)..(205): n is a, c, g, or t
  modified_base (513)..(513): a, c, t, g, unknown or other
  misc_feature (513)..(513): n is a, c, g, or t
tcagatagagtactcacgaccggtgctcgatttagtgtgagtagtttgggtttggggtccgagccatggtgcagactccccagagctctcctcctcctccactgcacagggtctctcctcccagcctgtgctgacttcaacgtccgcccttcgtcgcctctcggccctccggtggggagctcggtanaaggtcacctgtactcgngagctaggtcggaccacgagtccaagtccaacgccgatcgtcgttgactatcgagctaaggcgacgacgaccggaccggtccctcgttacgttagcgtacgacgtaacgtacaaacgtaagtcgtaacgtcggacgtaacgaccgtacggaacggacggggaaaccgggggaaccgttaccgtcccggtagtaccgttccgtacgtttcctacggtaaccttccgaccgtacgcgtcgttaacggcgttacggccgtaccttacgtaccctaccgtaaccgtaccgttccctacccgggccttaccgngtccgtaggacgtacgcggtaccgctttagtacccgtttagttctacgttcgaccggtacggtcggaacgtacgtcggtacgtcgttaacggtccggttacgggtaccgggaccggtaccgtacggtacccggttaccgggtaccgtaccggaccgggaccggtaccccggtaccggtaacccccaccggttacccgaacgtttccccgaaccgtttcccgttacccccggtacccg

SEQ ID NO: 53928 - DNA, 724 bp, Homo sapiens
  misc_feature: GYAE6OF01BAGAA.29.78.H01.1.454.CMB.1.raw
  modified_base (717)..(717): a, c, t, g, unknown or other
  misc_feature (717)..(717): n is a, c, g, or t
  modified_base (722)..(722): a, c, t, g, unknown or other
  misc_feature (722)..(722): n is a, c, g, or t
tcagatagagtactcacgaccggtgctcgatttagtgtgagtagtttgggtttggtggtctctctcccagcctgtgctgactcaatcgccctctgcctctgcctccctgggaggctcggtcaaggtcacctgtactctgagcagtggacacagcagctacgccatcgctgcatcagcagacggccagacgacgggcctcgttactgatgacagtacaacaatgatggcagtcacgaggacgaagggggaccggactcccgtagatccgtctttcctacgagttcctccgacggtccttaccggtcgggaccttggacgccgtacccttacctcaaccgtaactcccgtccccgggtacctccgacgtccgtaggacggtatcggaacggtcctaggtaacctttaagtttaccctagtacgaaccggtacccgggttgggggacctacggtacggtaccgtacgttaccggtacgggttcccggttaaccgggggaacccggggtaaccgtaacggttacccgaccggttcccggtaccggttaccgacccggtaccccgaaccggtacccctaaccccgtaccgttacgaccctaccgttacccgttacccgtttaccccctaccccgttaccctaccgtacgttcccttacctaacctcggtacgggacgtccgggtcgtaccgggaccgaaccgggtaccgtaacgtagtacgngtacncg

SEQ ID NO: 53929 - DNA, 792 bp, Homo sapiens
  misc_feature: GYAE6OF01BDKK0.29.78.H01.1.454.CMB.1.raw
tcagatagagtactcacgaccggtgctcgatttagtgtgagtagtttgggtttgggggcggcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcacctatttccagagacaattcggaaagaacacgctgtactctagactaaagtggaagacgtccgtagacgactccgaacgaaccgaccgggtccgtactactttacgtttaggttagggtttaaaacgggcgtaaggtaccgttaggggtaaacggtaaccggggggaccccggggaccccggtaaccggtttaccggaccccgtaacggtcggggggacccgtaacggggggacccgtcggtacgggttccgaacccggttccgttaccccgttaccgaccggtacccccttaccccggaaacccgtaaccggggtaccccctaacggtttcccgggttacccctttccccccgtcggtacccccgtacccccgttcccgtacccgaaacggaccgtacccgtacccgttcgggtccgggggtacaccgacgccgtacgtcccgtcgggtctccgtaccgtggttaacgaaggtacccttcgttaccgtacgtacccttacttacgtccgtaggacgggtccggcggtaggacgaacggcgagtaacgtgcgac

SEQ ID NO: 53930 - DNA, 835 bp, Homo sapiens
  misc_feature: GYAE6OF01BT362.29.78.H01.1.454.CMB.1.raw
  modified_base (253)..(253): a, c, t, g, unknown or other
  misc_feature (253)..(253): n is a, c, g, or t
tcagatagagtactcacgaccggtgctcgatttagtgtgagtagtttgggtttggggtctgagagaggagtccacccctgggatcttcaggttgttttcatttggtgatcaggacggaacagagagaactcaccatggagtttgggctgagctggtctttttcttgtggcttaattttaaaaggtgtccagtgtgacgtgctagttggtggagtcgtgggggcgtccgtggggtaccggggccgggggggtcncgtgacgacctctccgtggtcgccggccttcgtaggtaatttaaggttttaggatcgatcgcctagtacgaacgtcgggtcccgaccgagggcctaccggaagggggaaggggccgtgggaggttacgggttcgtcgggtacttagttggtgggtacaggttcgggtcggcgtacgttataattaagttaatcgaccgaggacccggtcccgtaggggaacggggtcccggtttaccacccgttagtttaccgaacgtaacgtaactaaacgttaccggaaagaacctacggtacttagtacttactacggtaactaaacggttgggaacgtacggtaacccgtggtaaaccgtaccggtaaccggaacccgggtaacccgtaacccggggttaccccgtttaacgttttaagtttaacggtttacgggtttaaacggttaaaacgggcggtaacggtacggttaacggggtaaaccggggtaccccgggggtaccccggggtacccgttaaccggtaccgtaacccggtaccgggtccgggggaacccggtaagggggcccttcgggtcccgggtaacccg

SEQ ID NO: 53931 - DNA, 790 bp, Homo sapiens
  misc_feature: GYAE6OF01EQ6GP.29.78.H01.1.454.CMB.1.raw
  modified_base (180)..(180): a, c, t, g, unknown or other
  misc_feature (180)..(180): n is a, c, g, or t
  modified_base (217)..(217): a, c, t, g, unknown or other
  misc_feature (217)..(217): n is a, c, g, or t
  modified_base (243)..(243): a, c, t, g, unknown or other
  misc_feature (243)..(243): n is a, c, g, or t
tcagatagagtactcacgaccggtgctcgatttagtgtgagtagtttgggttggggtctgagagaggagtccaccctgggatcttcaggtgtttcatttggtgatcaggacggaacagagagaactcaccatggacgtttgggctgaggctggtctttttctgtggctaattttaaaggntccagtgtgacgtgctagttggtggagtcgtggggcnccgtaggggtacgggccggggggtcnctgacgctctctgtgcggtctcgtaggtacttaagtttacggattcatcggcctatcgaacgtgggtccgcgaggcctaccggaaggggacggtcgtggtagtcgggtctcggcttagttagtgggactagggtcggtggtaccgtacgtataacgttagttacgtcggaaccgaacgtccgggtccctagggtaaccggggtaccccggtttaacaccccgtttacgtttaacccggaaggttacggaaccttaacgtttacccggaaacgtaaacgccgggtaaccttaggtacttccgtaagacgtaacggtagggtaaccgtgtaccgtaaggaacgtaccccgtacggacggtaacccgaccgggtcccgttaaccgttagtttaaccgggttgttaaacggggttaacggccgggttattccgggttaaggaacgggttaaccccggggtaaccggggccccttaaagttcccggaccccggttaacgggtaccggggacccgggtaaaaggggcccgttaaccgtgggttaaacccccgg

SEQ ID NO: 53932 - DNA, 758 bp, Homo sapiens
  misc_feature: GYAE6OF01APFXT.29.78.H01.1.454.CMB.1.raw
  modified_base (264)..(264): a, c, t, g, unknown or other
  misc_feature (264)..(264): n is a, c, g, or t
  modified_base (300)..(300): a, c, t, g, unknown or other
  misc_feature (300)..(300): n is a, c, g, or t
  modified_base (754)..(754): a, c, t, g, unknown or other
  misc_feature (754)..(754): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccgagggaaggggctggagtgggtctcggctattagtggcagtggtggcgctatatattatgcagacgccctggaagggtccggttcacctatttccagagacaattcgaanacacgctgtatctgacaaagtggagacgcctggaanactaccggacgacgacggccgtctattagtttgtagttaaaggcgaagcgtaggaacggtaccggggacccggggaccccgtacgtacgaccgacggtacgggggacccgacgggggaccgcgtcggtaccacccggttacccttcccgtccgaccgtccctacccgaaccgaaccggggccctacgttcccggttcccttccccccgttcggccccctaccccgttaccctaccgaaacgtccggtacctaacccgtcggtacggggtacccacgtacggacccgacccggtacccggtcgggtaccgtcgggaccccgttacgggtaccgaaccggttacccgtacccgtttaccgtaacgttacccttccgtaaacgtttccggttaggaaccggggtccggggaccgttaccgggaccgtaaaccggggtccgtaaccctaaggtaacgnggtc

SEQ ID NO: 53933 - DNA, 819 bp, Homo sapiens
  misc_feature: GYAE6OF01EDZ0C.29.78.H01.1.454.CMB.1.raw
tcagatagagtactcacgaccggtgctcgatttagtgtgagtagtttggggtttgggagagctctgtggagtctgcaccatggctcggaccccactcctcttcctcaccctcctcctccactgcacagggtctctcctcccagcctgtgctgactcaatccgccctctcgcctctcgccctccgtgggacggtctcggtacaacggtctaacctgtactctagagcgagtcggaacacagccacgcctacgcctagtcgtcgttcggacacgtacacggacgaacggacgaccgaacggaaccggaccgggtcccttacgttacgttagtaacgtacgaacgtaacgttaaccaaacgtaacgtacgacggtacggacgtacgtaacgaacgacgggaacgggaacgggggaaccggtacgtacccgtaggtacgtccgttacgtttacgtaccgtaacgttcctaccgtacgacggttccggtaccgggtaccgttacggaaccgccgttaacccttacccgtaaccgaaacccgttacgttaccccggcccggttacctaacccggttcgttacgtaagggaccgtacgttacgggaaccgttaccgttaagttaacccgtttaaccgttacgtaccggtaaccgtacgggtttaccggacgggacgttccgtaacgggttacttacggttacgggtaacccggtttacccggggtacccggggaaccggttaaccggttaaccggggttaccctacggggttcccgtaacggacccggtaacccggacccccggtaaaacgccccctaaacccggg

SEQ ID NO: 53934 - DNA, 644 bp, Homo sapiens
  misc_feature: GYAE6OF01E3JS5.29.78.H01.1.454.CMB.1.raw
  modified_base (641)..(641): a, c, t, g, unknown or other
  misc_feature (641)..(641): n is a, c, g, or t
  modified_base (644)..(644): a, c, t, g, unknown or other
  misc_feature (644)..(644): n is a, c, g, or t
tcagatagagtactcacgaccggtgctcgatttagtgtgagtagtttgggtttggtggtctctctcccagcctgtgctgactcaatcgccctctgcctctcgccctccctggggaggctcggtcaaggtcacctgtactctgagcagtggacacagcagctacgccatcgcttggcatcagcaggacgccagacgacgggtcccttcgttacttgatgacagtacaaacatgatggacacgtacacgaggacggaaacgggggacggtactcccgtagactccgtccttcgtacgacgttcctaccgacgtccgtcgtcgggtcctaggacgccgtacctaacctacgaactaactcccgtccggccctacgtacgtcgaggacggtagtacggacgtacgtacgtaacgtttacgttacgtcgtacgaacgggtccggtacgggtacctacggttcgaccttagttaccggtacgggttccggttaaccggggaacccgggtacgtaacgtccgtaccgtcggttcgacgaccgacccgaacgccaccctgtccgactaccgtctccgtcccctacctcctacgtacgttctacgtactcgtaacggtcggccggtgacgaccgagggtccagaagtcgntgn

SEQ ID NO: 53935 - DNA, 822 bp, Homo sapiens
  misc_feature: GYAE6OF01ESXPV.29.78.H01.1.454.CMB.1.raw
tcagatagagtactcacgaccggtgctcgatttagtgtgagtagtttgggttgggggcgcctgggtacggccggggggtcgctgagactctcctgtgcggcctctggattaagtttaggagtcatgccatgaactgggtccgcaggctccagggaagggctggagtgggtctcggctagttagtggcaggtggtggcgctatatattatgcagaccgcccgtaggaacgggtccggttcacctactttccagagaactaattacgaaagaacacgctgtatcgtagacaaagtggagacgccgtagacgtactaccgaccgaacgtaccgggtccgtacttaagtttagtttggttaaggtttaaaacggccggtagcggttaagggaaacggtaccggggaccccgggaccccgtacgttaccgaaccgtaacggtccgggggacccgaggggggaccgtacggttaccggtcccgtaacccgtcccgttacccgtacgtaaccccggtccccgtaacccccgaaaccccgggaaccggggtaccccctaaccggtttccccgggttcccccgtttccccccggtcccgggtaccccctaacccccgttaaccccgtacccgtaaaccggacccgtacccgtaaccccggttccgggacggggacccgacgaacggccgaccggtcccggtcgggccgtcggtacccgtcggttaaccgaaccggttaaccgttaccttccgtaacgttacccttacttaacgtcggtaaggtccggggtcggacccggttggaccggtaacggcgtaacgacgtagcgcg

SEQ ID NO: 53936 - DNA, 834 bp, Homo sapiens
  misc_feature: GYAE6OF01DARPD.29.78.H01.1.454.CMB.1.raw
  modified_base (262)..(262): a, c, t, g, unknown or other
  misc_feature (262)..(262): n is a, c, g, or t
  modified_base (273)..(273): a, c, t, g, unknown or other
  misc_feature (273)..(273): n is a, c, g, or t
  modified_base (277)..(277): a, c, t, g, unknown or other
  misc_feature (277)..(277): n is a, c, g, or t
  modified_base (826)..(826): a, c, t, g, unknown or other
  misc_feature (826)..(826): n is a, c, g, or t
  modified_base (832)..(832): a, c, t, g, unknown or other
  misc_feature (832)..(832): n is a, c, g, or t
tcagatagagtactcacgaccggtgctcgatttagtgtgagtagtttgggtttgggggcgcctgggtacggccgggggggtcgctgagactctcctgtgcggcctctggatttaagttttaggagtcatgccatgaacgtggggtccgccgaggctcccgagggaagggcgtggaggtgggtctcggctattagtggctaggtggtgcgctatatattatgcagtaccgccgtaggaggccggttccacctatttaccaganacaattcgaanaacncgctgtctactgacaaagtggaagacgccgtagataccgtaccggaaccgaccgtaccggtacccgtacctttaattacgttttggttaagggttaaaacgggcgtagtcgggtaaggtaaacggtacccggggggcccccggggtacccgtacggtttcgaacccgtaccggtaccggggggcccgaagggggtccggaccgtcgggttcccaccggtttccctcccgtacgaaccgtcccgtacccaaccggaacccggtacccaccggttcccggtttacccccttcccccggttccgaccccccttaaccccgtccccttaaccgaacgacccgtaccgaacccggttccgggttaccggggacccgtaccgacggttacccgaccggtccccgtcggggtacccgttcgggttccgtaccgggttaacccggtaaacgggttaccctttccgttaaccgttaaccggtacccttccttaacggttccgtacgggaccgggtaccgggttcccgaagggtaccggtaccggtaccgaagttacgnggtacncg

SEQ ID NO: 53937 - DNA, 802 bp, Homo sapiens
  misc_feature: GYAE6OF01CAHRZ.29.78.H01.1.454.CMB.1.raw
  modified_base (797)..(797): a, c, t, g, unknown or other
  misc_feature (797)..(797): n is a, c, g, or t
tcagatagagtactcacgaccggtgctcgatttagtgtgagtagtttgggtttgggggcgcctggggtacggccgggggggtcgctgagactctcctgtgcggcctctggatttaagttttaggagtcatgccatgaactgggtccgccgaggctccgaggggaaggggctggagtgggtctcggctagttagtggcaggtgggtggcgctatatattatgcagaccgccctaggaacggggtccggttacacctatttacccgaagagaactaattacgaaagaacacgctagtatctgactaaagtggaagagcctagacgtactaccgaccgaccgaccggtaccgttacttaatttagttggttaaggttaaacggcggacgtggtaggtaaacggtaccgggggaccccgggcccgtacgttacggaaccgtacggtcggggacgacggggacgtcgtcggtccgaccgtcctccgtcgaccgtcccacccgaaccggaccggacccctacgttacccggtttccccttaccccccgtccggtacccctacccccgttcccgtacccgaaccggtaccgtcccgtacccggttccgggtacgggggacccaaccggacggaccgacccggtcccgggtaccgggtcccgtaccgggtcccggttacggtaaccgtaaccggtacccttaacccgttacccggtaacttacccgttacgttaccgttaccggttacgggaacggggtcccggtacgggtaccgggaccggtaacgggtaccggaagtacgtgngtacg

SEQ ID NO: 53938 - DNA, 682 bp, Homo sapiens
  misc_feature: GYAE6OF01CAX4Z.29.78.H01.1.454.CMB.1.raw
  modified_base (265)..(265): a, c, t, g, unknown or other
  misc_feature (265)..(265): n is a, c, g, or t
  modified_base (509)..(509): a, c, t, g, unknown or other
  misc_feature (509)..(509): n is a, c, g, or t
  modified_base (680)..(681): a, c, t, g, unknown or other
  misc_feature (680)..(681): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactggggtccgccaggctccgagggaaggggctggagtgggtctcggctattagtggcagtggtggcgctatatattatgtagacgccctggaacgggccgttcacctatttccagagactaattcgaanaacacgctgtatctgacaatggagacgccgtgacgacgtaccgaccgaaccgaccgggcccgttacgtaatttagtttgttaggttaaaggcggagcgtaggaacgtaccgggggaccccgggcccgtacgttacggaccgaccgtcggggaccggacgggggaccgcggttcgggccgtacccgtctccctcgcgtcccctacccgaaccgacgggcccacgttcccgttccccgttcccccncggtaccccacccccttcccaccgaaggaccaccgtacccgtcggcggggacctacgacgcaccggtcccgtgggtctcgccgtcggacctaacgtacccttaccttccgacgttcctacgttacgtacgtcgggacggcgggtctacgggacggacggtcacgtatgcgnng

SEQ ID NO: 53939 - DNA, 724 bp, Homo sapiens
  misc_feature: GYAE6OF01DW2P6.29.78.H01.1.454.CMB.1.raw
  modified_base (205)..(205): a, c, t, g, unknown or other
  misc_feature (205)..(205): n is a, c, g, or t
  modified_base (481)..(481): a, c, t, g, unknown or other
  misc_feature (481)..(481): n is a, c, g, or t
  modified_base (719)..(720): a, c, t, g, unknown or other
  misc_feature (719)..(720): n is a, c, g, or t
tcagatagagtactcacgaccggtgctcgatttagtgtgagtagtttgggtttgggggcgcctgggtacggccgggggggtcgctgagactctcctgtgcggcctctggatttaagttttaggagtcatgccatgaactgggtccgccaggctccgagggaaggggctggagtgggtctcggcttattagtggcagtggtggcgntatattattatgcagccgccctaggaacgggtccgttcacctattccagagacaattacgaagaacacgctgtatctgacaaagtggagacgcctagacgaccgtacgaacgaccgaccgggtccgttacttaagttttagtttacggttaggttaaaacgggccggtaagtccggtaaagggtaaacggtaccgggggaccccgggtaacccgtacgttacgaaccgtacggtcgggggacgaacgggggacgtcgtcggtcctaccgtcctccncgtacgccctaccgaaccgaccgggaccctacgtcccgttcccgttcccccgtacgtcccctacccctacctaccgaacgtaccgccgtaccgtccggtccggggacctacgacgccgccgaccgtcggccgtacggtccgtacggtacgtaacgtaccttaccgttaccgtaacgttccttccgttacggtcgtaccggggcggggtcgtaacgggagtaccgggacgagtagacgnngacg

SEQ ID NO: 53940 - DNA, 828 bp, Homo sapiens
  misc_feature: GYAE6OF01CGZD9.29.78.H01.1.454.CMB.1.raw
tcagatagagtactcacgaccggtgctcgatttagtgtgagtagtttgggtttgggtctgagagaggagtccacccctgggatcttcaggtgttttcatttggtgatcgaggacggaacagagagaactcaccatggaggtttgggctgagcgtggtctttttcgttggtggcttaagttttaaaaggtgtaccagtgtgacgtgcgtagttggtgaggtcgtggggcgccgtggggtaccgggccgggggtcgcgtggaagtcctcgttccgtggtcgccggtccttgtaggttagttttaaggtttaggagtcatcgacaagtacgtaacgttcggttccgccgaggtccgtaccggaaggggtaacgggcgtgggtcggttcggtcgtcggtactttaacggttggaggtcgtaggttggcgggtaccctatttaagttaaacgtagtttacgtcgaaccgaacggtccccgtaccgtaaggtaacccgggtcccgtactaaacgttacgtttaccgaagaaccgtaacgtaaccgtaacgtaaacgaaaccgtcgtaacgttacgttaacgttaccgttacgaaacgtaaacggttacgggaaacggtaccgaaccggttacgaaccgtaccgttaaccggaaccgtaacccggtcccgttaacgttactttaaacggtttagtttcggtaaacggttaaagggaccgtagtacggttaaaccgggaaaccgggttacccgggggaacccgtacccggttaccgtaaccggtacccgtacgggttacgggacccgggaagggtccgtacggttccggtaccccg

SEQ ID NO: 53941 - DNA, 1056 bp, Homo sapiens
  misc_feature: GYAE6OF01BID0S.29.78.H01.1.454.CMB.1.raw
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggcctccgaggggaaggggctggagtgggtctcggctattagtggcagtggtggcgctatattattatgcagaccgcccgtaggaaacgggtcccggttccgaacctacgttttccaaggtaacgaacctaaagttacggaaaacggaaacaaccggtctagttacttctacgaactaaaagtgggagaacgtccgtagaacgtacctacggaaccgacgtaacccggcccgtttattaagttacgtttagttaaaggtttaaacgggcgtaaggtacgtaagggtaaaacggttaacccggggggaccccggggaccccgttaacggttaccgaaccccggtaacggtcggggggaaccggaacggggggtcgtaccgtttcggggaacctaccccggttccttaccccggtacgaaaccgtacccccgttacccccgaaaacccgggtaaacccggggtacccccctaaggggtttccccccgggtttcccctttaccccccccgggtggtaaacccccccgttccccccgttaaccccttaacccggaaaacggttaccccggaccccgtttaaacccgggtccccggggttacgggggaacccgtaaacggtaccccggaccgaaccccgggggttcccccggttacggggtaccggttaccccggtacccgggttttaaccgggggtaaacccgtaaaaccgggttttaacccccggttaaaacccctttttaacccggaaaacccggttttttaaccccgtacccggggtttttaaaacccttacccggggttaaaggggggccccggggggtaacccgggttaaaccccggtcggggtttaaaaccccggggggaaacgggtcccgggttaaaccctaaaacgggggaaccgttgggaaac

SEQ ID NO: 53942 - DNA, 878 bp, Homo sapiens
  misc_feature: GYAE6OF01E1YYA.29.78.H01.1.454.CMB.1.raw
tcagatagagtactcacgaccggtgctcgatttagtgtgagtagtttgggtttggggtctgagagaggagtcccacccctgggatcttacaggtgttttcgatttggtgatcaggacggacagagagaactcaccatggtagtttgggctggagctggtctttttcttgtggctattttaaaggtgtccagtgtgacgtgcgtaggttggtggagtcggtgggggagtcggtagggtaaccgaggtcccggtggggggtccctgggtacgtaccgttcctccgtggtcgacgcgtcccttgtggtactttaccgtaagttttaactgttactttttaccgagttaccgacgttcgggtacccgtacgtaacggtccggtaccggggggaaggtccggttacgggaaggttcggggttccttaccgttacgtttaagtttaacgtacgggaaggtaccgggttctaccttaaccgtacgtatttacgtaacgtcgtaccctaacgtacttacgttaggggtaaccgggaacggggtcccgtagtttacccgacccgtaactttacccgtaaccgacggaaacgtaaaccaaaccgtaaacctaaaccgttaacccttaccccgtaattaccgtacttacgaaacttaaacgttgaaaccgttacggtcttaacgggagtaacgggtacgaaccggtaacggtacggtacccggtttacctttagttttaagttttagttacggtaagtaaacggaaaaacgggtaacggaagggtacgtaaagggttaaccgttaacggttacggggttacgggtaaccggttttaggttttacccggaaggtttaccggggtacccggggtacccggtaaacccgggg

SEQ ID NO: 53943 - DNA, 710 bp, Homo sapiens
  misc_feature: GYAE6OF01A9HLL.29.78.H01.1.454.CMB.1.raw
  modified_base (267)..(267): a, c, t, g, unknown or other
  misc_feature (267)..(267): n is a, c, g, or t
tcagatagagtactcacgaccggtgctcgatttagtgtgagtagtttgggtttggtggtctctctcccagcctgtgctgactcaatcgccctctgcctctgcctccctgggagctcggtcaaggtcacctgtactctgagcagtggacacagcagctacgccatcgcttggcatcagcagacggccagacacgggccctcgttacttgatgacagtcaacaatgatggcagtcacaggcgaagggggcggatccctgactcgcttcncagtctccagcctcgtcgggacctggacgccgtactacccgtcaacctaacgttcccgtcccgggccctaccgtaggtccgtaggaacgtacgttggaacgggtcttacgtaacttaacgtttacctcgggtaacgaccggtaccggttggggcctacgtcggactacgttacgtacgggttccgttaccggggaacccggggtaaccgtaaccgggttccgtacccggttccggtacccggtaccgtaccggaaccccgaaccggtaccccaaccccgtaccgtaccgtacccgtaccgttcccgttacccgttcccccggtaccccttacccgtacgttaaccggttaccttaccgttacgttacccggttcgggtacccgggtccgggtccggtaccgggaacccggtaacgggtacccgtacgacggttagccgtagcg

SEQ ID NO: 53944 - DNA, 780 bp, Homo sapiens
  misc_feature: GYAE6OF01EUSFM.29.78.H01.1.454.CMB.1.raw
  modified_base (236)..(236): a, c, t, g, unknown or other
  misc_feature (236)..(236): n is a, c, g, or t
tcagatagagtactcacgaccggtgctcgatttagtgtgagtagtttgggtttggggtccgagccatggtgcagactccccagagctctcctcctcctccactgcacagggtctctctcccagcctgtgctgactcaaatcgccctctgcctctcgccctcccgtggggaggctacggtcaaaggtccacctgtactctgagcagtgacacaagcaggctacgccatcgcttgcancagcaggacgccagacgccggcctacgttacttgatgaacagtacaaacgtaatgagtggcgtaagtcaacgacggacggtaaagggggacggtacttcccgttaggactcggtacctttacctacgtacgttacccgtccgaaaccgtcctcggttacggggtacccttagggaccgtacccgtacccttaacccgtaccgaaaccttaacgtccccggttacccggtaccccttccgtaacgttccggttaaggtaaggaacgttagggtaaccgggtacttaggtaaaccgtttaactttaaccgtggttaaccgaccggttaaccgggtcggggtaaccctacgttacgggtacttaacgtttaccggttaacgggttacccggtttaaccggggaaccccggggtaaaccgtaaccggtttacccgtaaacccggtttcgggttaccggtacccgaaaccggtaccccggaaacccggacccccgaaacccccttacgttaccgtaacccgtacgtttcccgtacccgtttaccccccg

SEQ ID NO: 53945 - DNA, 658 bp, Homo sapiens
  misc_feature: GYAE6OF01BFIUE.29.78.H01.1.454.CMB.1.raw
  modified_base (651)..(651): a, c, t, g, unknown or other
  misc_feature (651)..(651): n is a, c, g, or t
  modified_base (656)..(656): a, c, t, g, unknown or other
  misc_feature (656)..(656): n is a, c, g, or t
tcagatagagtactcacgaccggtgctcgatttagtgtgagtagtttgggtttgggggcgcctgggtacggccggggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctggaacgggccggttcaccatttccagacgacaattacgaagaacacgctgtatctgacaaatggagagcctgagactcgacgacaccggcgtctattattggtagttaaaggcgagcgtaggaacgtaccggggacccgggccgacttacgaccgacggtcggggaccgaggggaccgcgtcgggtcctacccggttctcccgtcacgtccctacccgaaccggaccgggacccacgttcccgtcccttcccccgtggtcccctaccctcctaccgaacgaccgacccgtaccgtcgggtccggggaccaacggtacccgaccgccggtcccggtcgggtccggtccgtccgtacggttaccgaacgggtacccttacctccgtacttacctctacttcgaggcggcggccgtaggacgacggcganagtgncg

SEQ ID NO: 53946 - DNA, 765 bp, Homo sapiens
  misc_feature: GYAE6OF01C53HI.29.78.H01.1.454.CMB.1.raw
  modified_base (687)..(687): a, c, t, g, unknown or other
  misc_feature (687)..(687): n is a, c, g, or t
tcagatagagtactcacgaccggtgctcgatttagtgtgagtagtttgggtttggggcagggtgtacacctgtggttctcggggctgccctttggctttggagattggttttctcgagtgggggcgtgggagggcttttgttggagaccttgcacttgtactccttgccattcagccagtcctggtgcaggacggtgaggacgctgaccacgacggtacgtgctgttgtactgtcctcccgtcccgcggtctttgtcgttaggctattagtcgcctacctcccgacgtcccgtacccaccgtacagttacgtaacgttcgacctcgtacgggttccgtttcggtcggtcctaccgtaccgtacccaacccaccgaccgcacgttcggtaccgaccgttcggacggggtaccggagtacgtacgaggtggtacggggtttcggtttccggggtttggggggttttaggggggaaagggtaacgggtaacggtaccgggtaccgggtaaccccggtacccccggtaggttaccggttacggtaggggtcggcggttcggggacggtacggggtcgggacgtagtggttaggttcgttaggtttcgtacgtaacgtaggttacgtttcggtacttacgttacttttccgttacgttcccgttacgtttggtcgtttcgtcgttcgggttntggttacgtacttcgttaggtcgtacgtaggtgttcgggttagtcggttaggtacccgaccgtagtcgttggtacggg

SEQ ID NO: 53947 - DNA, 739 bp, Homo sapiens
  misc_feature: GYAE6OF01B93O2.29.78.H01.1.454.CMB.1.raw
  modified_base (160)..(160): a, c, t, g, unknown or other
  misc_feature (160)..(160): n is a, c, g, or t
  modified_base (205)..(205): a, c, t, g, unknown or other
  misc_feature (205)..(205): n is a, c, g, or t
  modified_base (283)..(283): a, c, t, g, unknown or other
  misc_feature (283)..(283): n is a, c, g, or t
  modified_base (547)..(547): a, c, t, g, unknown or other
  misc_feature (547)..(547): n is a, c, g, or t
  modified_base (707)..(707): a, c, t, g, unknown or other
  misc_feature (707)..(707): n is a, c, g, or t
  modified_base (731)..(731): a, c, t, g, unknown or other
  misc_feature (731)..(731): n is a, c, g, or t
  modified_base (736)..(736): a, c, t, g, unknown or other
  misc_feature (736)..(736): n is a, c, g, or t
tcagatagagtactcacgaccggtgctcgatttagtgtgagtagtttggggtttgggggcgcctggggtacgggccggggggggtcgctgagactctcctgtgcggcctctggatttaaggttttaggagtcatgccatgaactggggtccgccgaggcnccgaaggggaaggggctgggaggtgggtctcggctaagtttaggngggctagtgggtggcgctataatattagcgcaggaccgccgtagggaacgggtccggttacaacctatttaccgaganaacaagttacgaaagaacacggctgatctgaacaagtggaacaggcctagactacgacgacgacgaaccgggtcctattaagttagttagttaagggtaaacggcggaagtacgtaagggtaaaacgcccggggggaacccggggaccacggttaccggaccgacggtggggacccggagggggaccgtcggtgggacctaaccggtctaccctgaacccgcctaccgaacggaaccgtcccgagttcccgtccttacccccgnggacccctaccctaccgtaccgaacgacaccggtaccgtcggacgggacgaacgtagccgacgcccggtacggccgtaccggtccgttaccggacgaaccggtacttacccgttacggtaacctaccgttactacgtcgaacggtgggcccggttacggnggaaccggtacggacggtaacgtnacggngac

SEQ ID NO: 53948 - DNA, 695 bp, Homo sapiens
  misc_feature: GYAE6OF01A7SF4.29.78.H01.1.454.CMB.1.raw
  modified_base (256)..(256): a, c, t, g, unknown or other
  misc_feature (256)..(256): n is a, c, g, or t
  modified_base (692)..(692): a, c, t, g, unknown or other
  misc_feature (692)..(692): n is a, c, g, or t
tcagatagagtactcacgaccggtgctcgatttagtgtgagtagtttgggtttgggggcgcctgggtacggccgggggggtcgctgagactctcctgtgcggcctctggatttaagttttaggagtcatgccatgaactgggtccgccaggctccgaggggaagggctggagtgggtctcggctattagtggcaggtggtggcgctatatattatgcagaccgccctggaacgggccgttcacctatttccaaganaacaattcgaaacaacacgtctagtatctagactaaagtggagacgcctagagtactcgacgaaccacggccgtactaattagttgtaggttaaaggcgagtcgtaggaacgtaccgggggacccgggcccgtacgtcgaccgacggtcggggaccgagggggactcgtcggcctaccggtctcctcgactccctaccgaaccggaacggccctacgtccggttccccttccccgtagcccctaccctcctaccgaacgcgcccgtaccgtcgggtcggggacctacgcgaccgaccggtcccgtggtaccgccgtccggtacggtaacgtaaccggtaccttaccgtccgtaacgttcccgtttactaacgttccggtacgggaacgggtcgggtacgtaccggggtaccgaaagggtccccgagtagtaaccgngag

SEQ ID NO: 53949 - DNA, 794 bp, Homo sapiens
  misc_feature: GYAE6OF01D82OJ.29.78.H01.1.454.CMB.1.raw
  modified_base (150)..(150): a, c, t, g, unknown or other
  misc_feature (150)..(150): n is a, c, g, or t
  modified_base (258)..(258): a, c, t, g, unknown or other
  misc_feature (258)..(258): n is a, c, g, or t
  modified_base (538)..(538): a, c, t, g, unknown or other
  misc_feature (538)..(538): n is a, c, g, or t
  modified_base (550)..(550): a, c, t, g, unknown or other
  misc_feature (550)..(550): n is a, c, g, or t
tcagatagagtactcacgaccggtgctcgatttagtgtgagtagtttgggggtttggggagagctcgtggggagtctgcaccatggctccggaccccactcctcttccctcaccctcctcctccactcgacacgagggtctcctctcccngtcctgtcgctgactcactccgtcctctcgcctcgtccgtcccgtccggtggggacggtccgttcggtacgtaacggttcctaccgttcggtaccgtcggtcgaacgnggtacggtacggaaccaacgtacgcctacgaccgtaccgcctacggtccgttacgtcggacctacacggaacgacggacgggaccggaccgtaacggaccgggtaccccgggttcctttacggttacgtagtacgacgaacgtacggtaacaaacgtagcggtagtcgtaccagtacgacgggaaggaacgggggtaacggggacgtccgtacggtagtacgtcctacgttacctcgaccgttcgcgtacgtccggttacgccggtcgacgtaccgtccnccctaaccgacnccgttcgttacccgcctaccgtacggtcgttacgggagtacggacgtggtacctacttacgttataccggtccacgggtacttaccgggcgggtcgttccacgggttacgtccgttaaccgggttcgggtacggttaacccgggggttacggacccggggtaacgtacgggttcccggtaccgggtaacccggtaccgggacccgtaacccggaccctaccccggttacccaacccgtttccgg

SEQ ID NO: 53950 - DNA, 758 bp, Homo sapiens
  misc_feature: GYAE6OF01C7FON.29.78.H01.1.454.CMB.1.raw
tcagatagagtactcacgaccggtgctcgatttagtgtgagtagtttggggtttgggggcgcctgggtacggccgggggggtcgctgagactctcctgtgcggcctctggatttaagttttaggagtcatgccattgaactgggtccgccaggctccgagggaaggggctggagtgggtctcggctattagtggcagtggtggcgctatatattatgcagaccgccctggaacgggtccggttcacctatttaccgagaacgaactaattacgaaagaacacgctagtatctgacaaagtggaagacgctaggacgactacgaccgaccacggtccgtacttaattacgtttaggtaggttaaacggcggaggtcgtaaggaacggtaccggggacccggggaccgtacgttcggacctacggtcggggccgaaggggaccgtcggtggtacccgaccgtctcctcgaccgtccgtaccgaaccgtacgggtccctacggttcccggttaccccgttcccccgcgggtacccctaccccgttacctaaccgaacggtccgacccgtcccgtacgggtcggggaccaacgtcgtacccgacggtccccggtagggtcccgtcggtaccgtacggggttactaaccggttacccttaaccgtttccgtaaacggtacccttaacggttaccgttaccggtaggacgggtcccggggtccgacgggtaccggtaacgggaccccgtagaacggtcgctacg

SEQ ID NO: 53951 - DNA, 741 bp, Homo sapiens
  misc_feature: GYAE6OF01CZNWN.29.78.H01.1.454.CMB.1.raw
  modified_base (144)..(144): a, c, t, g, unknown or other
  misc_feature (144)..(144): n is a, c, g, or t
  modified_base (391)..(391): a, c, t, g, unknown or other
  misc_feature (391)..(391): n is a, c, g, or t
tcagatagagtactcacgaccggtgctcgatttagtgtgagtagtttgggtttgggggcgcctgggtacggccgggggggtcgctgagactctcctgtgcggctctggattaagttttaggagtcatgccatgaactgggtccnccaggctccgagggaagggctggagtgggtctcggctattagtggcagtggtggcgctaatactattatgcagacgcctagaacgggccggttcacctatttaccagacgtacaaacttcggaaagaacacgctgtatctgacaaagtggagagcctgacgactcgaacgtacgacggccgtctattattgtaagttaaggcgaagcgtaggaaagtaccgggaccggggccccgattcggaaccgngtacgggggaccgaacggggggacaccgtaggtccacccgtcgttacccacgaacggtcccctaccgaacccggaacgggacccctacggttacccggtttacccgtccccccgttacggaccccgttacccccgtacccgttaacccgaaagaacccgaccgtaaccccgttccggtacgggggacccaaaccgacgacccgttacgccccggtcgggaccgtcgggaccccggttggttaacccgaagggttacccttaacgttaccgtaaccgttaacgtacccttaacggtcctaaggcggtaccgggccggttacgacggtaacgggactaccggaatagcggta

SEQ ID NO: 53952 - DNA, 710 bp, Homo sapiens
  misc_feature: GYAE6OF01CJD6S.29.78.H01.1.454.CMB.1.raw
  modified_base (148)..(148): a, c, t, g, unknown or other
  misc_feature (148)..(148): n is a, c, g, or t
  modified_base (374)..(374): a, c, t, g, unknown or other
  misc_feature (374)..(374): n is a, c, g, or t
  modified_base (670)..(670): a, c, t, g, unknown or other
  misc_feature (670)..(670): n is a, c, g, or t
  modified_base (684)..(684): a, c, t, g, unknown or other
  misc_feature (684)..(684): n is a, c, g, or t
  modified_base (707)..(707): a, c, t, g, unknown or other
  misc_feature (707)..(707): n is a, c, g, or t
tcagatagagtactcacgaccggtgctcgatttagtgtgagtagtttgggtttgggggcgcctgggtacggccgggggggtcgctgagactcctcctgtgcggcctcgtggatttaagttttaggagtcatgccatgaactgggtccncaggctccgagggaagggctggagttgggtctcggcttattaggtggcagtggtggcgtctatactattatcgacagaccgcccgtggaacgggtcccgttcacctactttccgaagtaagacctaagttccgaaagaaccacgcttagtatctaggactaaagtggacgacgtaccgtagacgtactcggaccacgacggtctactattcgtagtagtaaacggngacgcgtaggaacggtccgggggaccggacccgtacttgacccgacggtcggggaccgaggggaccgtgttcggcctaaccggtcctccgtacgaccgtacccctaccaaccggtaaccggcccgtacgttcccgttacccgtcccccgtggaccccctaccgtccctaacgacgtaccacccgtaccgtacgggtcggcctaaacggcgtaccgaccggtccgggtacggtccggtaccgtcccggtaggtaccgaaacgttccgtaaccgtcctaagtccctacgtcgttcggngtacggcggtacgngtacccgtggccctagcgtcgtnacg

SEQ ID NO: 53953 - DNA, 717 bp, Homo sapiens
  misc_feature: GYAE6OF01EMUKQ.29.78.H01.1.454.CMB.1.raw
  modified_base (428)..(428): a, c, t, g, unknown or other
  misc_feature (428)..(428): n is a, c, g, or t
  modified_base (451)..(451): a, c, t, g, unknown or other
  misc_feature (451)..(451): n is a, c, g, or t
  modified_base (709)..(709): a, c, t, g, unknown or other
  misc_feature (709)..(709): n is a, c, g, or t
  modified_base (715)..(715): a, c, t, g, unknown or other
  misc_feature (715)..(715): n is a, c, g, or t
  modified_base (717)..(717): a, c, t, g, unknown or other
  misc_feature (717)..(717): n is a, c, g, or t
tcagatagagtactcacgaccggtgctcgatttagtgtgagtagtttgggtttgggggcgcctggggtacggccgggggggtcgctgagactctcctgtgcggcctctggatttaagttttaggagtcatgccatgaactgggtccgccaggctccaggggaaggggctggagtgggtctcggctattagtggcagtggtggcgctatatattatgcagaccgccctggaacgggccgttcaccatttccagagacaattcgaagaacacgctagtatctagacaaagtggagacgcctaggagactacgacgaccgaccggtccgtacttattagttcggtaggttaaacggcgaggtcgtagggaaacgtaccggggaccccggggcccgtacgttacgaccgtacggtcggggaccgaggggacncgtggtaccgaccgtctcctacnccgccctaccaaccgaacgggaccctacgtcccggttcccttacccccgtcggtacccctacccccgtacccgtaccgaaacgtaccgtacccgtaaccgtacccgggtacgggggaccctaacggaccgccgaaccggtccccgggtcgggtacccgtcgggtacccgttacggtaccgtaaccggtaccttacccgttaccgtaacgttaccgtacttacgttcgaggtacggcgggccgtggacgaacggcgtanacgtgngn

SEQ ID NO: 53954 - DNA, 772 bp, Homo sapiens
  misc_feature: GYAE6OF01BNUOW.29.78.H01.1.454.CMB.1.raw
  modified_base (222)..(222): a, c, t, g, unknown or other
  misc_feature (222)..(222): n is a, c, g, or t
  modified_base (282)..(282): a, c, t, g, unknown or other
  misc_feature (282)..(282): n is a, c, g, or t
  modified_base (341)..(341): a, c, t, g, unknown or other
  misc_feature (341)..(341): n is a, c, g, or t
  modified_base (724)..(724): a, c, t, g, unknown or other
  misc_feature (724)..(724): n is a, c, g, or t
tcagatagagtactcacgaccggtgctcgatttagtgtgagtagtttgggtttggggtccgagccatggtgcagactcccagagctctcctcctcctccactgcacagggtctctctcccagcctgtgctgactcaatcgccctctgcctctgccttccgtggggagctcggtacaaggtcacctgtactctgacgcagtgacacagcagctacgccatcgnttggctatcagcagacgccagacaccggtcctagttactgatgacagtacaatagtgagnggctagtcaacggacgtaggaacgggggacggtactcccgtaggactacgtccgtttcncacgtacctcgagtccgtcgtacggggtcctagggacggtacctaccctaaaccgtaccaacttaaccgtcccgggttcccgacccgttaccgtttaacgggcctaagggtaacgggtaactagggaacggggttcccttaaacggttaaccttaaaccgtttttaaccggcggtaacccggtaaaccggttaccccgggttaggggaccccgtaaaggtccgggttaaccgttaccgtttaccggggtaacggttttcccgggttaacggggggacccccgggtaaattacccggggttccggttaaccgggtacccggttcggggtaaacccaccccggttaaaccgggaaaccccggttacccccaaaaccccggggttnttaccccggggtactaaccccttcccgttttcccccggaaccccccgg

SEQ ID NO: 53955 - DNA, 1080 bp, Homo sapiens
  misc_feature: GYAE6OF01CWJJA.29.78.H01.1.454.CMB.1.raw
  modified_base (199)..(199): a, c, t, g, unknown or other
  misc_feature (199)..(199): n is a, c, g, or t
  modified_base (1076)..(1076): a, c, t, g, unknown or other
  misc_feature (1076)..(1076): n is a, c, g, or t
tcagatagagtactcacgaccggtgctcgatttagtgtgagtagtttgggtttggggcgccgtgggtacggccgggggggtcgctgagactctcctgtgcggcctctggatttaagttttaggagtcatcgccatgaactgggtccgccgaggcctccgaggggaagggctgggagtgggtctcggctagttagtcggnaggtggtcggcgactatagttactagtgacacgaccgcccgtaggaaacggggtcccgttacaacctatttccgaagaacgaacgtaaagttaccggaaaaataaccgtacgtcgttaggtaacttcgtaacggaaactaaaaggttagggaacgtaacggttacccgtaggaaacggtaacccttaaccgggaaaccggaaacccggtaaccccggggttaccccggtttaactttaaaacggtttttaagtttaaccgggtttaaaaggttaaaaaacggggtaccggtaacgggttacccgttaaagggggtaaaaacccggttaaacccccggggggggaccccccggggggttaaacccccgtaacgtttttacccgggaaaaccccggtaccgggtttaacccgggggggaacccggggaaacgggggggtaacccggttacccgtttcgggttaaccccggaacccccgggtttccccttaaccccgttacccggaaaccggttcccccccgttaaaaccccggaaaacccccgggtaaccgggggttaacccccgtaaacccgggtttccccgggtttaacccccctttccccccggtaaccccgggtacccccgttaaccccccccgtaaccttaaaaccccggaacggtaacccgaaccggttaaccccgttacggggtaccgggggaacccctaaaccggaacggtacccgtaaccgggtcccccggttaccggggtacctaccggggttcccggttacggtaacggaaaccgggtacctttaacctaacccggttaacgttaccgttactaccgttacgtacggacgggtacccgcggtacgaacggtaacggtcgacgtaatgngacg

SEQ ID NO: 53956 - DNA, 770 bp, Homo sapiens
  misc_feature: GYAE6OF01EGPI5.29.78.H01.1.454.CMB.1.raw
  modified_base (763)..(763): a, c, t, g, unknown or other
  misc_feature (763)..(763): n is a, c, g, or t
  modified_base (768)..(768): a, c, t, g, unknown or other
  misc_feature (768)..(768): n is a, c, g, or t
tcagatagagtactcacgaccggtgctcgatttagtgtgagtagtttgggtttgggggcgcctgggtacggccgggggggtcgctgagactctcctgtgcggcctctggatttaagttttaggagtcatgccatgaactgggtcccgcgaggctccaggggaaggggctggagtggtctcggctattagtggcagtggtggcgctatattattatgcagaccgcccgtggaacgggtccggttcacctactttaccagacgaactaattacgaaagaacacgtactgttatctgacgaaatggagacgcctaggacgacgtcgacgaccgaccgggtccgttacttactttagtttacggttaaggtttaaacgggacgtacggtacgttagggaacgggtaaccgggggaccccggggtacccgtacgttaccggaaccgtacggtcgggggaccggaacgggggtaccgtccgttcgggtaccctacccggttccttacccgtacgaccggtccctacccgaacccggtaacgggcccccttacggttccccggttccccttccccccggtcggtaccccctaccccgtcccgttaacccgaaaccggccgtacccgtaccgttccggggcgggaaccaccgacggccgaccggtcccggtaggccgtccgtacccgttagggaccgtaaccgtaccttaccctacgtacgttacctacttcgtccgtagggccggtcggtacgcggaacggacgccgaanagtgncg

SEQ ID NO: 53957 - DNA, 999 bp, Homo sapiens
  misc_feature: GYAE6OF01DLAJO.29.78.H01.1.454.CMB.1.raw
tcagatagagtactcacgaccggtgctcgatttagtgtgagtagtttgggtttggggtccgagccatggtgcagactcccagagctctcctcctcctccactgcacagggtctctctcccagcctgtgctgactcaatccgccctctcgccttctcgcccttcccggtggggacggtccgttcgggttacgaacggtcctacctagttactcgtggacgacgtagggtcggaaccacgaggtacacggtcctaccggacctagttccggtcgttcggactacgtcacggacgacggaacggacccgaacggaacccgggtacccggggttaccccttttacggttttaacggtttaggaacgttaaccgaaaccgttaaacggtaacctaaaacgttaaggttacgggtaacggttacggggacccgtaacggtaaccgaacgggtacggggaaaccggggggtaaaccgggggggaccgttacttaccggtacgtaacggttccgttacctttacgtcgtaccgttaccctaccgtcggtccgttcggtaccgggtaccgttacggacccggttcctaacccgttaacccgtaacccgtaaacgtttaccccgggttccccggttaacccccggtacccgttaaccggtttaggttaaccgggtaagggtaacggggttaccggtaacgggttaccggggttaccctttaaaggtttaacccgtttaaacgtttccgggttaaccggtaccgggaaaccgggtttcccggggtacggtaaccgttaacggggtttcccgtaaacttttccggggttaacccgggttacggttttaaccccggggggaccggggtaaaccccgggttacgttaccgggttcccggttaaccgggttcccggtaacccgggtacaacccccgggtaaaccccgtaacccggtaccccctaacgttcgttacggtccccttaacccggtcccgtttaacccccggtacccc

SEQ ID NO: 53958 - DNA, 846 bp, Homo sapiens
  misc_feature: GYAE6OF01D63BW.29.78.H01.1.454.CMB.1.raw
  modified_base (843)..(843): a, c, t, g, unknown or other
  misc_feature (843)..(843): n is a, c, g, or t
tcagatagagtactcacgaccggtgctcgatttagtgtgagtagtttgggtttggggcgcctgggtacgggccgggggggtcgctgagactctcctgtgcggcctctggatttaagtttaggagtcatgccatgaactcgggtccgccgaggcctccgaggggaagggctggagtgggtctcggctagttagtggcaggtgggtgcgtactatatattatgcacggaccgcccgtagggaacggggtcccgttacaaccgttactttaccgaagaacgaactaagttaccggaaaagaaccaacggtctacgttactcgtagaactaaagtggaagacgcctagacgacgtcgaacgaccgtaccggtccttacttagtttagttaggttaaggttaaacggcgtaggtacgtaggtaaacggtaccggggacccgggacccgtacgtaccgaaccgtacggtccggggaacggaggggtaccgtcggtacggtaccgtacccgttcctacccggttaccaccgtccccgtaacccggaaacccggtacccgggtacccctaacggtttcccccggttcccctttaccccccggacgggtaccccccttacccccgtacccgtaaccgtaaaccgcccggtacccgtacccggtccgggtacccggggacctaccggtacccgccgtacccggtacccggttccggggtcctacccggggttccgttaccgggtaacggtaaacccggttcctttaacccgtcccgtaaaggtttccccttaagttacgttaacccggtgggaccgggttaccggcggtacggaacgtacgggacatagtagntag

SEQ ID NO: 53959 - DNA, 705 bp, Homo sapiens
  misc_feature: GYAE6OF01BURLB.29.78.H01.1.454.CMB.1.raw
  modified_base (519)..(519): a, c, t, g, unknown or other
  misc_feature (519)..(519): n is a, c, g, or t
  modified_base (701)..(701): a, c, t, g, unknown or other
  misc_feature (701)..(701): n is a, c, g, or t
tcagatagagtactcacgaccggtgctcgatttagtgtgagtagtttgggtttgggggcgcctggggtacggccgggggggtcgctgagactctcctgtgcggcctctggattaagttttaggagtcatgccatgaactgggtccgccgaggctccgaggggaaggggctggagtgggtctcggctattagtggcagtggtggcgctatatattatgcagaccgccctaggaacgggccggttcacctatttccagacgactaattacgaaagaacacgctagtatctgactaaagtgggagacgcctaggacgaccgtcgacgaccgaccggccgtacttatttagttgttaggttaaaggcgaggtcgtagggaacggtaccgggggacccggggaccgtacgttcggaccgacggtcggggaccggacggggacgtcgtcggtccgtaccgtcctccgtacgaccgtccctacccgaaccgtaacgggtccctacgttccggttcccttcccccgnggcccctacccgtccctaccgaacgcgacccgtaccgtacgggtaccggggaccacgacggccgaccggtccgtcgggcctcggtacccgtggtaccgaacggtacctaccgttaccggacttaccgtaccttacgtcgtacggacggtccggggctacgggacgacggaccacgaatcggntacg

SEQ ID NO: 53960 - DNA, 707 bp, Homo sapiens
  misc_feature: GYAE6OF01DDVCC.29.78.H01.1.454.CMB.1.raw
  modified_base (144)..(144): a, c, t, g, unknown or other
  misc_feature (144)..(144): n is a, c, g, or t
  modified_base (186)..(186): a, c, t, g, unknown or other
  misc_feature (186)..(186): n is a, c, g, or t
  modified_base (212)..(212): a, c, t, g, unknown or other
  misc_feature (212)..(212): n is a, c, g, or t
  modified_base (563)..(563): a, c, t, g, unknown or other
  misc_feature (563)..(563): n is a, c, g, or t
  modified_base (704)..(705): a, c, t, g, unknown or other
  misc_feature (704)..(705): n is a, c, g, or t
  modified_base (707)..(707): a, c, t, g, unknown or other
  misc_feature (707)..(707): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccncaggctcgaggggaggggctggagtgggtctcggctattagnggcaggtggtggcgctatatattagngcagaccgcccgtaggaacgggccgttacaacctatttccaagagaactaagttacgaaagaacacgcgtagtatcagacaaagtggaagacgtctagaagaacgtccggaacgtaacgaccgggtcctttacgttaagttttagtttagggttaaacggtttaaaacggccggtagtaccggttaagggaaacgggtacccggggggaaccccggggccccgttaagttaccggaccgaacggtcgggggaccggaggggacgtccgtggtaccctacgtccgtccctacgaccgtcccgtaccaaccgggtaaccgggccctacggttcccggttccccttacccccgngggtacccctaccctacctacgaaacgacgcctacgtcgggtggaccacagccgacgtcccgaggctcgtcgtgaacgaacgttactacctcgacttacacgtactggcgtacgggccgtggacgacgacggacgataggnngn

SEQ ID NO: 53961 - DNA, 733 bp, Homo sapiens
  misc_feature: GYAE6OF01APRWJ.29.78.H01.1.454.CMB.1.raw
  modified_base (727)..(727): a, c, t, g, unknown or other
  misc_feature (727)..(727): n is a, c, g, or t
  modified_base (731)..(731): a, c, t, g, unknown or other
  misc_feature (731)..(731): n is a, c, g, or t
tcagatagagtactcacgaccggtgctcgatttagtgtgagtagtttgggtttggtggtctctctcccagcctgtgctgactcaatcgccctctcgcctctgcctcccgtggggacggtctcggtacaagggtcacttgtactcgtgacgcaggtggacacagacagactacgcctagtcgcgttcgctagtacagcaagggacggtaccaagtaccgccgggtacccttacggttacttacggaacgttacgtaaactaagtaaacgtaaaatcggagtacgggactagtacacggtaacgggacgggaacgggggtacgtactcgacgtactccgttactacacggtactaccgacgttaaccgtccgttacgggttccggacgttacggaccggtacctaacgtacctaacggacctacggttaccgtcccgtactaccggtactcggtaaacggagtacggtggtaaccgtcggtaacgttaccttaagttaccgctaacggtaccggacggacggttacacgtacggtactacggtacgtacgggttacgggaccgggtaccggacgtacgtaccggtacgcggtacgacgtaaccgaccgtaaccgaccaacccgtacgtacgtcctaccgttcctcccgtcctacctaccacctacgttactcgtaccgttcgacggtaccggtacggacggtcgacggaagtcgacgacggataacggntaancg

SEQ ID NO: 53962 - DNA, 632 bp, Homo sapiens
  misc_feature: GYAE6OF01AU438.29.78.H01.1.454.CMB.1.raw
  modified_base (306)..(306): a, c, t, g, unknown or other
  misc_feature (306)..(306): n is a, c, g, or t
  modified_base (626)..(627): a, c, t, g, unknown or other
  misc_feature (626)..(627): n is a, c, g, or t
  modified_base (630)..(631): a, c, t, g, unknown or other
  misc_feature (630)..(631): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcacctatttccagagacaattcgaagaacacgctgtatctgacaaagtggagcgctgacgactcgacgacncggtccgtctattagttgtagttaaggcggagcgtagggaacgtacggggacccggggccgtacgttcgacctacggtcggggccgagggggccgtcgtcgggtccaccggtctccctcacgtcccgtcccaaccggtaaccgggccctacgtccggttcccttcccccgttcggcccctacccgtcccgtaccaacgacgcctaccggtcggtcggggccacgacgccgacgcccgtcggcgtcgccgtcggactaacggtaccttaccgtaccgtacgttaccgtcttacgtctaggcggcggcgcggcgaaggcganncgnng

SEQ ID NO: 53963 - DNA, 814 bp, Homo sapiens
  misc_feature: GYAE6OF01D2PD2.29.78.H01.1.454.CMB.1.raw
  modified_base (201)..(201): a, c, t, g, unknown or other
  misc_feature (201)..(201): n is a, c, g, or t
  modified_base (247)..(247): a, c, t, g, unknown or other
  misc_feature (247)..(247): n is a, c, g, or t
  modified_base (292)..(292): a, c, t, g, unknown or other
  misc_feature (292)..(292): n is a, c, g, or t
  modified_base (316)..(316): a, c, t, g, unknown or other
  misc_feature (316)..(316): n is a, c, g, or t
  modified_base (385)..(385): a, c, t, g, unknown or other
  misc_feature (385)..(385): n is a, c, g, or t
  modified_base (686)..(686): a, c, t, g, unknown or other
  misc_feature (686)..(686): n is a, c, g, or t
tcagatagagtactcacgaccggtgctcgatttagtgtgagtagtttgggtttggggtctgagagaggagtcccacccctgggatcttcaggttgttttcatttggtgatcaggacggaacagagagaactcaccatggagtttggctgagcgtggtcttttcttagtgacttaatttaaaaggtgtccagtgtgacgtgngagttggtggagtcgtggggcgccggtgggtaccgggccgggggtncgtgagactctctgtcgcgcctgagtattagttaggagtcagtcnccgtagtacgtaacgtcggtaccnccgacggtccgtccggaaggggagggtacgtgggaggtcgggtcctacgggtacttagttacggtcggngtacggtgggtcggacgtcttaagttatttaacgttgaggacgtaaccggaccccgtacccggttaaggggtaacccgggtcccggttaccctaaaccccgttaacgtttacccgaaagggtaaccgtaacgtaaacggttacccggaaaaacgtaaccgtaacgtacgttacgttaacttcgttaacgaacgtaaacggttggaagtaccgtacgtaggaaccgtaccggaccggaaccggtaaccggtacccggtacccgtttaggttaagtttagttagggtaacggtttaaaccggnggtaaccgtacggtaccgggtaaacggggttacccggggaacccggggtccccgtaaagttaccggaacccggtaccggggaccggggtaacgggaaccggggaccgttcggttaccggttaccccgg

SEQ ID NO: 53964 - DNA, 709 bp, Homo sapiens
  misc_feature: GYAE6OF01E4CBF.29.78.H01.1.454.CMB.1.raw
  modified_base (697)..(697): a, c, t, g, unknown or other
  misc_feature (697)..(697): n is a, c, g, or t
  modified_base (706)..(706): a, c, t, g, unknown or other
  misc_feature (706)..(706): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccaggggaaggggctggagtgggtctcggctattagtggcagtggtggcgctatatattatgcagacgccctggaagggccggttcacctatttccagagacaattcgaagaacacgctgtatctgcaaatggagagcctgacgactcgacgacgaccggccgtctatttattgtagtttaaagggcgagtcgtaggaactacgggggacccggggcccgacgttcgaccgtacgtcggggccagggggaccgcttcgggtccaccggtctcctacgacgccctcccaaccgaaccgggacccacgtccggttacccttccccccgtcgggcccctacccccgttccctacccgaacgtacgccctacccgttccggtcgggggtaccaacgacgaccgaccgtccccggtacggggtccctacggtcccgttacggtaacccgtaaccgggtaacctttacccggttaccgtaaccggttaacctaccgttacgttccgtacggacgggtccggggtccgtacgggtaccgaacggggccgtanacttacggngcg

SEQ ID NO: 53965 - DNA, 773 bp, Homo sapiens
  misc_feature: GYAE6OF01BF7B2.29.78.H01.1.454.CMB.1.raw
  modified_base (768)..(768): a, c, t, g, unknown or other
  misc_feature (768)..(768): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtgcagtggtggcgctatattattatgcagaccgccctaggaagggccggttcacctactttccagacgacaattacgaagaacacgctagtatctagacaaagtggagacgcctggaacgaccgtcggacgaccgaccggtccgtacttatttagttaggttaggttaaagggcgtacggtcgtaggaacgtaccgggggacccggggacccgtacgttacgaccgacggacggggccggaacggggtcgtcgtcggtaccaccgtcctcctcgccgtaccctacccgtacgaaccggggtccccctacggtttccccggttccccctttccccccggtacgggacccccctaccccgttaccccgtaacccgaaaggtccccgtaccgtaacccgttcccgggtacgggggtacccaaccgtacgggaccctaccgggtcccccggtaggggcccgttccggtacccgggttacggtaaccgaacccggttaccttaccccgttacggtacctttaaccctacgtttaccgtcgtacgggaccggcgggtacggtacgggacggtacggccgaatcgtgngtacg

SEQ ID NO: 53966 - DNA, 683 bp, Homo sapiens
  misc_feature: GYAE6OF01C6KJX.29.78.H01.1.454.CMB.1.raw
  modified_base (206)..(206): a, c, t, g, unknown or other
  misc_feature (206)..(206): n is a, c, g, or t
  modified_base (286)..(286): a, c, t, g, unknown or other
  misc_feature (286)..(286): n is a, c, g, or t
tcagatagagtactcacgaccggtgctcgatttagtgtgagtagtttgggtttggggtccgagccatggtacagactccccagagctctcctcctcctccactgcacagggtctctctcccagcctgtgctgactcaatcgccctctgcctctgcctccgtgggaggctcggtcaaggtcacctgtactctgagcaggtggacacngcagcctacgcctagtcgtcgttggctatcagcaggacggaccagaccgacggtccctgtttactgatgacagtacaaanatgagtcggcagtcgacgacggacggaagggggacggacgtcccgtgtactcggtcttcctcgtacgttcctacgtagtccttacggtcggtccgtacggtacgccgtacctaaccctaccgaactaccgtcccggtccgtcccgtaccgtcgtacggtagggaggtacggtacggtacgcggttattaacgttacgttacgtcgtaccgacgggtaccggtcgggtacacggttcgaacgttccggttacggttcggttaccgggtaacccggggaccggttaaccggtaaccggtccgtaccgggttcgtaacccggtccgaccggacccggaacccgtaccccgaaccgtcgtaacccggttcctaccgttcccggtcccgttccccgtacccg

SEQ ID NO: 53967 - DNA, 667 bp, Homo sapiens
  misc_feature: GYAE6OF01EUCE7.29.78.H01.1.454.CMB.1.raw
  modified_base (567)..(567): a, c, t, g, unknown or other
  misc_feature (567)..(567): n is a, c, g, or t
  modified_base (665)..(665): a, c, t, g, unknown or other
  misc_feature (665)..(665): n is a, c, g, or t
tcagatagagtactcacgaccggtgctcgatttagtgtgagtagtttgggtttgggggcgcctgggtacgggccggggggggtcgctgagactctcctgtgcggcctctggattaagttttaggagtcatgccatgaactgggtccgccaggctccaggggaaggggctggagtgggtctcggctattagtggcagtggtggcgctatatattatgcagacgccctggaagggccggttcacctatttccagagacaattcgaagaacacgctgtatctgcaaatggagacgctgagactcgacgacgtaccgcgtactatttagttggtagttaaaggcgagtcgtaggtaagtaccggggacccggggaccccggtacgttacggaccgacggtcggggacccgtagggggaccgtcgtacgggtccaccggtcctccgtacgtaccgcccgttacccaacccggtaacgggcccaaccgttccggttccctttccccccgtcggaccctacccctccctaccaacggacgccgtacccgtcgggtacggggacctagaccgtcnccgtcccggtcgggccgtcggtccgtcggtacgaacggtacctaccgttcctagtactcgtactcgtaggcggcggtacgcggacgacggcgagatgngc

SEQ ID NO: 53968 - DNA, 761 bp, Homo sapiens
  misc_feature: GYAE6OF01BMDUU.29.78.H01.1.454.CMB.1.raw
  modified_base (147)..(147): a, c, t, g, unknown or other
  misc_feature (147)..(147): n is a, c, g, or t
  modified_base (757)..(757): a, c, t, g, unknown or other
  misc_feature (757)..(757): n is a, c, g, or t
tcagatagagtactcacgaccggtgctcgatttagtgtgagtagtttgggtttgggggcgcctgggtacggccggggggggtcgctgagactctcctgtgcggcctctggattaagttttaggagtcatgccatgaactggggtccnccaggctccgaggggaaggggctgggaggtgggtctcggcttattaggtggctaggtgggtggcgctatattattatcgcaggaccgcccgtggaacggggtccggttacacctactttccgagacgaactaacgttacgaaagaaccacgtctagtactctgacaaagtggagacgcctgagactcgacgacgccggccgttactagtttattcggttaaggttaaagggcgaggcgtagggaacgtacccgggggacccggggacccgtagttcgaccgacggtcgggggaccggacgggggacgtcgtacggtcccaccgttcccgtccctacgccggtccctaccccgaacggtaccgggaccccgtacgttcccgggttccccgttcccccgtccggaccccgtaccccgtccgtacccgaacgacgcctaccgtgggtccggggtacacgtacggacgtaccggccggtacgggtcctacgggtccgttacggtaccggtaacggtaccgttacccttaccgtaacgttaccgttacttacgtcggtaggtaccggggtcccgggcgtaccgggaacgtaccggggaccgtaggtacgtacggntacg

SEQ ID NO: 53969 - DNA, 957 bp, Homo sapiens
  misc_feature: GYAE6OF01C442C.29.78.H01.1.454.CMB.1.raw
  modified_base (149)..(149): a, c, t, g, unknown or other
  misc_feature (149)..(149): n is a, c, g, or t
  modified_base (953)..(953): a, c, t, g, unknown or other
  misc_feature (953)..(953): n is a, c, g, or t
  modified_base (955)..(955): a, c, t, g, unknown or other
  misc_feature (955)..(955): n is a, c, g, or t
tcagatagagtactcacgaccggtgctcgatttagtgtgagtagtttgggtttggggcgcctgggtacggccgggggggtcgctgagactctcctgtgcggcctctggtattttaaggttttaggagtcatgccatgaacgtgggtccncgagctccgagggaggcgtggagtggtctcggcttaagttaggtgcgaggtggtggcgtcttaatattagttatgcgaacgaccgcccgtaggaacggggtcccggttaccaaccttacgtttacccgaagtaacggaactaattaaccggaaaacggtaaccgaacgtcttaggttaacttaccgttaggaaacctaaaaggtcgggaacgaacggtcccgttaaggaacgtaacccgaaccggaaccgaaccggtaacccgggttcccgttaaccttttaaagtttacggttttaagggtttaaccgggtttaaaacggggacgaacggttccggtaaacgggtaaaccgtaaaccgggggtaccccggggtaacccccgggtaaccgttaccggttaaccgaacccgggttaccgggggtaaccggggaaaccggggtccgggttaacccgggtcggttacccggtaccccggttacccgttacccttaccggacccgttaccccggtaccccgaacccccgttaaacggggtaaccccggtacccgttcccgggtttaccccgttacccccgtccccggttccccgtaacccccgtcccgttaacctaacccggtaaccaccgggttaccccgttaacccggtccggggtaacccgtaccggtaccgaccggtacccgttacccggtccgggtcgtacccggtcgtaccggttaacccgtaccgttaacgttccctacgttacccgtacttacgtaccgttcggtacgtacggtcggacggtagacgtacggacgatagngnag

SEQ ID NO: 53970 - DNA, 808 bp, Homo sapiens
  misc_feature: GYAE6OF01CVGKK.29.78.H01.1.454.CMB.1.raw
  modified_base (270)..(270): a, c, t, g, unknown or other
  misc_feature (270)..(270): n is a, c, g, or t
  modified_base (386)..(386): a, c, t, g, unknown or other
  misc_feature (386)..(386): n is a, c, g, or t
  modified_base (398)..(398): a, c, t, g, unknown or other
  misc_feature (398)..(398): n is a, c, g, or t
  modified_base (651)..(651): a, c, t, g, unknown or other
  misc_feature (651)..(651): n is a, c, g, or t
  modified_base (675)..(675): a, c, t, g, unknown or other
  misc_feature (675)..(675): n is a, c, g, or t
tcagatagagtactcacgaccggtgctcgatttagtgtgagtagtttgggttggggcgccgtgggtacggccggggggtcgctgagactctccgtgtgcggcctctaggtatttaaggtttaggagtcagtcgcctaagtggtaacgtcgggtcccgacgacggtacctcccggaaagggggaacgggtcgtagggtaggttcgggttccgacggtacgttagttacgggtggaccgaggttcgggtcggactactaattattaagttcncgacgaaccggtcccgcccgttaagggaaccgggttcccgttacaaccgttactttaccgaacgacgtaactaacttacggaaaacaaccgcggtctaggttactgtacggtaaanaacggagggacnccgtaccgtaaggcgtaaccgtacggaccgaccggaaccggttccttagtttaattacggtttaggtaaacggtaaggacgtcgggtaacgtaaagggaaccccgggttaccgggggaaccccggttactacgtacgaaccgggttcgggacggacgggttaacgcgttcgcgtcctaccgctacccgacacccggttcaacccgacggttaccgccgtccgtccgtcccctcccgtactaccctcccgaccncgaacgcgccgtccgtaggcgacncgtacgaccgtcggacgtcgaccggtgtaccgtacgtaccgacttacccgacttacgtacgttactacggttctagggaacggtcccggtagggacccgtaacgggtgacccgggtactaggtacgtcgactg

SEQ ID NO: 53971 - DNA, 877 bp, Homo sapiens
  misc_feature: GYAE6OF01BV9DN.29.78.H01.1.454.CMB.1.raw
  modified_base (200)..(200): a, c, t, g, unknown or other
  misc_feature (200)..(200): n is a, c, g, or t
  modified_base (223)..(223): a, c, t, g, unknown or other
  misc_feature (223)..(223): n is a, c, g, or t
  modified_base (296)..(296): a, c, t, g, unknown or other
  misc_feature (296)..(296): n is a, c, g, or t
  modified_base (873)..(873): a, c, t, g, unknown or other
  misc_feature (873)..(873): n is a, c, g, or t
tcagatagagtactcacgaccggtgctcgatttagtgtgagtagtttgggtttggggggcgcctggggtacgggccggggggggtcgctgagactctcctgtgcggcctctggatttaagttttaggagtcatcgccatgaacgtgggtccgccaggctccgaggggaagggctgggagtgggtctcggctattagtggnaggtggtggcgctatattattancgcagaccgcccgtaggaacgggtccggttacactactttccaagaactactaagttaccgaaagaacgacgntagtactacgagagtaaaggtaggaacgacgtccgtaggaacgtaccgtaccggaaccgaaccggtaccggtaccgtttaacgtttaagtttaacgttaggttaaacggtaacgggtacgtaagggtacggtaacgggtaaccggggtaaccccgggggtaccccgggtaccgttaccgttaccggaaccgtacgggtaccggggaccgggtacggggtaccgtacggtaccggtaccctaccgtccgtacccgtacgtaccgtacccgtaccgaacccggtaaccgggtacctaccggttcccggttacccttccccggtaccgtaccccctaccccgtaccgtaaccggaaaccgtaccggtaccgtacccgggtacggggtaccgggacctaacggacggacccgtaaccggggtaccggttacgggtcccgttaccggtaccggtacggtaaccgtaaaccggttaccttaacccgtaccggttaacgttaccgttaacgtacggttaccggtacggggaccgggttacccgggaccggtaacgggaaccggtaccggacgtagtaccgtagntacg

SEQ ID NO: 53972 - DNA, 864 bp, Homo sapiens
  misc_feature: GYAE6OF01DCZT6.29.78.H01.1.454.CMB.1.raw
  modified_base (225)..(225): a, c, t, g, unknown or other
  misc_feature (225)..(225): n is a, c, g, or t
  modified_base (302)..(302): a, c, t, g, unknown or other
  misc_feature (302)..(302): n is a, c, g, or t
  modified_base (309)..(309): a, c, t, g, unknown or other
  misc_feature (309)..(309): n is a, c, g, or t
  modified_base (790)..(790): a, c, t, g, unknown or other
  misc_feature (790)..(790): n is a, c, g, or t
  modified_base (862)..(862): a, c, t, g, unknown or other
  misc_feature (862)..(862): n is a, c, g, or t
tcagatagagtactcacgaccggtgctcgatttagtgtgagtagtttgggtttgggggcgcctgggtacggccgggggggtcgctgagactctcctgtgcggcctctggattaagtttaggagtcatgccatgaacgtcgggtccgccgaggcctccgaaggggaaggggctagggaggtgggtcgtcggctagttaggtggcaggtggtggcgctatataattntcgacagaccgcccgtaggaacgggccgttacacctattccaagagactaattacgaaagacacgactgtatcgtanacaaagnggagacgtcctaggacgtaccgtcgaacggacgtaccggtaccgtacgttaagtttacgttaggtaaggtttaaaccgggaggtaacgtacgggtaaacgggtaaccgggtaccccgggggggaccccgggacccgtaacgttacccggaaccggtaccggggtcgggggaaccgggacgggggtaaccgtccggttacggtaccccggtaaccggtttacccctcccgtaccggaaaccgtcccccgttaaacccgaacccgggtaaacccgggccccgtaaccgtttcccgggttacccccctttaccccccggtccggaaccccccttaccccgttaccccgtaacccgaaacgggtaccctacccgggtaaccccgttcggggtacccggggacccaacggaccggcccttaacccgggccgggtaccggtcccgaccggttccgtaccggtaacgtaaccgtacgttaaccccgtnttaaccgacttaccgtaacgtccggaggtacggtccgggtacgtacgggaccacgggacctaacgacgtcgngc

SEQ ID NO: 53973 - DNA, 763 bp, Homo sapiens
  misc_feature: GYAE6OF01BHALC.29.78.H01.1.454.CMB.1.raw
  modified_base (145)..(145): a, c, t, g, unknown or other
  misc_feature (145)..(145): n is a, c, g, or t
  modified_base (710)..(710): a, c, t, g, unknown or other
  misc_feature (710)..(710): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccnccaggctccgagggaagggctggagttcgggtctcggcttagttagtggctaggtgggtggcgctatatattagtgcaggaccgcccgtggaacgggtccgttcacgtatttccgagacgactaagttccgaacgtacaccgcgtgtatctgactaagtcggagcgacgtgacgtactccggacgaccgtccggtaccgttactatttacgtagttacgttaaacgggcgtagtacgtagggtaacgtaccggggaccccggtccgacttccggaccgtacggtcggggaccaggggtaccgtcgtcggtacctaccggtccgttaccgcgcgtaccccgtaaccgaccgaaccgggtaccctacggtttacccggttccccgtacccccgttgggtaccccgtaccccgtccgtaaccgaacgccgtacccgtacccgcggttaccgggctaaccggacgtacctccgggtacccgtacggtccgtccgtaccgggtccggtacgtaacccggtaccttaccgttacccgtaagtaccccgttaccgtacgtcgtaaccccggnggtccccgggagttcgggaacccgttacggccgtaaacgtcggtacgtcgtac

SEQ ID NO: 53974 - DNA, 746 bp, Homo sapiens
  misc_feature: GYAE6OF01EGP9C.29.78.H01.1.454.CMB.1.raw
  modified_base (444)..(444): a, c, t, g, unknown or other
  misc_feature (444)..(444): n is a, c, g, or t
  modified_base (450)..(450): a, c, t, g, unknown or other
  misc_feature (450)..(450): n is a, c, g, or t
  modified_base (740)..(740): a, c, t, g, unknown or other
  misc_feature (740)..(740): n is a, c, g, or t
tcagatagagtactcacgaccggtgctcgatttagtgtgagtagtttgggtttggggcgcctgggtacggccgggggtcgctgagactctcctgtgcggcctctggattaagtttaggatcatgccatgaactgggtccgccgaggctccgagggaaggggtctgggagtgggtcttcggcttattagtggcagtggtggcgctagtatattatgcgagaccgccctggaagggtccggtttcaaccgtatttccaagtaagtactaaagttcgaaagaaccacgtctgtaatctagacaaaagtggagagcctgacgactcggacaccgacggcctctaattcgttggtagttaaaggcgtagtctggaaattaccgggaccgggtaccaagttcggacctacggtagggggacccaaggggacctcgtggtacctacccgtntacccncgaacgtccctaccaaccgtaacgggccctaagttccggtaccttacccccgtaggacccctaaccctccgtaaccgaaagaccgtacccaaccgtccggtagggccaaccgtacgccgtaacgccccgtagggtacctacgggtccgttacggtaacccgtaacgggtaaccttaacccgttccgtaaacggttaccgttaaccgtaacggtttaaccggttacgggtaacgggtcccggggtaacgttcgggaacccggtaaacgggtccgaacgttaaggtacccgngaccgg

SEQ ID NO: 53975 - DNA, 780 bp, Homo sapiens
  misc_feature: GYAE6OF01D3C5M.29.78.H01.1.454.CMB.1.raw
  modified_base (777)..(777): a, c, t, g, unknown or other
  misc_feature (777)..(777): n is a, c, g, or t
tcagatagagtactcacgaccggtgctcgatttagtgtgagtagtttgggtttgggggcgcctgggtacgggccgggggggtcgctgagactctcctgtgcggcctctggatttaagttttaggagtcatgccatgaactgggtccgccgaggctccgaggggaaggggcgtggaggtgggtctcggcttattagtggcgagtggtggcgctatatattatgcagaccgccctaggaacgggtccggttccaacctactttccagagaactaagttacgaacgaacacgcttgtatctagacaagtggagacgctgacgactaccgacgaccgaccggtcctacttagtttagttggttaaggttaaggacgtagtacgtaggaacggtaccggggacccggggtacccgtacgttacgaaccgtacggtaccgggggaccggaacggggtacgtcggtacggtaccgtaccgtcctaccgtacgaccgtcccgtaccccgaaccggaaccgggcccctacgtttccccggttacccccgtttccccccggaccgggacccccttaccccccgttacccgtaacccgaaacgggtacccgaccccgttaaccccggtaccggggttaccggggaaccctacggaccggacccgaccggcccggttacggggtccctaccgggtcccgttagaaccgtaacggtaccttaccgtcctacgtaccttacttacgtccgtaggccgggtcgggtacgacggacgtacggccaagtagcgngta

SEQ ID NO: 53976 - DNA, 877 bp, Homo sapiens
  misc_feature: GYAE6OF01EVYY4.29.78.H01.1.454.CMB.1.raw
  modified_base (191)..(191): a, c, t, g, unknown or other
  misc_feature (191)..(191): n is a, c, g, or t
  modified_base (203)..(203): a, c, t, g, unknown or other
  misc_feature (203)..(203): n is a, c, g, or t
  modified_base (873)..(873): a, c, t, g, unknown or other
  misc_feature (873)..(873): n is a, c, g, or t
  modified_base (876)..(876): a, c, t, g, unknown or other
  misc_feature (876)..(876): n is a, c, g, or t
tcagatagagtactcacgaccggtgctcgatttagtgtgagtagtttgggtttgggggcgcctgggtacggccgggggggtcgctgagactctcctgtgcggcctctggatttaagttttaggagtcatgccatgaactgggtcccgccaggctccgaggggaagggctggagtgggtctcggctattagngcagtggtgcgntatatattatgcagaccgcccttaggaacggggtccggtttaccaacctacttttacccgaaggtaacgaactaaacgtttacggaaaacggaaacctacggtaccttaggttaacttcgtagtaacgtaaaggtaggacgtacggtccgtaggaaccgaccgtaccggaaccggaaccggtaccggtacccgtttaacgtttagttttaacggtttaggttaacgggttaaacgggcggtaacggtacggttaacgggaaaaccggggtaccccggggggaaccccggggtaccccgtaaccgttaccgggaaccggtaccggggtcggggtaacccgggacgggggtaccgtcggttaccggtccccgtacccgttccctaccgtaccgacccgtccccgtaacccgaacccgggaaccgggtacccgtacccgttaccccggttcccccgttcccccggtaccggtaccccctaccccgttaccggtaaaccgtaaccgccgtacccgtacccgggtcgggaccgggaccgacgtaccgaccggtacccgtcccgggtcggtaccgtaccgtcggttacggtaaccgtaaccgtacccttaccgttaaccgtacgttaccttacgtacgtacgtggacggtcggacgtacggacgtacggactacgntgnc

SEQ ID NO: 53977 - DNA, 751 bp, Homo sapiens
  misc_feature: GYAE6OF01EYAXU.29.78.H01.1.454.CMB.1.raw
tcagatagagtactcacgaccggtgctcgatttagtgtgagtagtttgggtttggggggagagaggagtccacccctgggatcttcaggttgttttcatttggtgatcaggacggaacagagagaactcaccatggagtttgggctgagcgtggtcgttttcgtaggtgactaattttaaaaggtgtccagtgtgacgtgactaggttggtggagtcgtcggggcgccgtaggggtaccgggccggggggtcgctgagactctcctgtcgcggcctcgtaggtatttaaggttttagcgtctagtcgacctagtcgaacgtcggggtcccgaccgtaggcctccggaggggaaacgggtcgtagggtcgggtgggttcctcgggacgtttaacggttaggttgggccgtagggtgggttcggccgtaatattaacttagtttaagtgacacggaccggtcccgtaagggaccgggtccggttcaaacccttcgtttaccaggtaccgaataacgttaaccgaaagaacctacgtaccgtacgttaagtcgtacgtaataacggtaggaagtgaccgtagtaaccgactaccggaccgacgtaccggtaccgttattagttacgttagttaacggttaacggacgtcgtagtcggaaacggtacccggggaccggaccccgtaggttacgacccgtacgggtacccgggcgtaacggggtcccgtacggtcgggtaacctcccgggttaccc

SEQ ID NO: 53978 - DNA, 842 bp, Homo sapiens
  misc_feature: GYAE6OF01COZ64.29.78.H01.1.454.CMB.1.raw
  modified_base (412)..(412): a, c, t, g, unknown or other
  misc_feature (412)..(412): n is a, c, g, or t
  modified_base (633)..(633): a, c, t, g, unknown or other
  misc_feature (633)..(633): n is a, c, g, or t
tcagatagagtactcacgaccggtgctcgatttagtgtgagtagtttgggtttgggggagagaggagtcccaccccgtgggatcttcaggttgttttctatttggtgatcaggacggaacagagagaactcaccatggagtttggctgagcgtgtctttttgttgtggcttaagttttaaaaggtcgtaccgagtgtgacgtgcgtaggttggtggtaggtcggtgggggccgccggttcgggggtaccggggcccggggggggtccgcgtaggaacggaccgttccgttccgttggtcgtccggtcccttcgtaggttaaagttttaaacggtttaggtacgttcagtcgtacctagtacggtaacgtcgggtcccgccgacggtcctaccggaaggggaagggcgtgggnggtcggtccgtcggtacgtagtaggtgtcggtagggtcggtggtccgtacttaagttaattaagttacgtgaccgaacgggtaccccgtacccgaaggggttaccgggtacccccggttactaacccggtttaacgtttaacccgaagggtaaacgaaacccttaaacgtaaccgtaaaaaccgaacgtaaccggttacgtaacggttacgttaccgtaanaaccgtaaaagggtcgggtaaacggcgtaaccgtaggaaaccgtcgaaccggtaaaccgaccggtacccgttacgttacgttaagtttcgttacggtaaaggttaacgggcgtacggaggtaaccggacgggtacccgggtacccggtacgttacgaccggtaccgtacgggcggacggacggtcccgtggtacccggtctcccggtcc

SEQ ID NO: 53979 - DNA, 717 bp, Homo sapiens
  misc_feature: GYAE6OF01AM529.29.78.H01.1.454.CMB.1.raw
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgccaggctccgagggaagggctggagtgggtctcggctagttagtggcaggtggtggcgctatatattatgcagacgccctgaacgggccggttcacgtatttccgagagactaagttcgaagaaccacgctgtactctgacaaagtcggagacgcgtagagactcgacgacgaccggcgttactattgttgtagttaaggcgagcgtaggaacggtaccggggacccggtaccgtacgtacggacccgtaggtccgggggaccgtaggggacggtcgtcgggtcctacccggttctacccgtcgtaactccccgtacccgaacggtaacccgggtaccctaccgtcccggttcccttaccccccgtcggtacccctaccccgtccctaaccgaacgtaccgaccgtacccgtccgggtcggggaccacgtaccggaccgtaccggtccggtacgggccgtcgggtacccgttcgggacgtaaccggtaccttaccgtaccgtacgttaccgtctacgtccgtacggccgggtcccggtcgggacgtcggaaccgggcgtaggtaactggctag

SEQ ID NO: 53980 - DNA, 858 bp, Homo sapiens
  misc_feature: GYAE6OF01DC8BI.29.78.H01.1.454.CMB.1.raw
  modified_base (128)..(128): a, c, t, g, unknown or other
  misc_feature (128)..(128): n is a, c, g, or t
  modified_base (218)..(218): a, c, t, g, unknown or other
  misc_feature (218)..(218): n is a, c, g, or t
  modified_base (290)..(290): a, c, t, g, unknown or other
  misc_feature (290)..(290): n is a, c, g, or t
  modified_base (847)..(847): a, c, t, g, unknown or other
  misc_feature (847)..(847): n is a, c, g, or t
  modified_base (854)..(854): a, c, t, g, unknown or other
  misc_feature (854)..(854): n is a, c, g, or t
tcagatagagtactcacgaccggtgctcgatttagtgtgagtagtttgggtttgggggcgcctgggtacggcgggggggtcgctgagactctcctgtgcggcctctggatttaagtttaggagtcatnccatgaactgggtccgcaggctaccgagggaaggggctggagtgggtctcggcttattagtggcaggtggtggcgctatatattatgacngaccgcccgtaggaacggggtcccgttccaaccgtattttacccgaagacgtaacctaaagttccggaaaanaacgaacgtccttggtaacttcgtacgaaccgtaaaagtggggaacgacgtaccgtaggaacgtacccgttaggaacccggaaccgcccgggttaaccccggttactttaagtttaacgtttggttaacgggtttaaaacgggcggtaacgggcgtaaacgggtaaggtaacccgggggaccccggggtaccccgtaacgttcgaccgtacggtcggggacccggtaaggggcgtacggtcggtacctccggtacctccggtacacggtaccctaccgaacccgacgggtacccctacggttcccgggttcccccttacccccggtcggtacccctaccccgtaaccctacccgaaacggaccgacccttaaacccgttcgggtacggggaccgtaaccgacggtacccgaccggtcccgtacgggggtccctacgggttacccgtacgggttaaccgtaaccgggtaccctttaaaccggttcccctaacggttaacccttacgttaacgtcgtacgggacggtcggggaccttcgggaacggtacggacccgtanaacggtntcgc

SEQ ID NO: 53981 - DNA, 622 bp, Homo sapiens
  misc_feature: GYAE6OF01BA4CA.29.78.H01.1.454.CMB.1.raw
  modified_base (504)..(504): a, c, t, g, unknown or other
  misc_feature (504)..(504): n is a, c, g, or t
  modified_base (616)..(616): a, c, t, g, unknown or other
  misc_feature (616)..(616): n is a, c, g, or t
  modified_base (618)..(618): a, c, t, g, unknown or other
  misc_feature (618)..(618): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtagttaaggcgagctggaagtaccgggaccggggcccgacttcgaccacgtcggggccgaggggacgcgtggtccaccgtctccctcacgcctcccgaccgaacgggcccacgtccggtccttcccccgtcggcccctaccctcccaccgaagacgaccaccgtccgtcggggccacgtacgccncggcccgtgggcctcggtccgtcggtaccaacgggtacctaccttccgtaagtaccttcttacgtccgttggacggtccgggtcgtgggaccgtaacgggccgaaccgtagngntacg

SEQ ID NO: 53982 - DNA, 978 bp, Homo sapiens
  misc_feature: GYAE6OF01B6H6Z.29.78.H01.1.454.CMB.1.raw
  modified_base (124)..(124): a, c, t, g, unknown or other
  misc_feature (124)..(124): n is a, c, g, or t
  modified_base (483)..(483): a, c, t, g, unknown or other
  misc_feature (483)..(483): n is a, c, g, or t
  modified_base (495)..(495): a, c, t, g, unknown or other
  misc_feature (495)..(495): n is a, c, g, or t
  modified_base (542)..(542): a, c, t, g, unknown or other
  misc_feature (542)..(542): n is a, c, g, or t
tcagatagagtactcacgaccggtgctcgatttagtgtgagtagtttgggtttggggtctgagagaggagtcccaccccgtgggatcttcaggttgttttctatttggtgatcaggaacggaanagagagaactcactagtggtaggtttggctggagtcgtggttctttttcgttggtggtactttaaaagttttaaaaggtcgttaccgtaggtggttagacgttgagtagggtttgggtagggtacggttccgggtggggggccgtccggttacgggggggtaccgggggcccgggggggggttcacgtggaacgtccgttccgtccgttggtaccggccggtccttacgtagggttaagtttaaagggtttacgagttcacttcggactaggtacgtacggtcggggtcccacgacggccgtaccggggaagggggaacgggtcggagggtacggtggtccgtagggtacttagtcggngcgtagggtggnggctatattactgtactgacgtacgaccgcgtaggaccgggtctacnctaacgtcgaaggacctataacgttacgaacgtacacgtctacgttacgtacgaataacggtaagtcgggaagtacccgtacggtaacggtaaccgtacccggtaaaccgggaccgggttaaccccgacccggggttttaacccgttagtttaaacccggttttacgggttttaaaggggtaaacccgggtttaaacggggtaccggttaacgggttacccggggtttaaaagggtaaacccccgggggggggttaaaccccggggggttaaaccccccggggggtttacccccgggtttaaaaccgggttaccccggggttaaacccggggtaaccccgggggggttttacccccgggggggaaacccgggggtaacccgggggtttcccggttaaacccccggggggggtttttggttaaaccccccccccggg

SEQ ID NO: 53983 - DNA, 948 bp, Homo sapiens
  misc_feature: GYAE6OF01DSJ06.29.78.H01.1.454.CMB.1.raw
  modified_base (227)..(227): a, c, t, g, unknown or other
  misc_feature (227)..(227): n is a, c, g, or t
  modified_base (356)..(356): a, c, t, g, unknown or other
  misc_feature (356)..(356): n is a, c, g, or t
tcagatagagtactcacgaccggtgctcgatttagtgtgagtagtttgggtttggggtccgagccatggtgcagactccccagagctctcctcctcctccactgcacgagggtctctctcccagcctgtgctcgactcaactccgtccctctcgccttcgcgtcccgttcccggtagggcggtccgttccgggtacaacggtccaaccgttcgtaccttcgagacgngacggtacggacacgagcgaacgctacgctaagtcgtcgtcggactacgtacgacgcgacggacggtccgaacgtaccgtacccgggtcctttacgttacgtgacgtacgacgtacggtaactaaacgngttacggtacggtacggtactaccggacgaacggacggggaccggggtaaacgggggaccggtaccgtttaccggtacggtacgttcccggttctttaccgtacgtccggtacctaccggtcgccgtttcgggtccgtaccggagtccggacccgttccgtaccctacgtaacctcgttacccggtaccccggttaccgttaccgtacggttacgggaacggttacgggtaaccgttcgggaaccggttaccgtaaaccggttttaccgtttaacggttttacccgaaccgggtttaacgggtaacccgggttaaccggggtacccgggttaaccgggttaaccggttcccgggtaccggtttaacgttaacccgggggtttaaccgggtttaccccggggtaaaccccgggggttaaccccgggtaaccgggttaaccccgggttccccgggttaacccgggttaccccgggtacccggtaccgggaacccccggtaaccccggaacccggttacccccggaaaccccctttcgggttaaccccttaaccccgtttccccggttaaaccccgttccccgttaaaccccccg

SEQ ID NO: 53984 - DNA, 942 bp, Homo sapiens
  misc_feature: GYAE6OF01AQIQC.29.78.H01.1.454.CMB.1.raw
  modified_base (146)..(146): a, c, t, g, unknown or other
  misc_feature (146)..(146): n is a, c, g, or t
tcagatagagtactcacgaccggtgctcgatttagtgtgagtagtttgggtttggggtccgagccatggtgcagactccccagagctctcctcctcctccactgcacagggtctctctcccagcctgtgctgactcaatcgccctntcgcctctcgccctccgtgggacgctcggtcaaggtccacctgtactcgtagacgcgagtcggacacgaggcacgtctaccgcctagtccgtcgtttaggacctacgtaccgacgacgaacggaaccggtacccaacggaccggtaaccccgggttccccttttacggtttaaccgttggtaacgtaccggaaccgtacggtaacccaaaacgtaagttcggtaacggtccggacctaacgtaccgaacggacggggaacggggtaaaccgggggaccgttacctcccgttaggtaccgttcccgtctttaccgacgttaccgtcccttaccggacggttcgtaccggtccgggtaccttacgggacccgttaccgtacccttacccgtaacaaccccgttaaccggttccccggtccccggtacccttacccgggtaacgttacggtagggtaacggtcggttacgggtaacggttccgttaacgtttaaccgttacgtttaccggtcgttaaccggtaacgggtttacccgggttacgggttaccgttacggtaccgtttaacgggtttacccggttaaccggggtttacccgggttaacccgggggtacccggtaaccggtttacccgggtcccggttaacccggggttacccggggttaccgggaaccccgtaaccccggggtaaaccccggacccggttaaaccccccggtaaaccccggttcgttaacccccggttacccggttaacccgtttcccccgggtttcccccggttaccccccggttaccccg

SEQ ID NO: 53985 - DNA, 781 bp, Homo sapiens
  misc_feature: GYAE6OF01BJ2LF.29.78.H01.1.454.CMB.1.raw
  modified_base (467)..(467): a, c, t, g, unknown or other
  misc_feature (467)..(467): n is a, c, g, or t
  modified_base (512)..(512): a, c, t, g, unknown or other
  misc_feature (512)..(512): n is a, c, g, or t
  modified_base (779)..(779): a, c, t, g, unknown or other
  misc_feature (779)..(779): n is a, c, g, or t
tcagatagagtactcacgaccggtgctcgatttagtgtgagtagtttggggtttgggggcgcctggggtacgggccggggggggtcgctgagactctcctgtgcggcctctggatttaagttttaggagtcatgccatgaactggggtccgccaggctccgagggggaagggggctgggaggtggggtctcgggcttattagtggcaggtgggtgggcgctaatattattatgacagaccgccctagggaacggggtcccggttaccacctactttccaagagaactaaagttacgaaacgaacacgcttagtactctagacaaagtgggaacgaggtacctggacgactaccggaacgacgaccgggtcctacttagttacgttggttaaggtaagggacgagtcgtaaggaacggtaccgggggacccgggccgtactcggaccgaggtcggggacgagggacgngtcggcctcgcctcgtacacgtcccaccgaaccgacggtaccctntccggtccctccccgtcggcccctaccctcctaacgacgaccgtaccctcgtccgggtacgggactaacgacggtaccgacggtcccgggtacgggtccgtacggtccggttacgtaccgggtaaaccggttaccgttacccgttacccggttaacgttaccgttaacggttaccgtttaacgggtaccgggtaccgggggccgggggttaacccgggtacggggtaaaccggggtacggggtacccggaacggttaacggacggtncg

SEQ ID NO: 53986 - DNA, 890 bp, Homo sapiens
  misc_feature: GYAE6OF01C000M.29.78.H01.1.454.CMB.1.raw
  modified_base (693)..(693): a, c, t, g, unknown or other
  misc_feature (693)..(693): n is a, c, g, or t
  modified_base (867)..(867): a, c, t, g, unknown or other
  misc_feature (867)..(867): n is a, c, g, or t
  modified_base (888)..(888): a, c, t, g, unknown or other
  misc_feature (888)..(888): n is a, c, g, or t
tcagatagagtactcacgaccggtgctcgatttagtgtgagtagtttgggtttgggggcgcctggggtacggccggggggtcgctgagactctcctgtgcggcctctggatttaagttttaggagtcatgccatgaactgggtccgccaggctccgagggaagggctggagtgggtctcggactattagtgcaggtggtggcgctatatattatcgacacgacgcccgtaggaacgggtccggtttccaaccgttacgtttacccgaaaggacgaacgtaaagtttaccggaaaacggaaaccaccggtcctttggtaacttaccgtaggaacctaaaaaggtggggaagaccggtaccgttaggaacgaccgttaacggacgtaaccggaacccgggtcccggtttaccttttaagttacgttttaggtttaagggtttaaaacgggaccggtaaggtaccggttaagggtaaacgggttaccccgggggaccccgggggtacccccggtaacgttcggtaacccgtacgggtaccgggggggaccgaaacgggggaccgtcggtacgggtccgtacccgtttccgcccgttacgcccggtcccgtacccgaaccggaacccgggtcccttacggtccccggtttccccttccccgtacgggtccccttaacccgtaccctaacacggaccnccgtaaccgttcgggacgggtaccgtacgacggtaccgcgtacccgggtttcgggcccttacggggtccctagggtaaccggaaccgttcttaacccgtttaccaccgggttccttaccgtaacgtttccgggacgggaccgggtccgggggtaccaacccgggtcgggaaacncccggggtactaacggacggntc

SEQ ID NO: 53987 - DNA, 804 bp, Homo sapiens
  misc_feature: GYAE6OF01APECU.29.78.H01.1.454.CMB.1.raw
  modified_base (250)..(250): a, c, t, g, unknown or other
  misc_feature (250)..(250): n is a, c, g, or t
tcagatagagtactcacgaccggtgctcgatttagtgtgagtagtttgggtttggggtccggagccatggtgcagacctcccagagctctcctcctcctccactgcacgagggtctctcctcccagcctgtgtcgtgactcaacgtccggtcccctcgtctcccttcgtcgtcccgtcccggtaggggtcggtccggttcggtacctaacggtccctaccttcggtactctggagcggtaggtcggaacncgagtcgaccgtactacccgacgtcgtcgtcggtcgacttacacggacggacgagaccgggtaacgaccgaccgggccggtttacccgttacgtttacgtcacggtaacgtaccgtaacaacgtaaacggtacgtacgtgggtaccacgtacgtacacggggtaaggaccgggggtagggaccccggtactaccggtcggtacttccgtccggtttacacggtacgtaccggtacctccggtgttacggcccggtagttccgggacctaccctacggtcttacccaaggttacccctcggtcccgtacgtaccgtgtgtaccggaaatccggtagtacgttacgtcgttaacgttcgtaactcggtaccgtacggtcggtacgtcgggttactacggtcttaacggtacccggtttacgggaccggtaacgggtcccgggttaagacccggttaccggtccggtaaacggtcccgggtaccctacccggaccgaaccccgtacccgtacggtacccttaccgtcccgttaaccgtcccctttcccgggtacccc

SEQ ID NO: 53988 - DNA, 761 bp, Homo sapiens
  misc_feature: GYAE6OF01BTVO5.29.78.H01.1.454.CMB.1.raw
tcagatagagtactcacgaccggtgctcgatttagtgtgagtagtttgggtttggggcgcctgggtacggccggggggtcgctgagactctcctgtgcggcctctggatttaagttttaggagtcatgccatgaacgtgggtccgccaggctccgagggagggctggagtgggtctcggctagttagtggcaggtggtggcgctatatattatgcagacgcctggaacgggtccgttacaaccgtatttccgaagacgaactaacgttcgaaaagaacgacgtctagtactctgacaaatggagacgcgtgagactacgaacgacgacggtctcgtattagttcgttagttaaaggacgtagacgtaggaacgtacggggaccccgggtacccgtagttacgaccgaacggtaccggggccggaacggggaacgccgttaggtaccgtaccggtccgttaccgtccgaccgtccctacccaacccggaaacccgggtacccgaccgtaaccccgggtttccccgttaccccccggtacggtacccgtaaccccctaccccgtttacccgaaacggaaccgcccgtaacccgttccgggtacggggtacccgaacgtccgaccgacggtcccgtcgggttcgtccggtccgttacggtacgtaaaccgtacgttacccttaccgtacgttaccttacgtaacgtcgttaggacggtccgggacgttccggacggacgggtaccgaaggttactcgggatcgg

SEQ ID NO: 53989 - DNA, 805 bp, Homo sapiens
  misc_feature: GYAE6OF01AGTB1.29.78.H01.1.454.CMB.1.raw
tcagatagagtactcacgaccggtgctcgatttagtgtgagtagtttgggggtttggggagagctcgtgggggagtctgcaccatggctccggaccccactcctcttcctcacccttcctcctccactgcacgagggtctctctcccagcctgtgctagactcaacttccgccctgtcgccttcgtcgtcccttaccggtggggacggtccgtcggtacgaacggtcctaccgttagtacctcgtacggaggtcgtaacgggtcggaacccacgacggtccgaacggcccgttaaccggcctaacggttccggtacggttcggaccttaacgtccgaacggacgaacggaccgggaccaacgggaccggtacccgggttccctttacggtttaacgttacggtacgtacggaaacctacgtaacctaaacggaagtacggtacggcggtactaacggtacgaaacgggtacgggtaacggggaacgggggaccctacgtcccggttaagtccgtccgtacgttccgaacgttcgtaccgtacggcgtacggtcggttcgggaccgtcggtaccgtaccgtacctaaccgtacctaaccgtttccgtaccccggttccggtacctacggtcggtcggtaaaggtcggtagtcggtactcgtaacgttcgttaagttccgaggttaccggagggtttaccgggcgttaagccgtcggttactaccgggtcggtaacccgggttgggacccgggtacggtacgtacggcgtacccggtgtacccgctaaccggactacccacgcgttc

SEQ ID NO: 53990 - DNA, 713 bp, Homo sapiens
  misc_feature: GYAE6OF01D5N17.29.78.H01.1.454.CMB.1.raw
  modified_base (273)..(273): a, c, t, g, unknown or other
  misc_feature (273)..(273): n is a, c, g, or t
  modified_base (339)..(339): a, c, t, g, unknown or other
  misc_feature (339)..(339): n is a, c, g, or t
  modified_base (348)..(348): a, c, t, g, unknown or other
  misc_feature (348)..(348): n is a, c, g, or t
  modified_base (448)..(448): a, c, t, g, unknown or other
  misc_feature (448)..(448): n is a, c, g, or t
  modified_base (684)..(684): a, c, t, g, unknown or other
  misc_feature (684)..(684): n is a, c, g, or t
tcagatagagtactcacgaccggtgctcgatttagtgtgagtagtttgggtttggggtctgagagaggagtccaccctggatcttcaggttgttttcatttggtgatcaggacggaacagagagaactcaccatggtaggtttggctgagtcgtggtctttttcgtggtggtacttaagttttaaaaggtgtccgagtgtcgacgtgtcgtaggttggtggtacggtcggtcggggtccgccggtaggggttaccggggcccgggggggttcnccgtagacggtacctccgtcgtgttcgaccgtcctaggtggtaattttaggtttacggagttactntcggtaccngttacggaacgttcgggtcccgaccgtaacggtccgtaccggaaggggtaacgggtcgttagggacggtttcggtcgtacggcgtttagtacggtgacgnggtgggtcgtagtcgtatattacttaagtcgacgtagaacccgtcgtaggaaccggttccgtacctaacgtacttcgaagtacgtactaagtaaccgaacgactcgtattgtatccgtagactaagtcgaaggcttcgaggtactacgcgtaacgacggtacgttcgtatttagtcgttagtacggtaacgcgttagtcggtacggaaggtcccggaccggtctacgtgaacccgnggtccggacggaggtctcgtccgtaaccg

SEQ ID NO: 53991 - DNA, 812 bp, Homo sapiens
  misc_feature: GYAE6OF01BXQES.29.78.H01.1.454.CMB.1.raw
  modified_base (257)..(257): a, c, t, g, unknown or other
  misc_feature (257)..(257): n is a, c, g, or t
tcagatagagtactcacgaccggtgctcgatttagtgtgagtagtttgggtttggggggagagaggagtccacccctgggatcttcaggttgttttcatttggtgatcaggacggaacagagagaactcaccatggagttgggctgagctggtctttttcttgtggtacttaattttaaaaggtgtccagtgtgacgtgctaggttggtggagtcggtgggggccgtccggtgggggtaccggggccgggggggtcncgtggacgaccttccgtccgtggtcggccggtccttacgtgggttaattttaagggttttagggagtcagtcgacctagtacgacgtcgggtcccgaccgacggccgtacggaggggaggggtcgtgggagggtcggtccgtcggtacttagttagggtcgacgtggttgggtggcctattataagttattagtcgacgtacggaccgtcccggtaagggaacgggtcccgttacaccgttacttaccgaggtaactaactaacgttacgaacgtaacgacgtacgtagtactacgtacgaacgtaaagtaggagtacgacgtagacgtaccgtacgaaccgaccgtaccggtacgttacgttaagtttagttaggtttaacgtaaacgggtacggtaacggtacggttaaacgggtaaccggggtacccgggggaccccggggtaacccgttacggttaacccgggaacccggttaccggggaccgggggtacccgggtaaccggggggtacccgtaccgggttcccgggttccccgtacccggttaccccggg

SEQ ID NO: 53992 - DNA, 789 bp, Homo sapiens
  misc_feature: GYAE6OF01C4DBR.29.78.H01.1.454.CMB.1.raw
  modified_base (231)..(231): a, c, t, g, unknown or other
  misc_feature (231)..(231): n is a, c, g, or t
  modified_base (269)..(269): a, c, t, g, unknown or other
  misc_feature (269)..(269): n is a, c, g, or t
  modified_base (271)..(271): a, c, t, g, unknown or other
  misc_feature (271)..(271): n is a, c, g, or t
  modified_base (442)..(442): a, c, t, g, unknown or other
  misc_feature (442)..(442): n is a, c, g, or t
tcagatagagtactcacgaccggtgctcgatttagtgtgagtagtttgggtttggggtctgagagaggagtcccacccctgggatccttcaggttgttttcatttggtgatcaggacggaacagagagaacctcaccatggagtttggctgagcgtgtcgttttctaggtggtcttaaagttttaaaggtgtccagtgtgacgtgctaggttggtggagtcgtgggggccnccggtggggaccgggcggggggtcacgtgagctctccngngccgacctgtggtaatttaagttaggattacgatcgacctagtacgtacgtcggtacccgacgacggtccgtacggaacggggaacggggtcgtagggtcggtcgggtaccgtccggtaccgttagtagggtcgcgtaggtgggtcggctacttaattagttaacgttaanccggtacacgggaacccgttcccggaagggtaccgggtacccgtttaaccgaacccttacgttttaacgaacgtagaaacctacgtaacggtaaacgtaacctacgtacgttacgtacgtacgtcgtaacgaagtacggacgaacgtcgtagtaaccgtacgtaaccgaccgtaacctacccggttacttacgttaacgttcgttaaggttaacggtacggtaccggaggttacggtaccgggtaacgggtacccggggtacccgggtaaccccgttcggtacccgaacccggttacggggtaccgggtaaccggaggggtaacccgtcccgggtaacggtaccccg

SEQ ID NO: 53993 - DNA, 843 bp, Homo sapiens
  misc_feature: GYAE6OF01ER8CT.29.78.H01.1.454.CMB.1.raw
tcagatagagtactcacgaccggtgctcgatttagtgtgagtagtttgggtttggggtctgagagaggagtccacccctgggatcttcaggtgttttcatttggtgatcaggacggaacagagagaactcaccatggtagtttgggctgagcgtggtcttttcttgtggtcttaagttttaaaaggtgttccagtgtgacgtgctaggttggtggagtcggtgggggcgtccggtggggtaccgggccggggggtcgcgtgagactcctccgtgtcgccggtctcgtaggtaagttaaggtttacggagttacagtcgacgtagtacggtaacgtcgggtacccgaccgacggtacgtaccggaagggggaacggcggtgggtagggtcgggtcgttccggagttagttacggtggcgtaggtgggtcggcgtagtacgtattagttagtcgacgacgtaccggtaccgtagggtaaaccgggtcccgttaccgtaaccttacgtttaccgaaacgtacgaaaccgttaaacgtttaaccgaaaacgtaacctaacggtcgttaattacgtaccgttaaggtaacgtaaaggtcgggaaagtacgtcccgtaaggaaccggtacgaccggtaaccggaacgtacccggtcgttaacgtttaattttaacgggttaaggttaaaccgggtaaacggtcggtaacgttcgggtaaacgggtacccggggttaaccccgggggaccccgggttaacccggtccgtaaacccgggtaaacccggacccgggggttaaccgggtacccggggaaacccgggcccgggttccgttaccgggtacccccg

SEQ ID NO: 53994 - DNA, 650 bp, Homo sapiens
  misc_feature: GYAE6OF01BBYHX.29.78.H01.1.454.CMB.1.raw
  modified_base (244)..(244): a, c, t, g, unknown or other
  misc_feature (244)..(244): n is a, c, g, or t
  modified_base (270)..(270): a, c, t, g, unknown or other
  misc_feature (270)..(270): n is a, c, g, or t
  modified_base (527)..(527): a, c, t, g, unknown or other
  misc_feature (527)..(527): n is a, c, g, or t
  modified_base (648)..(648): a, c, t, g, unknown or other
  misc_feature (648)..(648): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgccaggctccaggaagggctggagtgggtctcggctattagtggcagtggtggcgctatatattatgcagacgcctgaagggccggttcacatttccaganactattcgaaagacacgctagattcngtcaaatcgagtaagcctgagactcgacgacacggtccgtctattattgtacgttaaagcgtaggctaggaagttaccgggaccggggccctattcggaccacgtcggggaccacgggggacgcgtacggtaccgaccgttcgaccttcgacgacccgtccaacccggaaccggcccgtaagtccggtaccctttcccccgtacgggtaccaccccgttcccaccgtaagaccgccaaccgtcgtacggggccaacncgtccaacgccgtcgggactcggcccttacggcgtaacgggaccttaccgttcccagttaaccgtacttaacgtcgtcgacggtccgggtacgtcgggcgtaacgggctccgattaccggncg

SEQ ID NO: 53995 - DNA, 215 bp, Homo sapiens
  misc_feature: GYAE6OF01BYKBR.29.78.H01.1.454.CMB.1.raw
  modified_base (147)..(147): a, c, t, g, unknown or other
  misc_feature (147)..(147): n is a, c, g, or t
  modified_base (205)..(205): a, c, t, g, unknown or other
  misc_feature (205)..(205): n is a, c, g, or t
  modified_base (211)..(215): a, c, t, g, unknown or other
  misc_feature (211)..(215): n is a, c, g, or t
tcagatagagtactcacgaccggtgctcgatttagtgtgagtagtttgggtttgggggcgcctggggtacggccgggggggtcgctgagactctcctgtgcggcctctggattaaagttttaggagtcatgccatgaactgggtccncaggctccgagggaaggggctgggagtgggtctcggctattagtggcagtgggtggcncttaannnnn

SEQ ID NO: 53996 - DNA, 811 bp, Homo sapiens
  misc_feature: GYAE6OF01AL7EU.29.78.H01.1.454.CMB.1.raw
  modified_base (186)..(186): a, c, t, g, unknown or other
  misc_feature (186)..(186): n is a, c, g, or t
  modified_base (315)..(315): a, c, t, g, unknown or other
  misc_feature (315)..(315): n is a, c, g, or t
  modified_base (412)..(412): a, c, t, g, unknown or other
  misc_feature (412)..(412): n is a, c, g, or t
tcagatagagtactcacgaccggtgctcgatttagtgtgagtagtttgggtttgggggcagggtgtacacctgtggttctcggggctgcctttggctttggagatggttttctcgatggggggctggggagggcttttgttggagaccttgcacttgtactccttgccattcagccagtcctggtncaggacggtgaggacgctgaccacacgggttacgtgccttggttgtaacctggccttcccgtcccggtcggtcttttggttccttgggctattatcggccaccctccgaccgtccgtaccaccgtaccngttcgacttcgacctcgagggttcttcggtcggcctacgaccgtcccaccaccgcgctagtacgtcgacccgttcggacggggttccggagactcgngtacggtagggttcgtttaccgggtttaggggggtttagggggaaacggtaggtaacggtaccggtccggaaccccgggttcccccggtagggtacgttcggtagggttacggtcggttcggggccggtaagggtccggggtacgtaggttcgggttagggttacggtttaagggttttcgtaaccgtaacgttaaggttaacgtttcggggtacctttaccggtttaaccttttcgtttaccggttacccgttacgggttttacgggtttgttcggttcgttcggggttctttcggtacgttaccgttcggttacgtttcggaggttaggttacggtttacgggttacggttcgggttaccgggtacggtacccgttacggtccggtgggtaccgggg

SEQ ID NO: 53997 - DNA, 763 bp, Homo sapiens
  misc_feature: GYAE6OF01C52Q2.29.78.H01.1.454.CMB.1.raw
  modified_base (734)..(734): a, c, t, g, unknown or other
  misc_feature (734)..(734): n is a, c, g, or t
tcagatagagtactcacgaccggtgctcgatttagtgtgagtagtttgggtttgggggcgcctggggtacggccgggggggtcgctgagactctcctgtgcggcctctggatttaagtttaggagtcatgccatgaactgggtccgccaggctccgagggaggggctggaggtgggtctcggtacttagttaggtggcaggttgggtggcgtctattattattagtgacagaccgccgtaggaacgggtccggttacaccttatttccgaagacgaactaagtacgaagaacctacggatacgtatcttaggactaaaggtggagacgcccgtaggaaccgacttaccggacgaaccggtcccgggtaacccggtttcttttaaagttttacgtttaggtttaacggttaaacggggcgtaacggtcggtagggaaaccgggttacccgggggaccccgggccgtacgttaccggacccggacggttaccgggggaccggtaggggaccgtcggtaccggtccgaccgttccgtacctccgaacgcccctaccgaccgtaccgggtcctacgtccgttccctcccgtcgccctacccgtcctaccgacgccgtctaccgtcggtcgggaccacgtacgcgacgcccggtacgggccgtccgtacgtacggtacgtaaccgtaccgtacctttaccgcgttaacccttgtaacgtccgtggacgggtcggtacgnggtaccggagacccgtagtaacgcgagcg

SEQ ID NO: 53998 - DNA, 852 bp, Homo sapiens
  misc_feature: GYAE6OF01EDJYU.29.78.H01.1.454.CMB.1.raw
tcagatagagtactcacgaccggtgctcgatttagtgtgagtagtttgggtttggggtccgagccatggtgcagactccccagagctctcctcctcctccactgcacaggtctctcctcccagcctgtgctgactcaagtccgccctcgtcgcccttcgtcgcccgttcccgtaggggacggtccgtcggtaccgaacggtcctaccgttgtactcgtagacgcgtaggtcggaaccagacgacgacgcctaaccgcctagtccgtcgttcggactacgtccgagacgacggaccggtaccgaacggaacccggtaacccggggtcccctttaacggtttaccgttacggtaagttaccgaacctaacggttaaccaaaacgtaagttcggtaacggtcggaaccgttacggtaaccgaacggtaagggaaccggggaacgggggtaccgtaccttaccggtacggtaaccgttccgtccttaccgtaccggtaacgttccgaccgtacgtccggtcggtaccggtaccgtcggaccgtcccgtacctaaccgtacctaacggtacccgttcccgacccgttaccctaccggttacgtacggtacggtaacggtacgtacgggtaccgtacgttaacgttacctttacggttacgtccggtacgtacggtaccgggtcggtacctcggtacgtacgtttacgttaccgggtacggtttaccggtaccgggggacccgttaaccggaccggttacccgtaccggttaccggtccgaacccggacccgaccccggtacccgtaccccaacccggttctaacccgtccttacccgttcccgttccccgtaccccg

SEQ ID NO: 53999 - DNA, 824 bp, Homo sapiens
  misc_feature: GYAE6OF01CHI97.29.78.H01.1.454.CMB.1.raw
  modified_base (144)..(144): a, c, t, g, unknown or other
  misc_feature (144)..(144): n is a, c, g, or t
  modified_base (282)..(282): a, c, t, g, unknown or other
  misc_feature (282)..(282): n is a, c, g, or t
  modified_base (347)..(347): a, c, t, g, unknown or other
  misc_feature (347)..(347): n is a, c, g, or t
  modified_base (821)..(821): a, c, t, g, unknown or other
  misc_feature (821)..(821): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccncaggctccgagggaagggctggagtggtctcggctagttagtggcagtggtgcgctatatattatcgcaacgccgtccctaggaacgggtcccggttcaacctatttccaagacgaacaagttcgaaagtaacacggnttagtatctaggactaaaagtggaagacgtctaggactacgtcgaaccgacgaccggtacccgtnttaacgtttagttagtaggttaaaacggcggaacgtcgtaacggaacgtaccggggaacccggggtaccgtaacgttacggaccgtaacgtcgggggaccgtaagggggaccgtcgtacggtaccgaacccgttctacccgtaacgacctccccgttacccgaaaccggaaccgggtaccccgtaacgttaccccggttacccgtttaccccccgtcggtaaccccgttacccctacccgttaacccgaaacgtaccggacccgtacccgttaccgggtaccgggggacctaaacgacggaccgtaacggccccggttacggggacccgtccgggtaccgtaccgggttaaacgtaaaccgggtacctttaaccgttacccgtaaggtacccgtttacgtaaccgttcgtttaaccggagggttcccggacggttaacggaccgttaacgggaccccgtagtaacctggtaacncgg

SEQ ID NO: 54000 - DNA, 763 bp, Homo sapiens
  misc_feature: GYAE6OF01ASR5W.29.78.H01.1.454.CMB.1.raw
  modified_base (716)..(716): a, c, t, g, unknown or other
  misc_feature (716)..(716): n is a, c, g, or t
  modified_base (747)..(747): a, c, t, g, unknown or other
  misc_feature (747)..(747): n is a, c, g, or t
  modified_base (763)..(763): a, c, t, g, unknown or other
  misc_feature (763)..(763): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaacgtgggtcccgccaggctccgaggggaaggggctgggaggtgggtcgtcggctattagtggcaggtggtggcgctatattattatgcgagcgcctggacgggccggttccacctatttccgagagactaattcgatacgaacacgcttgtatcgtagacgaaagtggagcgcgtagacgacgtaccgaacgaaccgaccggtccgttacttagtttagttaggttacggtttaaaggacggtagtaccgtaagggtaacgggtaaccccgggggacccgggggtaccccgttaccggtttaccgaacccgaccggggtacggggacccgggaacgggggacggtcggtcggtcccgtaccccgttccctccctccgaccgccctacccgaaccgaccgggccctacgttcccgttaccccttccccgccgcccctaccccgtcccaccgacggacctaccgcccgttccggggacggtccgaacgtccgtaccgacccggcccgggttcggcccgttcggtaccgttcggtaacccgtacgtaccccgttacgttcccgtaagttacccttacgttccgngtacgggcccgggtggtaccgacgggtacgnggtacccgactagcgn

SEQ ID NO: 54001 - DNA, 609 bp, Homo sapiens
  misc_feature: GYAE6OF01D4R76.29.78.H01.1.454.CMB.1.raw
  modified_base (338)..(338): a, c, t, g, unknown or other
  misc_feature (338)..(338): n is a, c, g, or t
  modified_base (385)..(385): a, c, t, g, unknown or other
  misc_feature (385)..(385): n is a, c, g, or t
  modified_base (400)..(400): a, c, t, g, unknown or other
  misc_feature (400)..(400): n is a, c, g, or t
  modified_base (607)..(608): a, c, t, g, unknown or other
  misc_feature (607)..(608): n is a, c, g, or t
tcagatagagtactcacgaccggtgctcgatttagtgtgagtagtttgggtttgggggcgcctgggtacggccgggggggtcgctgagactctcctgtgcggcctctgtattaagttttaggagtcatgccatgaactgggtccgccaggctccgagggaaggggctgggagtgggtctcggctattagtggcagtggtggcgctatatattatgcagacgccctgaagggccggttcaccatttccagagacaagttcgaagaacacgctgtatctgacaaaatggagacgcctagagactcgacgacacggccgtctattattgtagttaaagcgngctggaatacgggaccgggccactgaccacgtggggcccaggggacncgtggtccaccgtcncctcacgcctccaaccgaggacccagtccggtccttcccccgtggtaccaccctctccaacgacgtccaccgtcgtacggggccacgacgcacgccctgggctacggcctaggtcgaacggcttacccttaccgacggttacctacgttaactccgttagggaccggccgggtccgttacgggaccgtaacgggcgacctagtacgnng

SEQ ID NO: 54002 - DNA, 789 bp, Homo sapiens
  misc_feature: GYAE6OF01D7ISA.29.78.H01.1.454.CMB.1.raw
  modified_base (263)..(263): a, c, t, g, unknown or other
  misc_feature (263)..(263): n is a, c, g, or t
  modified_base (785)..(785): a, c, t, g, unknown or other
  misc_feature (785)..(785): n is a, c, g, or t
  modified_base (787)..(787): a, c, t, g, unknown or other
  misc_feature (787)..(787): n is a, c, g, or t
  modified_base (789)..(789): a, c, t, g, unknown or other
  misc_feature (789)..(789): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtcccgaccaggcctccgaggggaaggggctggagtgggtctcggctagttaggtggcaggtggtggcgctatatattatgcagaccgccctggaacgggtccgttcacctacttccgaaganacgtaattaccgaaagaaccacgtctagtactcgtcgaacaacgtggaagacgcctagggacgtaccgtacggaaccggaccaccgggtccctatttaacgttacgtttggtaaggtttaaacggcgaacggcgtaagggtaaaccggtaaccggggacccggggtaccccgtagttaccggaaccgacggtaccgggggaccgacggggaccggtcgtacggtacccgtaacccggtccctaccgtacgaccggtcccctaacccggtaacccggtaaccgggaccccgtacggttcccccggtttccccgttccccccggtccggtacccccctacccctaccccgtaaccgaaaccggccgtacccgtaccccgtccgggtcgggaccctaacggaccgacccgtaccgggtcccgtacggggtccctcgggtcccgttagtaccggaaccggtaccttccgtacccgttatacccgttactagtcgtaggcggtccggcgtacggcgaacggccagangngn

SEQ ID NO: 54003 - DNA, 849 bp, Homo sapiens
  misc_feature: GYAE6OF01AOBPW.29.78.H01.1.454.CMB.1.raw
  modified_base (848)..(848): a, c, t, g, unknown or other
  misc_feature (848)..(848): n is a, c, g, or t
tcagatagagtactcacgaccggtgctcgatttagtgtgagtagtttgggtttggggggcgcctggggtacgggccggggggggtcgctgagactctcctgtgcggcctctggattaagttttaggagtcatgccatgaactgggtccgccaggctccaggggaaggggctgggagtgggtctcggctattagtggcagtggtggcgctatatattatgcaggaccgtcccgtaggaacggggtcccggttaccaaccgtacttttacccgaaggtaacggtaacctaaagtttaccggaaaaggtaaacccaaccggtccttaggttaacttccgttaggacctaaaaggtgggaaggtacggtcccgtaggaacggtaccgtaccggaaccgaaccgaccgggtcccgtttacttaagtttacgttggttaaggttaaacgggcgaagtcgtaggaacggtaccgggggacccgggtccgtacgttcgaccgtacggtacgggggaccgagggggaccgtcgtcggtccgacccgttctcccgtaccgacgtcccctacccgaaccggtaaccgggccctacggttcccggttacccctttccccccggtcggtacccctaccccgttcccgtaacccgaaacggccgtacccgtacccggtccgggtacgggggaccctaaccggacggacccgtacccgggtccccggtacggggttacccgtccggtacccggttaccgggtaccgtaacgggtacccttaccgttacccgtaccgtttacctacgttacgtccggtacgggacgggtccgggcgtcgggacgtaaccgggccgactagtcgnc

SEQ ID NO: 54004 - DNA, 712 bp, Homo sapiens
  misc_feature: GYAE6OF01B2DM6.29.78.H01.1.454.CMB.1.raw
  modified_base (226)..(226): a, c, t, g, unknown or other
  misc_feature (226)..(226): n is a, c, g, or t
  modified_base (301)..(301): a, c, t, g, unknown or other
  misc_feature (301)..(301): n is a, c, g, or t
  modified_base (353)..(353): a, c, t, g, unknown or other
  misc_feature (353)..(353): n is a, c, g, or t
tcagatagagtactcacgaccggtgctcgatttagtgtgagtagtttgggtttgggtccgagccatggtgcagactccccagagctctcctcctccactgcacagggtctctctcccagcctgtgctgactcaatccgccctctcgcctctcgccctcccgtgggaggctcggtcaaggtcacctgtactctgagcaggtcggacacagcagctacgccatccgtnttggctatcgagcgaggacggccaaggtaccgaccgggtcccttagttacttagagtacgaacgtagtaacaaanaacgtgaagtcgctacgtacacgaaggacgggaacggggtaccgctacccgngtaccgtcgtcttacgtcgacgtcctaccgtgtccgtcgtcggggtacctggtaccggtaccaccctttaccaaccgtaacgaaccgttcccgtaccccggaaccttccgtagttccgtaagggagtacggtacggtaaccggtacgttaacgttaacgtttaacgttccgttacgtccggaaacccggtcgggtacggggtaaccacggtttcggtacctacggtacccggtacgttaccgggtaccggggaaccggtaaccgtaaccggtaccgtaccgtccggtaccgtcggaacccgaccgtacccgggacccctaaccgtacgtcgtactaccgcccgttccgccccgttcccg

SEQ ID NO: 54005 - DNA, 860 bp, Homo sapiens
  misc_feature: GYAE6OF01CB9T0.29.78.H01.1.454.CMB.1.raw
  modified_base (144)..(144): a, c, t, g, unknown or other
  misc_feature (144)..(144): n is a, c, g, or t
  modified_base (850)..(850): a, c, t, g, unknown or other
  misc_feature (850)..(850): n is a, c, g, or t
  modified_base (855)..(855): a, c, t, g, unknown or other
  misc_feature (855)..(855): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactggtccncagctccgagggaagggctggagtggtcgtcggctagttagtggctaggtgggtggcgtcttaatattatttatcgacaggaccgcccgtaggaacgggtcccgttaccaccttactttccgaagacaactaattacgaaagtaacacgcttcgtactcgtagacgtaagttgggaagaccgaccgttagaacgtacgtaccggaaccgaccgcggtacccgttattactttagttaggttaacggtaaacggcggtaacggtcggtaagggtaaaccgggttaacccgggggaccccggggtccccgttaacggttaccggaacccggtacgggtaccgggggacccgggtaacgggggacccgtccggttcgggtacccgtaaccccggtttcctcccgtacccgtaccggtccccctaacccgaacccgggaacccgggtaccccgtacccgtttccccgggttcccccgtttaccccccgtcccggtcccccgtaacccccgttcccgtaacccgtacggaacccgtcccgtaacccggtccggtaccggggaccctaacgacccgtccgaccgggtcccggtcgggtcccgtaccgggttaccggtacgtaaccggtaaccgtaccgtttaacccgtccgtaacgttacccttacttcgtacgtcggaccgggttcggacgtacggacggtacgacgtacngttgngtacg

SEQ ID NO: 54006 - DNA, 248 bp, Homo sapiens
  misc_feature: GYAE6OF01D17OT.29.78.H01.1.454.CMB.1.raw
  modified_base (148)..(148): a, c, t, g, unknown or other
  misc_feature (148)..(148): n is a, c, g, or t
  modified_base (218)..(218): a, c, t, g, unknown or other
  misc_feature (218)..(218): n is a, c, g, or t
  modified_base (243)..(248): a, c, t, g, unknown or other
  misc_feature (243)..(248): n is a, c, g, or t
tcagatagagtactcacgaccggtgctcgatttagtgtgagtagtttgggtttgggggcgcctggggtacggccgggggggtcgctgagactctcctgtgcggcctctggtatttaagttttaggagtcatgccatgaactgggtccnccaggtctccgagggggaagggctgggagtgggtcgtcggtctagttaggtggacaggtgggtggccgtntatatattatgcagaccgcccgtannnnnn

SEQ ID NO: 54007 - DNA, 896 bp, Homo sapiens
  misc_feature: GYAE6OF01BAH17.29.78.H01.1.454.CMB.1.raw
  modified_base (217)..(217): a, c, t, g, unknown or other
  misc_feature (217)..(217): n is a, c, g, or t
  modified_base (892)..(892): a, c, t, g, unknown or other
  misc_feature (892)..(892): n is a, c, g, or t
tcagatagagtactcacgaccggtgctcgatttagtgtgagtagtttggggtttgggggcgcctggggtacgggccggggggggtcgctggagactctcctgtgcgggcctcgtggattaagttttaggagttcatgccatgacgtggggtcccgccaggccgtccgagggggaagggggtctgggaggttggggtctcgggtcttagttaggtggngaggttggggtggcgtcttattaattatttactgcaaggtaccgcccgtagggaacgggtccggttcaccctactttccgagacgtactattacgaaaggaaccacgcttgtactcgtagactaaagtgggaagacgtcctaggaacgtcgtaccgaccgaaccggaccgggtccttcttaacgttttgttggttaacgggtaaagggtcggtacggtacggttaagggtaaccgggtaacccgggggggtacccgggtacccggttacggttagaccccggtaacggtcgggggaccggacggggggtccgtcggttcggtcccgtacccggttctccccgtttacggaaccgtccccggttaccaacccgggtacggggtacccgtaaccgggttcccggttaccccctttccccccgggttccgaccccgtaccccgttacccctaaccgtaaccggaccgtaccccgtacccggttccggggtaccgggtaaccctaccggaaccgcccgggtaccggtccccgggttcggcccggttacccggttaccgggtacggttaacccggtaaggtacccgtttaacccgtacggttacccgttacctttcggtaccgtttacgggcgtaccgggggccggttcggcgggtaacgggtaccgacgtacgtagtcnggtc

SEQ ID NO: 54008 - DNA, 768 bp, Homo sapiens
  misc_feature: GYAE6OF01CYCPT.29.78.H01.1.454.CMB.1.raw
  modified_base (408)..(408): a, c, t, g, unknown or other
  misc_feature (408)..(408): n is a, c, g, or t
  modified_base (445)..(445): a, c, t, g, unknown or other
  misc_feature (445)..(445): n is a, c, g, or t
  modified_base (527)..(527): a, c, t, g, unknown or other
  misc_feature (527)..(527): n is a, c, g, or t
tcagatagagtactcacgaccggtgctcgatttagtgtgagtagtttgggtttggggtccgagccatggtgcagacctccccagagctctcctcctcctccactgcacgacgggtctcctctcccagtcctgtgctagacctacaacgtccgcccttctcgcctcgtccgtccctccggtaggggcgtcgtaccggtacgtaacggtcctaccgttgtacctacgcgacgacgtaggtacgacaacgacggcacggtaccgtacgacctacgtcgtcgtggcctagcgacggacgacgacggaccacggacccgtaccggtccctttagtacgtacgagtacgaactacgaaccaagagttacggagtcgacgtaacacgaacggacgggaacgggacggggtaaccncgtaccgatacgtcctcgtacctcgttacgccgtacncggtccgtacggcgtccgacgcgtcctacctataccgactaccgtccacccggtactacggtcgacggaggtagttaaccgnggtaccggttactaacggttaccttaacgtacgttcccgggaacgtacccgggtacgggtccgttaacgtacggttacgtaccgtttaccggtaccgggttacggttaccccggtacgggggtaaaccacccggtttccggaccgtttaccgggacgtcccgggtaactacccggaaaccccgtcccggaaccccttacgggttcgaaccttccgtaccccttcgttcccccggttacccc

SEQ ID NO: 54009 - DNA, 918 bp, Homo sapiens
  misc_feature: GYAE6OF01B3NAV.29.78.H01.1.454.CMB.1.raw
tcagatagagtactcacgaccggtgctcgatttagtgtgagtagtttgggtttgggggcgccgtgggtacgggccggggggtcgctgagactctcctgtgcggcctctggtatttaagttttaggagtcatgccatgaacgtgggtccgccaggctccgaggggaaggggctggagtgggtctcggcttattagtggcaggtggtggcgtctatattattatgcagacgcccgtggaacgggtcccggttacacctatttccaagagaactaattacgaaagaaccacgacttagtattctgaactaaagtaggagtacgcctagacgtacgtaccggaacgaaccggtaaccgggtccgttactttaagtttaacgtttagttaacggttaaaggtacgacggtacgttaagggtaaaccggtaaccggggtaccccggggacccgttaacgttacggaaccgtaacggtacgggggaccgtaagggggaaccgtcgtacggtaccgacccgttccgttaccctacgacgtccccgtaaccgacccggtaaaccgggaccccgtacgttacccgggttccctttaccccccggtacggtaccccctaaccccgttaccgtaacccgaacggtaccggtacccttacccggttacccgggtaaccggggggacctaaaccggaccggtaacccgggtaccgtacccccgggttacggggtaccgtttccgggtttaccggttacgggtaacgttaaacccgggttaccctttacccggtttaaacccgttaacggtttaaccgtttaaccggttttaccgttaaccgggtttaagggccgggggttacccggggtacccggtttaaccgggaacccggttaaaccggggaccggtaaaccgtttaaggtagtaacggc

SEQ ID NO: 54010 - DNA, 735 bp, Homo sapiens
  misc_feature: GYAE6OF01BNH23.29.78.H01.1.454.CMB.1.raw
  modified_base (732)..(732): a, c, t, g, unknown or other
  misc_feature (732)..(732): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccgaggggaaggggctggagtgggtctcggctattagtggcagtggtggcgctatatattatgcagacgccctaggaacgggccggttccacctactttccagagactaattcgaagaacacgctagtatctgacaaagtggagagcctgagactcgacgacgaccggtccgtcttattagttaggtaggttaaaggcgagtcgtagggtaacgtaccgggggacccggggcccgacgttcgaccgtacgtcgggggaccgacgggggaccgcgtcggtccgtacccggttcctacccgtcacgtcccctacccgaacccggaacgggaccccgtacgttccggttccccttccccccgtcggtcccctacccctcccgtaccaaccggacgaccctacccgttccggaccggggtaccaccgaccgtaccgaccggtcccggtcgggtaccgtccgggtacccgttacgggtaaccgtaaccggtacccgttaaccgttccgtaaccgttaccgttaccgttacgtccggtacgggacgggtccgggacgtcgggaacgacgggaccgacgacggtagngcg

SEQ ID NO: 54011 - DNA, 765 bp, Homo sapiens
  misc_feature: GYAE6OF01C61IZ.29.78.H01.1.454.CMB.1.raw
  modified_base (95)..(95): a, c, t, g, unknown or other
  misc_feature (95)..(95): n is a, c, g, or t
  modified_base (173)..(173): a, c, t, g, unknown or other
  misc_feature (173)..(173): n is a, c, g, or t
  modified_base (179)..(179): a, c, t, g, unknown or other
  misc_feature (179)..(179): n is a, c, g, or t
  modified_base (195)..(195): a, c, t, g, unknown or other
  misc_feature (195)..(195): n is a, c, g, or t
  modified_base (578)..(578): a, c, t, g, unknown or other
  misc_feature (578)..(578): n is a, c, g, or t
  modified_base (587)..(587): a, c, t, g, unknown or other
  misc_feature (587)..(587): n is a, c, g, or t
  modified_base (635)..(635): a, c, t, g, unknown or other
  misc_feature (635)..(635): n is a, c, g, or t
  modified_base (737)..(737): a, c, t, g, unknown or other
  misc_feature (737)..(737): n is a, c, g, or t
  modified_base (750)..(750): a, c, t, g, unknown or other
  misc_feature (750)..(750): n is a, c, g, or t
  modified_base (758)..(758): a, c, t, g, unknown or other
  misc_feature (758)..(758): n is a, c, g, or t
  modified_base (760)..(760): a, c, t, g, unknown or other
  misc_feature (760)..(760): n is a, c, g, or t
  modified_base (763)..(765): a, c, t, g, unknown or other
  misc_feature (763)..(765): n is a, c, g, or t
tcagatagagtactcacgaccggtgctcgatttagtgtgagtagtttgggtttggtggtctctctcccagcctgtgctgactcaactccgccctntcgccttctcgccctcccggtggggcggtccttcgggactaaggtccaccttgtacctcgtgacgacaggtcgaacangctacnccgtaacgctgtccgnttcggactactacgacgacgacggacgaccgaacggtacccgtccgggtacctttacggttataggactaggacctaacgtaacaaactggtaacgtgcggactaagtacccgaaggaacgggtaacgggggaacggggtaccggtaccttacccgggtattaccggtccgttaacccggttttcaaccgtacggttccccaaccggttacggtccgtttaaccgggccggttaccgaacgggttccacccctaacccttaacgcccgttaacgtacccgttacccggcccctttacgaccgtacggttcgaaggcgtaccgtagggtacctacttaacggacttttaaccgcgtacgaccggttaacggcggtagtaaccgngttaccgtntaacgtttggaccgggttacccggaagggaccggtaccgccggttacnccggttccggacctaacgaccgtaccccaacgtaccactcgtacctacgtcctaacctcccggtacctcgaccttacgtcgttcacgtcgtggccgtaccgngtaccggctacgngtaacgtnancgnnn

SEQ ID NO: 54012 - DNA, 677 bp, Homo sapiens
  misc_feature: GYAE6OF01BQG1Z.29.78.H01.1.454.CMB.1.raw
  modified_base (593)..(593): a, c, t, g, unknown or other
  misc_feature (593)..(593): n is a, c, g, or t
tcagatagagtactcacgaccggtgctcgatttagtgtgagtagtttgggtttggggtccgagccatggtgcagactccccagagctctcctcctcctccactgcacagggtctctctcccagcctgtgctgactcaatcgccctctgcctctgccctccgtgggagctcggtcaaggtccactgtactctgagcagtgacacagcagctacgcatcgcttggcatcagcagacgcagaccgcggccttagttactgatgaacacgtacaactatgagtcggactagtaccaacgacggacgggaaggggaccgtacgttcccgtagtaccgttacgttcttaccgtacgtacgttcctacgtacgttccgtcggtacgggtcctagggaccgtaccgtaccttaacccgtacaaccgttacgtcccgttaccccggtaccttaccgtacggtttcgaagggaaacggttcgtagggaccgttcgtaacgttaaccttacgtttacgtacggtaccgtaacgggtaccggtggtaaccgtacgttggaccttacggttacgtacccgggttacggtaccgggaccggtaaccncgggttccctagggttccgtacggaccaccggacccgaacgtacccctacgtacttacccgacttaccttccggtccctccccg

SEQ ID NO: 54013 - DNA, 692 bp, Homo sapiens
  misc_feature: GYAE6OF01C4WKK.29.78.H01.1.454.CMB.1.raw
  modified_base (95)..(95): a, c, t, g, unknown or other
  misc_feature (95)..(95): n is a, c, g, or t
  modified_base (350)..(350): a, c, t, g, unknown or other
  misc_feature (350)..(350): n is a, c, g, or t
  modified_base (356)..(356): a, c, t, g, unknown or other
  misc_feature (356)..(356): n is a, c, g, or t
  modified_base (638)..(638): a, c, t, g, unknown or other
  misc_feature (638)..(638): n is a, c, g, or t
  modified_base (647)..(648): a, c, t, g, unknown or other
  misc_feature (647)..(648): n is a, c, g, or t
  modified_base (652)..(652): a, c, t, g, unknown or other
  misc_feature (652)..(652): n is a, c, g, or t
  modified_base (657)..(657): a, c, t, g, unknown or other
  misc_feature (657)..(657): n is a, c, g, or t
  modified_base (659)..(659): a, c, t, g, unknown or other
  misc_feature (659)..(659): n is a, c, g, or t
  modified_base (669)..(669): a, c, t, g, unknown or other
  misc_feature (669)..(669): n is a, c, g, or t
  modified_base (672)..(672): a, c, t, g, unknown or other
  misc_feature (672)..(672): n is a, c, g, or t
  modified_base (677)..(677): a, c, t, g, unknown or other
  misc_feature (677)..(677): n is a, c, g, or t
  modified_base (683)..(684): a, c, t, g, unknown or other
  misc_feature (683)..(684): n is a, c, g, or t
  modified_base (687)..(687): a, c, t, g, unknown or other
  misc_feature (687)..(687): n is a, c, g, or t
  modified_base (691)..(691): a, c, t, g, unknown or other
  misc_feature (691)..(691): n is a, c, g, or t
tcagatagagtactcacgaccggtgctcgatttagtgtgagtagtttgggtttgggagctcggtcaaggtcacctgtactctgagcagtggacanagcagctacgccatcgcttggcatcgagcagaggaccagtaccgaccggggtcccttacgtttacttgagtacgactagtaccaaagtaatggagtgcgtagtaccaagaggacgggaaacggggggtacgtaccgtcccgtagtacgttccgtacttctaccgtcgtacctacctacggtccgttacggtccggggtactacggacgtccgaccttaccgactaactacctccggttcccgaccttacgcgtgnggaagngttggacgtccgtattacgttaacgtccgttcgacggtaaccgggtacgggtccggtaacctcgttaaccgggtcttaacggttaccgggtcggttacccgggttaacggggaaccccggtaacgtacggtacccgttacggggtcgtacggaccgacccgtaccgaacggtcccctacgacgttctcctcgtcctcccgtaccctaccgtactacgtacgtacttctacggtcggtacggtacggccgggtacggaccggtacggacggtacgacttacgngactcgacnncgtntgctnancgtgcgcgtnacnctacncgtatnnatngtgng

SEQ ID NO: 54014 - DNA, 767 bp, Homo sapiens
  misc_feature: GYAE6OF01BTHSC.29.78.H01.1.454.CMB.1.raw
  modified_base (635)..(635): a, c, t, g, unknown or other
  misc_feature (635)..(635): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtgcgctatatattatgcagtaccgccctaggaacgggtccggttcaccgtatttccagagacaattcgaaagacacgtctagtatacgtcgactaaagtggagacgccgtagacgtacctcggaaccgaccgaccggtccgttactacttttagttggttaagttaaacgggcgaaggtcgtacgggaaacggtaccggggaccccggggtaccgtacgttccgaacctcggcgggaccggtaggggaccgtcgtaccggtacctacccggtcctacccgtacgaccgtccccgtacccgacccggtaaccgggacccctaacggttccccggttaccccgttccccccgtacggtacccccgtaacccccttcccgtaaccgaaacggtccgtaacccgtaccgtacccgggttccgggggactaacccgtacggacncccggacccggtgggtccgtccggtaccgtcggtaacgtacggtacttaccgtccgtacttccgtaccgttcgtacgttagggacggtcgggtacggaccggtacggaacgggccgtacaggtaccgtggac

SEQ ID NO: 54015 - DNA, 776 bp, Homo sapiens
  misc_feature: GYAE6OF01EG56J.29.78.H01.1.454.CMB.1.raw
  modified_base (369)..(369): a, c, t, g, unknown or other
  misc_feature (369)..(369): n is a, c, g, or t
tcagatagagtactcacgaccggtgctcgatttagtgtgagtagtttgggtttggggtccgagccatggtgcagactccccagagctctcctcctcctccactgcacagggtctctcctcccagcctgtgctgactcaatccgccctctgccttctgccctcccgtggggacgctcggtacaaggtccaccttgtactcgtgagcagtcgacacagcagcctacgcctagtcgcgttggacatcgaagcgaggacggaccgacgaaccgacccgggtcccttacgttactgatacgacacgtacaactatgatcggactacgtcagtacggacgggaacggggtccgactcccgtagtcgtcgtcttcncgtacgtcctcgagtccgttacggtacgggccctaggaccgtcccgtacctacccgttaccgaaccgttaaccgttccccgtccccggtaccttaccgtacggtttccggtaggaaccggtacgtacgggtaaccgggtaccacgtttaaccgtttagtttaaccgtaccggtacctaaccgggtcccgggttcgggaccctacgggttcgaaccgtttacggttaccggttacggggttcccgttaacccgggggaccccggggtaacgtaccgggttccccggtaccgggtttcggtaaccccggtccgaaaccccgggtccccgtaaaaccccgaccccgttaaaccccccgtggtttacccgtaccccgttacccggtttcccctaacccgggtttccccccc

SEQ ID NO: 54016 - DNA, 795 bp, Homo sapiens
  misc_feature: GYAE6OF01BVQ8E.29.78.H01.1.454.CMB.1.raw
  modified_base (242)..(242): a, c, t, g, unknown or other
  misc_feature (242)..(242): n is a, c, g, or t
  modified_base (436)..(436): a, c, t, g, unknown or other
  misc_feature (436)..(436): n is a, c, g, or t
  modified_base (444)..(444): a, c, t, g, unknown or other
  misc_feature (444)..(444): n is a, c, g, or t
tcagatagagtactcacgaccggtgctcgatttagtgtgagtagtttgggtttgggagagctcgtggggagtctgcaccatggctcggaccccactcctcttcctcgaccctcctcctccactgcacaggtctctctccagcctgtgctgactcatccgcctctgcctctcgcctccgtgggagcgtcggtcaaggtccacctgtactctagacgcgagtcgacaccgagtcacgccgtacnccgtcgtcgtcgtacgcagtaccgagaccgacggaccgacgacgacccggtaccgtcctacgttacgtagtacactaaccgactacctaaaggtgtacggtacggtacgacgtacggacgaccgggaacgggtaacggggaaccggggtaccgtccgtactaccggtactcggttaaccttcgaccgttccggntacccggntcccggtacgtcgggacccgtttacgaccgtacccgtaccttacccgtaacccgtaccgtccgtcccccgttaccggttacccgtaccgttaccggtagtacgggtaaacgttcgtacggtactacgttacgtaacgtttacgtaccggttacgtaccggtaccggtaccgggtacggtacggttacggaacggtcccgttacgggtacccgttaccgggggtaacccgttacccgggggtaaccggtaccccgggttaaccggttccccggaacccgggttacccgttaaccccgggtcccaaacccgggtaaccccggtaacccgtacccccggtacgtttacccccgg

SEQ ID NO: 54017 - DNA, 928 bp, Homo sapiens
  misc_feature: GYAE6OF01DT26L.29.78.H01.1.454.CMB.1.raw
  modified_base (924)..(924): a, c, t, g, unknown or other
  misc_feature (924)..(924): n is a, c, g, or t
tcagatagagtactcacgaccggtgctcgatttagtgtgagtagtttgggtttggtggtctctctcccagcctgtgctgactcaatcgccctctgcctctcgcctcccgtgggagctcggtcaaggtcacctgtacctctgagcaggtggacacagcagctacgccatcgcttggcatcagcagagccagaccgaccggccctgttactggatgacagtacaaacagtgagtcgcagtcacgaggacggaaagggggacgtactccgtagacgtcgtccttcgtactacgttcctccgacgtccgtcggtacgggtccgtggacgtccggtactacctacaacctaacgttcccgtaccccggtcctaccgtacggtacgtagggtaacgggtacgtagggtaccggttacgttaacgtaacgtttaaccgttttacgggtaccggtttaccggaaaccgggttacccgggttcgggggtaacccttaacggggttaccggttacccgttaaccgggttttaacgggttaaccccgggggttttaacccggggttaacccccggggggtaaaaccccgggggttaaaccgggttaaccccggggtttaccccgggtaaccccgggtttacccggggtttccccggggtaacccggtaaccccccgggtaaccccgggtaaacccccggtaacccccccgttaaacccccgaccggtttacccgtttaaccccgttaacccgtttcccccggtttttacccccggtttaccccccccttaaccccgtttacccccggttaaccgttaacccctttaacccgttcccgtttacggtaccccggtttaccgggggaccggggttccccggttaacccgggacgggtaaacccgggaccggtacccgtttaaacggacgttaacggcncgcg

SEQ ID NO: 54018 - DNA, 788 bp, Homo sapiens
  misc_feature: GYAE6OF01EO5QG.29.78.H01.1.454.CMB.1.raw
  modified_base (215)..(215): a, c, t, g, unknown or other
  misc_feature (215)..(215): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccgaggggaagggctgggaggtgggtctcggctattaggtggcagtggtgcgctatatattangcagaccgccctaggaacgggccggttacaacctactttaccagacgactaaacttacgaaagaacacgtctagtactcgtagactaaaagtgggacgacgccgtgaacgtacctaccggaacgaccgaccgggtccttacgttaagtttagtttaggtaagggttaacggacgtacgtacggtacggtaaacggtacccgggggacccgggtacccgtacgttacggaacctacgggtcggggaccgacgggggccgtacgtcggtacctacccggtccttacccgcgaacctccccgtaacccgaacccggtaccgggtccctaccgttcccggttaccccttcccccgtcggacccctacccctcccgtaaccgaaaccgccgtacccgtaccggtccgggtacggggaccaaccggaccgaccgtccggccccggttggccccgtcggttacccggttacgtaacggtaaccgtaccctttaccgtaccgtacgttaccgtaccttacgtcgtaacggccgggtcggtaccgtcggaaccggtaccgggactaccgtaagtcggctacg

SEQ ID NO: 54019 - DNA, 849 bp, Homo sapiens
  misc_feature: GYAE6OF01CTAKA.29.78.H01.1.454.CMB.1.raw
tcagatagagtactcacgaccggtgctcgatttagtgtgagtagtttgggtttgggggcgcctggggtacgggccgggggggtcgctgagactctcctgtgcggcctctggatttaagttttaggagtcatgccattgaacgtgggtccgcaggctccgagggaagggctgggaggtgggtctcggcttattaggtggctaggtgggtcggcgtctaattattattacgtgacaggaccgcccgtaggaacggggtcccggttaccacctatttccaagacgacaattcgaaagacacgtctgtaactcgtgaacgaaagtggtagacgtccgtagaacgtaccgtaccggaaccgaccggtacccggtccgttactttaattagttcggtaaggttaaacggccggtaagcgtaagggaaccggtaccggggacccgggcctacgtcggacctcggtcggggaccggacggggacgtcgtacggtccgtaccgttcctccgtacgaccgtaccctaacccgaccggaaccgggtacccgtaccggttcccgggttcccccctttcccccggtccggtaccccttaccccccgttaccctaacccgaacggtacccgtaccctaaccccggttccggggtccggggacctaacccggacggaaccccgtcccgggtcccgggtcgggttcccggtacggtacccgttcgggttaaacccgtaacggttcccctttaaaccggttcccgtaaactttacccgttaccgttacgtaacccgggttgggaacccgggtccgggggttacctacgggtaccgggaaccgggctaaccggtaggtaccgtgcgg

SEQ ID NO: 54020 - DNA, 863 bp, Homo sapiens
  misc_feature: GYAE6OF01CUGQ4.29.78.H01.1.454.CMB.1.raw
  modified_base (858)..(858): a, c, t, g, unknown or other
  misc_feature (858)..(858): n is a, c, g, or t
tcagatagagtactcacgaccggtgctcgatttagtgtgagtagtttgggtttggtggtctctcctcccagcctgtcgctgactcaaatccgccctctgcctcgtcgccctcccgtgggacgtccgtcggtcaaacggtcctaccttgtaacctctaggacgactaggtcggaacaaccgagccgaacgtcccgtacccgccacgttccggtccgtttacgggcaacttccgacgaacgacggtacggaccccgaacggtaacccggtacccgggcccccgttttacgtttaaccgtttggaacgttaccggaacctaacgttacctaaaacgtaagtcgtacgtacggacctaacgtccgaaggacgggaccggggtaaacgggggacccgggtcttaccccggtgttaaccgtcccggtttcttacgtaccgaccgttccgtaccgacgtccgttaccggtcggggtaccacggtaccgccgtaacccttccgacctaaccgttaccgcccctttaccgcccgttagtaccggttagtaagggaacgttacggtacggaccgttcgtaacggtttaacctttacgtacggtttacgaaccggtaccggttaccggacggtactacgggtacgtacgttacgtaccgtaccggggttaccgtaacccgggggaacgtaccggtaccggtccgttaccggtaccggttaccgtaccggacccgacccgtacccgaacccgaacccgtacgtaccggtacccgttacttcccgtaccccgtcccttacccgtctaccgtctccgtaccgtcgttacggtaccgcggacggtcgaccgtacgacggtcgacgtaacgtcngtcga

SEQ ID NO: 54021 - DNA, 916 bp, Homo sapiens
  misc_feature: GYAE6OF01AIPHL.29.78.H01.1.454.CMB.1.raw
  modified_base (200)..(200): a, c, t, g, unknown or other
  misc_feature (200)..(200): n is a, c, g, or t
  modified_base (912)..(912): a, c, t, g, unknown or other
  misc_feature (912)..(912): n is a, c, g, or t
tcagatagagtactcacgaccggtgctcgatttagtgtgagtagtttggggtttgggggcgcctgggtacggccggggggtcgctgagactctccgtgtcgcggcctctggtatttaagttttaggagtccatgcccattggaactcgggtccgcaggctccgagggaagggtctggagtgggtctcggcttattacggnggcacggttgggtcggcgacttatacttaagttaagtcgccgacgtaccgtcccgttgggaaacgggtcccggttaccaccggtactttacccgaagtaacgaacgtaaagttaccggaaaagtaaccgtacgctttagtaataccgtaggaacgaaaggtcgggaacgtacgtccggtaggaaccgtaccgtaccggaaccggtaccggtaaccggttccgtttagttaacgttagtttacggtaacggttaacggccgtaacgtacgggtaacgggtaaccgggtacccggggtaccccgggtaccgtaaccggtttaccggaacccggtacgggtacccgggggtaccgggaccggggtaaccggttcggtttaccggtacccgttacccggtcccgtcccgtaccgtaacccgtccccgacccggaacccgggaaccccggtcccgttaccgtttaccccggttccccgtttcccccggtaccggtacccctacccgtacccggtaaccgaacggtacccgtaccgtaccggtccgggaccgggacccgtacgtacgtaccgtaccggtcccggttaccggtccgtccggtacccggttaaccggtaaccggttaaccgttaccgttaacccttaccgtaccgtttaccgtaacggttacgtcggtacggacgggccggtacgacggtaaccggacggtcgagttcgngctg

SEQ ID NO: 54022 - DNA, 166 bp, Homo sapiens; identical to SEQ ID NO: 53192
  misc_feature: GYAE6OF02F0MT3.29.78.H01.1.454.CMB.1.raw
  modified_base (166)..(166): a, c, t, g, unknown or other
  misc_feature (166)..(166): n is a, c, g, or t

SEQ ID NO: 54023 - DNA, 481 bp, Homo sapiens
  misc_feature: GYAE6OF02H1FSH.29.78.H01.1.454.CMB.1.raw
  modified_base (479)..(481): a, c, t, g, unknown or other
  misc_feature (479)..(481): n is a, c, g, or t
tcagatagagtactcacgaccggtgctcgatttagtgtgagtagtttgggtttggtggtctctctcccagcctgtgctgactcaatcgccctctgcctctgcctccctgggaggctcggtcaaggtcacctgtactctgagcagtggacacagcagctacgccatcgcttggcatcagcagaggccagacacgggccctcgttacttgatgacagtcaacaatgatggcagtcacagcaagggggacggatccctgatcgcttctcagtctccagctctgggcctgagcgctacctcacaatctccggcctccagtctgaggatgaggctgactattactgtcagacctggggcactggcattcaggtcttcggaccgggacaaggtcaccgtcgtcggtcagcccaaggccaacccactgtcactctgttcccaccctcctcagtactctatctgagcgggctggcaaggcgcatagnnn

SEQ ID NO: 54024 - DNA, 115 bp, Homo sapiens
  misc_feature: GYAE6OF02F32Z3.29.78.H01.1.454.CMB.1.raw
tcagatagagtactcacgaccggtgctcgatttagtgtgagtagttgggtttggggcgcctgggtacggccgggggtcgctgagactctcctgagcgggctggcaaggcgcatag

SEQ ID NO: 54025 - DNA, 222 bp, Homo sapiens
  misc_feature: GYAE6OF02HCX9O.29.78.H01.1.454.CMB.1.raw
  modified_base (172)..(179): a, c, t, g, unknown or other
  misc_feature (172)..(179): n is a, c, g, or t
  modified_base (181)..(222): a, c, t, g, unknown or other
  misc_feature (181)..(222): n is a, c, g, or t
tcagatagagtactcacgaccggtgctcgatttagtgtgagtagtttgggtttgggggtctccactcccgccttgacggggcctgccatcagcccaacggcaaccccactgtcactctgttcccaccctcctcagtactctactctgagcgggctggacaaggtcgcatagnnnnnnnngnnnnnnnnnnnnnnnnnnnnnnnnnnnnnnnnnnnnnnnnnn

SEQ ID NO: 54026 - DNA, 548 bp, Homo sapiens
  misc_feature: GYAE6OF02I20Q5.29.78.H01.1.454.CMB.1.raw
tcagatagagtactcacgaccggtgctcgatttagtgtgagtagtttgggtttgggtctgagagaggagtccacccctgggatcttcaggtgttttcatttggtgatcaggacggaacagagagaactcaccatggagtttgggctgagcgtgcgtttctaggtggctatttaaaggtgtccagtgtgacgtgcagttggtggagtctgggggcgcctggggtacggccgggggggtcgctgagactctcctgtgcggcctctggattaagttttaggagtcatgccatgaactgggtccgccaggctccagggaaggggctggagtgggtctcggctattagtggcagtggtgcgctatatattatgcagacgcctgaagggtccggttcaccatttccagagacaattcgaagaacagctgtatctgcaaatgagagcctgagactcgacgacacggccgtctattattgtgttaaaaggcagctggaagtcgggaccggggcccgtacttcggaccacgtggggcccagggggacgcgtggtccg

SEQ ID NO: 54027 - DNA, 561 bp, Homo sapiens
  misc_feature: GYAE6OF02F9ZGY.29.78.H01.1.454.CMB.1.raw
tcagatagagtactcacgaccggtgctcgatttagtgtgagtagtttgggtttgggtctgagagaggagtccaccctgggatcttcaggtgtttcatttggtgatcaggacggaacagagagaactcaccatggagtttgggctgagcggtgtcgtttctaggtcggctattttaaaaggtgtccagtgtgacgtgcagttggtggagtctgggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtaatctgcaaatgagagcctgagactcgacgacacggccgtctattattgtgttaaggtacgagctggaagtaacgggaccgggcccggaccgttcgtaccgaccgtaggggccgacggggacggcgtggtccgg

SEQ ID NO: 54028 - DNA, 529 bp, Homo sapiens
  misc_feature: GYAE6OF02FQI2Y.29.78.H01.1.454.CMB.1.raw
  modified_base (528)..(529): a, c, t, g, unknown or other
  misc_feature (528)..(529): n is a, c, g, or t
tcagatagagtactcacgaccggtgctcgatttagtgtgagtagtttgggtttggggcgcctgggtacggccgggggtcgctgagactctcctgtgcggcctctggattaagtttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccgggccgacttgaccactgggggccagggggacgctggtcaccgtctcctcagcctccaccaagggcccatcggtcttcccctggcaccctcctccaagagcacctctggggccacagcagccctgggctgcctggtcaaggactacttccagtactctatctgagcgggctggcaggcgcatagnn

SEQ ID NO: 54029 - DNA, 531 bp, Homo sapiens
  misc_feature: GYAE6OF02GY0TC.29.78.H01.1.454.CMB.1.raw
  modified_base (377)..(377): a, c, t, g, unknown or other
  misc_feature (377)..(377): n is a, c, g, or t
  modified_base (531)..(531): a, c, t, g, unknown or other
  misc_feature (531)..(531): n is a, c, g, or t
tcagatagagtactcacgaccggtgctcgatttagtgtgagtagtttgggtttggggcgcctgggtacggccgggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccggggcccgacttgaccactggggccaggggacnctggtcaccgtctcctcagcctccaccaagggcccatcggtcttccccctggccaccctcctccaagacgcacctctggggcacagcacgccctgggctgcctggtcaaggactactccagtactctatctgacgcggctggcaggcgcatagn

SEQ ID NO: 54030 - DNA, 497 bp, Homo sapiens
  misc_feature: GYAE6OF02IR99I.29.78.H01.1.454.CMB.1.raw
tcagatagagtactcacgaccggtgctcgatttagtgtgagtagtttgggtttggggtccgagccatggtgcagactccccagagctctcctcctcctccactgcacagggtctctctcccagcctgtgctgactcaatcgccctctgcctctgcctccctgggaggctcggtcaaggtcacctgtactctgagcagtggacacagcagctacgccatcgcttggcatcagcagaggccagacacgggccctcgttacttgatgacagtcaacaatgatggcagtcacagcaagggggacggatccctgatcgcttctcagtctccagctctgggcctgagcgctacctcacatctccggcctccagtctgaggatgaggctgactattactgtcagacctggggcacgtggcagttcgaggttcgttcggaccggggacagggtcaccggtcgtcggtccagcccaaggcccaacccgctcgcactctcgtccccg

SEQ ID NO: 54031 - DNA, 172 bp, Homo sapiens
  misc_feature: GYAE6OF02HQ2XH.29.78.H01.1.454.CMB.1.raw
  modified_base (166)..(172): a, c, t, g, unknown or other
  misc_feature (166)..(172): n is a, c, g, or t
tcagatagagtactcacgaccggtgctcgatttagtgtgagtagtttgggtttggggtctccactcccgccttgacgggctgccatcagcccaaggccaaccccactgtcactctgttcccaccctcctcagtactctatctgagcgggctggcaaggcgcatagnnnnnnn

SEQ ID NO: 54032 - DNA, 524 bp, Homo sapiens
  misc_feature: GYAE6OF02I5OU5.29.78.H01.1.454.CMB.1.raw
  modified_base (371)..(371): a, c, t, g, unknown or other
  misc_feature (371)..(371): n is a, c, g, or t
  modified_base (523)..(524): a, c, t, g, unknown or other
  misc_feature (523)..(524): n is a, c, g, or t
tcagatagagtactcacgaccggtgctcgatttagtgtgagtagtttgggtttgggcgcctgggtacggccggggtcgctgagactctcctgtgcggcctctggattaagtttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggacgggccgacttgaccactggggccaggggacnctggtcaccgtctcctcagcctccaccaagggcccatcggtcttccccctcggcaccctcctccaagacgcacctctggggcacagcagccctggctgcctggtcaaggactacttccagtactctatctgagcggctggcaggcgcatagnn

SEQ ID NO: 54033 - DNA, 574 bp, Homo sapiens
  misc_feature: GYAE6OF02I0GJ9.29.78.H01.1.454.CMB.1.raw
  modified_base (389)..(389): a, c, t, g, unknown or other
  misc_feature (389)..(389): n is a, c, g, or t
  modified_base (441)..(441): a, c, t, g, unknown or other
  misc_feature (441)..(441): n is a, c, g, or t
  modified_base (453)..(453): a, c, t, g, unknown or other
  misc_feature (453)..(453): n is a, c, g, or t
  modified_base (571)..(571): a, c, t, g, unknown or other
  misc_feature (571)..(571): n is a, c, g, or t
tcagatagagtactcacgaccggtgctcgatttagtgtgagtagtttgggtttgggggtcggcctgggtacggccggggggtcgctgagactctcctgtgcggcctctggattaagtttaggagtcatgccatgaactgggtccgccaggctccagggaaggggcgtggagtgggtcgtcggctattagtggtcagtggtggcgctatatattatgcagacggccctgaagggccggttcaccagtttcccagagacaattcgaagaacacgctgtatcttcgcaaatggtagagcctgagactcgacgacacggccgtcgtattatggtgttaaaggcgagctggaatcgggacgggccgacgttgaccacgtggggccaggggaccnctggtcacggtctcctcagcctccacaggcccatcgctcccctgcacctccncacgagcactcncgggcacgagccacgcccgtacgggcgtcgtccgtggtccgaacggaccgtacttccagttaccttacgtaacgtcttagacggtcgggcgttgggacgacggcgacgacgttacggntcg

SEQ ID NO: 54034 - DNA, 565 bp, Homo sapiens
  misc_feature: GYAE6OF02JSURN.29.78.H01.1.454.CMB.1.raw
  modified_base (564)..(565): a, c, t, g, unknown or other
  misc_feature (564)..(565): n is a, c, g, or t
tcagatagagtactcacgaccggtgctcgatttagtgtgagtagtttgggtttggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccgggccgacttgaccactggggccaggggacgcgtggtcaccgtctcctcagcctccaccaagggcccatcggtccttcccccgtcggccaccctcctccaacgacgccacctccgtgggggccacacgccacgcccgtcgggcctcgccctgggtccaacgggacctacgtccacgtactctacgtctagacggcggctggcgaacggccgcacgtagnn

SEQ ID NO: 54035 - DNA, 527 bp, Homo sapiens
  misc_feature: GYAE6OF02IGWP5.29.78.H01.1.454.CMB.1.raw
  modified_base (464)..(464): a, c, t, g, unknown or other
  misc_feature (464)..(464): n is a, c, g, or t
  modified_base (526)..(527): a, c, t, g, unknown or other
  misc_feature (526)..(527): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccgggcccgacttgaccactggggccaggggacgctggtcaccgtctcctcagcctccaccagggcccatcggtcttccccctggccaccctcctccaacgacgcacctctcggggcacngcagccctggctgcctggtcagctactccagtctctatctgagcggctggcaggcgcatagnn

SEQ ID NO: 54036 - DNA, 480 bp, Homo sapiens
  misc_feature: GYAE6OF02G9IM3.29.78.H01.1.454.CMB.1.raw
  modified_base (339)..(339): a, c, t, g, unknown or other
  misc_feature (339)..(339): n is a, c, g, or t
  modified_base (471)..(471): a, c, t, g, unknown or other
  misc_feature (471)..(471): n is a, c, g, or t
  modified_base (478)..(480): a, c, t, g, unknown or other
  misc_feature (478)..(480): n is a, c, g, or t
tcagatagagtactcacgaccggtgctcgatttagtgtgagtagtttgggtttggtggtctctctcccagcctgtgctgactcaatcgccctctgcctctgcctccctgggaggctcggtcaaggtcacctgtactctgagcagtggacacagcagctacgccatcgcttggcatcagcagaggccagacacgggccctcgttacttgatgacagtcaacaatgatggcagtcacagcaagggggacggatccctgatcgcttctcagtctccagctctgggcctgagcgctacctcacaatctccggcctccagtctgagatgaggctgactattacngtcagacctggggcactggcattcaggtctcggacgggacaaggtcacgtcgtcggtcagcccaaggccaacccgctcgtcactctcgttcccacctcctcagtacctctatcgtgagcggctggcaaggcncatacgnnn

SEQ ID NO: 54037 - DNA, 647 bp, Homo sapiens
  misc_feature: GYAE6OF02G8UWB.29.78.H01.1.454.CMB.1.raw
tcagatagagtactcacgaccggtgctcgatttagtgtgagtagtttgggtttgggggcgcctgggtaacgccggggggtcgcgtgaggactctcctaggtgcgggccttctggattaaacgttttagggagttcattgccattgaactgggtccgccaggctccgagggaacgggcgtggagttgggtctcggctattacgtggtccagtggtcggcgctatatattatggcagacggccctgaagggccgttacaccgatttccagagaccaattcgaagttaactacggcctagtaatacctagctaaaagtcggtaggacgcctgagaactcggaacgacgaccggcccgtaactacttattgttagttaaagggcgtagccgtggaattccgggggaccgggacccgatttcgacctacgtcggggaccagggggacgcggtcggtctaccggtctcctcacgcctccaacacggccactcggtctccccgtgcacctctcagcgctactctggggcacgagacagtccctacgggtccttcgcctacggttccgaacgggtacgtaaccgttaccgacggtactctacgtaccgtagtacggcgggtccgtggaccgaacggccgtcgtacgtacgtgtac

SEQ ID NO: 54038 - DNA, 548 bp, Homo sapiens
  misc_feature: GYAE6OF02I56GR.29.78.H01.1.454.CMB.1.raw
  modified_base (547)..(548): a, c, t, g, unknown or other
  misc_feature (547)..(548): n is a, c, g, or t
tcagatagagtactcacgaccggtgctcgatttagtgtgagtagtttgggtttgggggcgcctgggtacggccggggggtcgctgagactctcctgtgcggcctctggattaagtttaggagtcatgccatgaactgggtccgccaggctccagggaaggggctggagtgggtctcggctattagtggcagtggtggcgctatatattatgcagacgccctgaagggccgttcaccatttccagagacaattcgaagaacacgctgtatctgcaaatggagagcctgagactcgacgacacggccgtctattattgtgttaaaggcgagctggaatacgggaccgggccgacttgaccactggggccagggggacgctggtcaccggtctcctcacgcctccaccaagggcccacgtcggtccttcccccgtggccaccctcctccaacgacgccacctccgtcggggcacgagccacgccctgggctcgcctggtcaaggcctactccagtactctactctgacgcgggctggcaggcgcatacgnn

SEQ ID NO: 54039 - DNA, 534 bp, Homo sapiens
  misc_feature: GYAE6OF02IJYED.29.78.H01.1.454.CMB.1.raw
  modified_base (512)..(512): a, c, t, g, unknown or other
  misc_feature (512)..(512): n is a, c, g, or t
  modified_base (533)..(534): a, c, t, g, unknown or other
  misc_feature (533)..(534): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccggggcccgacttgaccactggggccaggggacgctggtcaccgtctcctcagcctccaccaaggcccatcggtcttccccctggccaccctcctccaacgagcacctctgggggcacagcagccctgggctgcctggtcaaggactacttccagtactctatctgngcgggctggcaggcgcatagnn

SEQ ID NO: 54040 - DNA, 531 bp, Homo sapiens
  misc_feature: GYAE6OF02JC86N.29.78.H01.1.454.CMB.1.raw
  modified_base (376)..(376): a, c, t, g, unknown or other
  misc_feature (376)..(376): n is a, c, g, or t
  modified_base (530)..(531): a, c, t, g, unknown or other
  misc_feature (530)..(531): n is a, c, g, or t
tcagatagagtactcacgaccggtgctcgatttagtgtgagtagtttgggtttggggcgcctgggtacggccgggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccgggcccgacttgaccactggggccaggggacnctggtcacgtctcctcagcctcaccaagggcccatccggtcttccccctggccaccctcctccaacgacgcacctctggggcacagcagccctgggctgcctggtcaaggactacttccagtactctatctgagcggctggcaaggcgcatagnn

SEQ ID NO: 54041 - DNA, 486 bp, Homo sapiens
  misc_feature: GYAE6OF02G1WA5.29.78.H01.1.454.CMB.1.raw
  modified_base (485)..(486): a, c, t, g, unknown or other
  misc_feature (485)..(486): n is a, c, g, or t
tcagatagagtactcacgaccggtgctcgatttagtgtgagtagtttgggtttggtggtctctctcccagcctgtgctgactcaatcgccctctgcctctgcctccctgggaggctcggtcaaggtcacctgtactctgagcagtggacacagcagctacgccatcgcttggcatcagcagaggccagacacgtgccctcgttacttgatgacagtcaacaatgatggcagtcacagcaagggggacgggatccctgatcgcttctcagtctccagctctgggcctgagcgctacctcacaatctccggcctccagtctgaggatgaggctgactattactgtcagacctggggcactggcattcaggtcttcggaccgggaccaggtcaccgtcgtcggtcagcccaaggccaaccccactcgtcactctcgttccccaccctcctcagtactctactctgacgcgggctggcaggcgcatagnn

SEQ ID NO: 54042 - DNA, 490 bp, Homo sapiens
  misc_feature: GYAE6OF02I70VZ.29.78.H01.1.454.CMB.1.raw
  modified_base (422)..(422): a, c, t, g, unknown or other
  misc_feature (422)..(422): n is a, c, g, or t
  modified_base (488)..(490): a, c, t, g, unknown or other
  misc_feature (488)..(490): n is a, c, g, or t
tcagatagagtactcacgaccggtgctcgatttagtgtgagtagtttgggtttggtggtctctctcccagcctgtgctgactcaatcgccctctgcctctgcctccctgggaggctcggtcaaggtcacctgtactctgagcagtggacacagcagctacgccatcgcttggcatcagcagaggccagacacgggccctcgttacttgatgacagtcaacaatgatggcagtcacagcaagggggacgggatccctgatcgcttctcagtctccagctctgggcctgagcgctacctcacaatctccggcctcagtctgaggatgaggctgactattactgtcagacctggggcacgtggcattcaggtcttcggaccgggaccaaggtcaccgtcgtcggtcacgcccaaggcccaacccnctcgtcactctcgttcccgccctcctcacgtacctctatcgtgacgcgggctggcaggcgcatagnnn

SEQ ID NO: 54043 - DNA, 578 bp, Homo sapiens
  misc_feature: GYAE6OF02HJY4O.29.78.H01.1.454.CMB.1.raw
  modified_base (416)..(416): a, c, t, g, unknown or other
  misc_feature (416)..(416): n is a, c, g, or t
tcagatagagtactcacgaccggtgctcgatttagtgtgagtagtttgggtttgggggagagaggagtccacccctgggatcttcaggtgttttcatttggtgatcaggacggaacagagagaactcaccatggagtttgggctgagcgtgtcgtttctaggtggctaattttaaaaggtgtccagtgtgacgtgcagttggtggagtctgggggcgccgtggggtacggccgggggggtcgctgagctctcctgtgcggcctctggatttaagttttaggagtcatgccatgaactgggtccgccaggctccgaggggaagggctggagtgggtctcggctattagtggcagtggtgcgctatatattatgcagacgcctgaagggccgttcaccattccagagacaattcgaanacacgctgtatctgacaaatggagagcctgagactcgacgacacggccgtctattatgtagttaaaggcgaagcgtggaacgtaccggggaccggggcccgtagttcggaacccacggtcgggggccgaacgggggaccgcgttcgggtaccacccggttcc

SEQ ID NO: 54044 - DNA, 532 bp, Homo sapiens
  misc_feature: GYAE6OF02I55YI.29.78.H01.1.454.CMB.1.raw
  modified_base (531)..(532): a, c, t, g, unknown or other
  misc_feature (531)..(532): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccggggcccgacttgaccactggggccaggggacgctggtcaccgtctcctcagcctccaccaaggcccatcggtcttccccctggcaccctcctccaacgagcacctctggggcacagcagccctgggctgcctggtcaaggactactccagtactctatctgagcgggctggcaaggcgcatagnn

SEQ ID NO: 54045 - DNA, 580 bp, Homo sapiens
  misc_feature: GYAE6OF02I6UUR.29.78.H01.1.454.CMB.1.raw
  modified_base (375)..(375): a, c, t, g, unknown or other
  misc_feature (375)..(375): n is a, c, g, or t
  modified_base (424)..(424): a, c, t, g, unknown or other
  misc_feature (424)..(424): n is a, c, g, or t
  modified_base (580)..(580): a, c, t, g, unknown or other
  misc_feature (580)..(580): n is a, c, g, or t
tcagatagagtactcacgaccggtgctcgatttagtgtgagtagtttgggtttgggggcgcctgggtacggccggggggtcgctgagactctcctgtgcgggcctgtgagtagtttagagtcatgccatgactggtcgcaggctccagggaaggggctggagtgggtctcggctattagtggcagtggtggcgctatatattatgcagacgccctgaagggccgttcaccatttccagagacaattcgaagaacacgctgtatctgcaaatggagagcctgagactcgacgacacggccgtctattattgtagttaaaggcgagctggaatacgggaccggggcccattggacccagtcgggggccagggggacncgtggccacgtctcctcagcctcaccaaggcccatcgtccttcccccgnggccacccgtcctacccaagacgccaccgtcgtcgggggccacgacgccacgcccgtgggcctcgccgtcggtacaacggtaccttaccgttaccacgttacctctacgttcgtcgacggccgggtacgtggaccgaacgggccgacgagtagcgn

SEQ ID NO: 54046 - DNA, 515 bp, Homo sapiens
  misc_feature: GYAE6OF02JERBE.29.78.H01.1.454.CMB.1.raw
  modified_base (320)..(320): a, c, t, g, unknown or other
  misc_feature (320)..(320): n is a, c, g, or t
  modified_base (495)..(495): a, c, t, g, unknown or other
  misc_feature (495)..(495): n is a, c, g, or t
tcagatagagtactcacgaccggtgctcgatttagtgtgagtagtttgggtttggggtccgagccatggtgcagactccccagagctctcctcctcctccactgcacagggtctctctcccagcctgtgctgactcaatcgccctctgcctctgcctccctgggaggctcggtcaaggtcacctgtactctgagcagtggacacagcagctacgccatcgcttggcatcagcagaggccagacacgggccctcgttactgatgacagtcaacaatgatggcagtcacagcgaagggggacggatcccgtgactcgcttcncagtctccagctcgtgggcctgagcgctacctcacatcctccggcctccagtctgaggatggaggctgacttattactgtcacgaccgtggggcacgtgctagttcgaggttccgttccgggaccgggaccgaacggtcaccggtcggtcggtcacggcccgacggcccaacccncgtcgtcacttctcgtcccc

SEQ ID NO: 54047 - DNA, 498 bp, Homo sapiens
  misc_feature: GYAE6OF02HBCQZ.29.78.H01.1.454.CMB.1.raw
  modified_base (496)..(498): a, c, t, g, unknown or other
  misc_feature (496)..(498): n is a, c, g, or t
tcagatagagtactcacgaccggtgctcgatttagtgtgagtagtttgggtttggtggtctctctcccagcctgtgctgactcaatcgccctctgcctctgcctccctgggaggctcggtcaaggtcacctgtactctgagcagtggacacagcagctacgccatcgcttggcatcagcagaggccagacacgggccctcgttacttgatgacagtcaacaatgatggcagtcacagcaagggggacggatccctgatcgcttctcagtctccagctctgggcctgagcgctacctcacaatctccggcctccagtctgaggatgaggctgactattactgtcagacctggggcacgtggcattcgaggtcttcgggaccgggacaaggtcaccgtcgtcggtcacgcccaaggcccaacccactcgtccactcctcgttccccaccctcctcacgtacctctactctgacgcgggctggcaacggcgcagtacgnnn

SEQ ID NO: 54048 - DNA, 833 bp, Homo sapiens
  misc_feature: GYAE6OF02HTIL4.29.78.H01.1.454.CMB.1.raw
tcagatagagtactcacgaccggtgctcgatttagtgtgagtagtttgggttggggtcggcctgggtacggcccgggggtcgctggagactctcctggtgcggcctcgtcggattaagttttaggagtccagtgcccatgaactgggtccgccaggcctccgtagggaaggggctggagtgggtctcgggctattagtcggcagtcggtggtcgctattattattattggcgagacgcccctgaacgggccggttcacctatttcccgagagacaagttcgtaagaacacgctgtatcttgacaaaagtggagacgacctgagactcgacgacaacggccgtactagttagttggtgttaaacggccgaggtactggaatacgggaccggggccgacgttcggaccgaacgtcggggacctaggggacgccgtggttcgacccggtctccgtcgacgtcctaccgaaccgtaacgggcccaacgttaccgggttaccttttccccccgtcgggtcccaaccccgttccctacccgtaaacggtaacgaccgtaaacccgtttcccgttaccgggggggttaccctaacccgttaacgggccccgtaacggggtacccccgttacgggggtaccccgttacgggtaaccccgtttacggggttaaacccgtaaaaccggggtaaccgtttaaacccggtttaccccgtaacgggttacccgtttacccgttaaacgttcccgtttacgggtaaccggttcccgggggtacccgtttaccggggtaccccgtaaaccggggaccggttacccgtaacggttaacggtattaacgg

SEQ ID NO: 54049 - DNA, 550 bp, Homo sapiens
  misc_feature: GYAE6OF02IPJ0S.29.78.H01.1.454.CMB.1.raw
  modified_base (399)..(399): a, c, t, g, unknown or other
  misc_feature (399)..(399): n is a, c, g, or t
tcagatagagtactcacgaccggtgctcgatttagtgtgagtagtttggggtttggggagagctctggggagtctgcaccatggctcggaccccactcctcttcctcaccctcctcctccactgcacagggtctctctcccagcctgtgctgactcaatcgccctctgcctctgcctccctgggaggctcggtcaaggtcacctgtactctgagcagtggacacagcagctacgccatcgcttggcatcagcagaggccagacacgggccctcgttacttgatgacagtcaacaatgatggcagtcacagcgaagggggacggatcccgtgatcgcttctcagtctcagctcgtgggcctgagcgctacctcacaatctccgcctccagtctgaggtanggaggctagacttattactgtacagaccgtggggcacgtggactagttcgacgggttcgttaccggggaaccggggtaacctaacgggtccgaacccgggttcggtaccgggttaccaccggaccccgaaacgggccccaaaccccgtacg

SEQ ID NO: 54050 - DNA, 538 bp, Homo sapiens
  misc_feature: GYAE6OF02GQ8J2.29.78.H01.1.454.CMB.1.raw
  modified_base (378)..(378): a, c, t, g, unknown or other
  misc_feature (378)..(378): n is a, c, g, or t
  modified_base (537)..(538): a, c, t, g, unknown or other
  misc_feature (537)..(538): n is a, c, g, or t
tcagatagagtactcacgaccggtgctcgatttagtgtgagtagtttgggtttggggcgcctgggtacggccggggggtcgctgagactctcctgtgcgggcctcgtggattaagtttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccgggcccgacttgaccactggggccaggggacnctggtcaccgtctcctcagcctccaccaagggcccactcggtcttccccctggccaccctcctccaacgacgcacctctcggggcacgagcacgccctgggctcgcctggtcaaggactacttccagtactctatctgagcggctggcaggcgcatagnn

SEQ ID NO: 54051 - DNA, 527 bp, Homo sapiens
  misc_feature: GYAE6OF02IXGQZ.29.78.H01.1.454.CMB.1.raw
  modified_base (526)..(527): a, c, t, g, unknown or other
  misc_feature (526)..(527): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacggggaccgggccgacttgaccacgtggggccaggggacgctggtcaccgtctcctcagcctccacaggcccatcgtctcccctgcacctcctccaagacgcacctcgtcggggcacagcacgccctgggctgcctggtcaaggactactccagtactctatctgacgcggctggcaggcgcatagnn

SEQ ID NO: 54052 - DNA, 529 bp, Homo sapiens
  misc_feature: GYAE6OF02HN5RQ.29.78.H01.1.454.CMB.1.raw
  modified_base (528)..(529): a, c, t, g, unknown or other
  misc_feature (528)..(529): n is a, c, g, or t
tcagatagagtactcacgaccggtgctcgatttagtgtgagtagtttgggtttggggcgcctgggtacggccggggggtcgctgagactctcctgtgcggcctctggattaagtttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattatgtgttaaaggcgagctggaatacgggaccgggcccgacttgaccactgggggccaggggacgctggtcaccgtctcctcagcctccaccaaggcccatcggtcttccccctggcaccctcctccaacgacgcacctctcggggcacagcagccctgggctgcctggtcaaggactactccagtactctatctgagcggctggcaggcgcatagnn

SEQ ID NO: 54053 - DNA, 535 bp, Homo sapiens
  misc_feature: GYAE6OF02H1V1I.29.78.H01.1.454.CMB.1.raw
  modified_base (505)..(505): a, c, t, g, unknown or other
  misc_feature (505)..(505): n is a, c, g, or t
  modified_base (534)..(535): a, c, t, g, unknown or other
  misc_feature (534)..(535): n is a, c, g, or t
tcagatagagtactcacgaccggtgctcgatttagtgtgagtagtttgggtttggggcgcctgggtacgggccggggggtcgctgagactctcctgtgcggcctctggattaagtttaggagtcatgccatgaactgggtccgccaggctccagggaaggggctggagtgggtctcggctattagtggcagtggtggcgctatatattatgcagacgccctgaagggccggttcaccattttccagagacaattcgaagaacacgctgtatctgcaaatggagagcctgagactcgacgacacggccgtctattacttgtgttaaaggcgaagctggaatacgggaccgggcccgacgttcgaccgactgggggccaggggacgctggtcaccgtctcctcagcctcaccaagggcccatcggtcttcccctggcacctcctccagagcacctctcggggcacagccagccctgggctgcctggtcaaggctacttccagtactntatctgagcggtctggcaaggcgcatagnn

SEQ ID NO: 54054 - DNA, 503 bp, Homo sapiens
  misc_feature: GYAE6OF02H7OAU.29.78.H01.1.454.CMB.1.raw
  modified_base (266)..(266): a, c, t, g, unknown or other
  misc_feature (266)..(266): n is a, c, g, or t
tcagatagagtactcacgaccggtgctcgatttagtgtgagtagtttgggtttggggtccgagccatggtgcagactccccagagctctcctcctcctccactgcacagggtctctctcccagcctgtgctgactcaatcgccctctgcctctgcctccctgggaggctcggtcaaggtcacctgtactctgagcagtggacacagcagctacgccatcgcttggcatcagcagaggccagacacgggccctcgttactgatgacngtcaacaatgatggcagtcacagcgaagggggacggatccctgatcgcttctcagtctccagctctgggcctgagcgctacctcaacatctccggcctccagtctgaggatgaggctgacttattactgtcagaccgtggggcacgtggcattcgagttcgtcggaccgggaccaaggtcaccggtcgtcggtcacgcccaacggcccaaccccgctcgtccactcctcgttacccc

SEQ ID NO: 54055 - DNA, 533 bp, Homo sapiens
  misc_feature: GYAE6OF02IPW14.29.78.H01.1.454.CMB.1.raw
  modified_base (532)..(533): a, c, t, g, unknown or other
  misc_feature (532)..(533): n is a, c, g, or t
tcagatagagtactcacgaccggtgctcgatttagtgtgagtagtttgggtttgggggcgcctgggtacggccggggggtcgctgagactctcctgtgcggcctctggattaagtttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccgggccgacttgaccactggggccaggggacgctggtcaccgtctcctcagcctccaccaagggcccatcggtcttccccctggccaccctcctccaacgacgccacctctcggggcacagcagccctgggctgcctggtcaaggctaactccagtactctatctgagcggctggcaaggcgcatagnn

SEQ ID NO: 54056 - DNA, 541 bp, Homo sapiens
  misc_feature: GYAE6OF02IZJB2.29.78.H01.1.454.CMB.1.raw
  modified_base (375)..(375): a, c, t, g, unknown or other
  misc_feature (375)..(375): n is a, c, g, or t
  modified_base (540)..(541): a, c, t, g, unknown or other
  misc_feature (540)..(541): n is a, c, g, or t
tcagatagagtactcacgaccggtgctcgatttagtgtgagtagtttgggtttggggcgcctgggtacggccgggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccgggccgacttgaccactggggccaggggacnctggtcaccgtctcctcagcctccacaagggcccatcggtcttccccctggccaccctcctccaacgacgccaccgtcctacgggggccaccagccagccctgggcctcgcctggtcaaggactacttccagtactctatctgagcggctggcaaggcgcatagnn

SEQ ID NO: 54057 - DNA, 517 bp, Homo sapiens
  misc_feature: GYAE6OF02G2KC2.29.78.H01.1.454.CMB.1.raw
  modified_base (495)..(495): a, c, t, g, unknown or other
  misc_feature (495)..(495): n is a, c, g, or t
tcagatagagtactcacgaccggtgctcgatttagtgtgagtagtttgggtttggggtccgagccatggtgcagactccccagagctctcctcctcctccactgcacagggtctctctcccagcctgtgctgactcaatcgccctctgcctctgcctccctgggaggctcggtcaaggtcacctgtactctgagcagtggacacagcagctacgccatcgcttggcatcagcagaggccagacacgggccctcgttactgatgacagtcaacaatgatggcagtcacagcgaagggggacggatccctgatcgcttctcagtctccagctcgtgggcctgacgcgctacctcacatcctccggcctccagtctgagatgaggctgactattactgtcagaccgtggggccacgtggactagttcgaggttccgttacgggaccggggtacacgggtccaccggtcgtccggtacacggcccaacggcccaacccncgtcgtccactcgtcgtccccg

SEQ ID NO: 54058 - DNA, 561 bp, Homo sapiens
  misc_feature: GYAE6OF02H36IB.29.78.H01.1.454.CMB.1.raw
  modified_base (552)..(552): a, c, t, g, unknown or other
  misc_feature (552)..(552): n is a, c, g, or t
tcagatagagtactcacgaccggtgctcgatttagtgtgagtagtttgggtttggggtctgagagaggagtccacccctgggatcttcaggtgttttcatttggtgatcaggacggaacagagagaactcaccatggagtttgggctgagcgtgcgttttctgtggctattttaaaggtgtccagtgtgacgtgcagttggtggagtctgggggcgcctgggtacggccgggggggtcgctgagactctcctgtgcggcctctggattaagttttaggagtcatgccatgaactgggtccgccaggctccagggaaggggctggagtgggtctcggctattagtgcagtggtggcgctagtatattatgcagacgcccgtgaagggcccggttacacccgattttcccagagaacaacttacgaagaacacgctgtatctgcaaatggagacgcctgagactcgacgacacggcgtctattattgtagttaaaggcgagctggaacgtacgggacccggggccgacgttcgaccgacgtggggccaggggcncgtggtccg

SEQ ID NO: 54059 - DNA, 739 bp, Homo sapiens
  misc_feature: GYAE6OF02FUT1A.29.78.H01.1.454.CMB.1.raw
  modified_base (734)..(734): a, c, t, g, unknown or other
  misc_feature (734)..(734): n is a, c, g, or t
tcagatagagtactcacgaccggtgctcgatttagtgtgagtagtttgggtttggggggcgccgtgggtaccggccggggggtcgctgagacgtcgtccttgtgtcggcctctggagttaagtttaggagtacatgccatgaactggtcgctaggctcaggagggtctggtagtggtcttacggcgtattagtggtcagtggtggcgcgtatagtagttatgcggaggacgccgtgaagggccggttcgaccgactttccgagagtacaacttcgaagaacacgctgtagtctgcaaattggaagacgtcctgagactcgacgacacgggcccgtctagttattcgtaggttaaaggcggagtcgtagggaagttacggggaccggggcccgtaacgttggtaccgagttgggggacctaagggggacgacgtaggtactaccggtctaccgtcgacggtcccgtaccgaacccgtaacgggtccccaacgtaccggttccctttccccccgtagggacccgaccccgttacccttacccgaaacggtaacgtaccgttaacccgtccgttacgggggtacctaaccgacggtacgaaccggtaccccggttcggggtaccgtcggaccggttcgggtaccgaaacgggaccgttaccgttaccgtacgttacttacgtacgttcgtaggacggtcgggtacgtgggacgaacgggtccggtacgtacgtaggngtacg

SEQ ID NO: 54060 - DNA, 492 bp, Homo sapiens
  misc_feature: GYAE6OF02GTJQH.29.78.H01.1.454.CMB.1.raw
  modified_base (426)..(426): a, c, t, g, unknown or other
  misc_feature (426)..(426): n is a, c, g, or t
  modified_base (485)..(485): a, c, t, g, unknown or other
  misc_feature (485)..(485): n is a, c, g, or t
  modified_base (490)..(492): a, c, t, g, unknown or other
  misc_feature (490)..(492): n is a, c, g, or t
tcagatagagtactcacgaccggtgctcgatttagtgtgagtagtttgggtttggtggtctctctcccagcctgtgctgactcaatcgccctctgcctctgcctccctgggaggctcggtcaaggtcacctgtactctgagcagtggacacagcagctacgccatcgcttggcatcagcagaggccagacacgggccctcgttacttgatgacagtcaacaatgatggcagtcacagcgaagggggacggatccctgatcgcttctcagtctccagctctgggcctgagcgctacctcacaatcctccggcctccagtctgaggatgagctgactatactgtcagaccgtggggcacgtggcattcgaggtcttcgggaccgggaccaaggtcaccggtcgtcggtcacgcccaaggcccaacccnctcgtcacttctcgttcccgcctcctcacgtactctatcgtgacgcgggctggcaggcncatgnnn

SEQ ID NO: 54061 - DNA, 582 bp, Homo sapiens
  misc_feature: GYAE6OF02FYZUX.29.78.H01.1.454.CMB.1.raw
  modified_base (580)..(580): a, c, t, g, unknown or other
  misc_feature (580)..(580): n is a, c, g, or t
tcagatagagtactcacgaccggtgctcgatttagtgtgagtagtttgggtttgggggtcggcctagggtacggcccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaaatggagagcctgacgactcgacgacacgggccgtctattattgtgttaaaggcgagctggaatacggggaccgggcccgacttgaccacgtggggccaggggacgcgtggtcaccggtctcctcacgccctaccaaccaacgggcccactccggtccttccccctcggccaccctcctccaacgacgcacctcgtcggggccacgagccacgcccgtgggcctcgcctggtactaacggactacgttccgagttactcgtacgtctgacggcggtctggcgaacggcgacacgtacgncg

SEQ ID NO: 54062 - DNA, 627 bp, Homo sapiens
  misc_feature: GYAE6OF02JYD4O.29.78.H01.1.454.CMB.1.raw
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccgggcccgacttgaccacgtggggccaggggacgctggtcaccgtctcctcagccctccaccaacgggcccactccggtccttcccccgtcggcccaccctccctcccaacgacgccaccctccgtcgggggccacgacgccgacggccccgtcgggcctcggcccgtcgggtccgaaacgggtaccttaaccgttcccacggttaccttccgttaacgttccgttacggacggtccggggtaccgtcgggaccgtaacgggccgaccgtacgtacgtcgcg

SEQ ID NO: 54063 - DNA, 538 bp, Homo sapiens
  misc_feature: GYAE6OF02FVQFQ.29.78.H01.1.454.CMB.1.raw
  modified_base (537)..(538): a, c, t, g, unknown or other
  misc_feature (537)..(538): n is a, c, g, or t
tcagatagagtactcacgaccggtgctcgatttagtgtgagtagtttgggtttggggcgcctgggtacggccgggggtcgctgagactctcctgtgcggcctctggattaagtttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccgggccgacttgaccactgggggccagggggaccgctgggtcaccggtctcctcagcctccaccaagggcccatcggtcttccccctggccaccctcctccaagacgccacctctggggccacgagcacgccctgggctgcctggtcaaggactacttccagtactctatctgagcggctggcaggcgcactagnn

SEQ ID NO: 54064 - DNA, 601 bp, Homo sapiens
  misc_feature: GYAE6OF02J183H.29.78.H01.1.454.CMB.1.raw
  modified_base (599)..(600): a, c, t, g, unknown or other
  misc_feature (599)..(600): n is a, c, g, or t
tcagatagagtactcacgaccggtgctcgatttagtgtgagtagtttgggtttggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccgggcccgacttgaccacgtggggccaggggacgctgggtcaccgtctcctcagccctccaccgaacgggcccagtccggtccttcccccgtcggccacccctccctcccaacgacgccacctcgtcgggggccacgacgccacgccccgtcgggcctcggccgtcggttccaaacgggtaccttaccgttcccacgttacctccttaacgtctcggaggccgggtcgtcggaccgaacgggccgacgacgtagnng

SEQ ID NO: 54065 - DNA, 673 bp, Homo sapiens
  misc_feature: GYAE6OF02H7OTW.29.78.H01.1.454.CMB.1.raw
tcagatagagtactcacgaccggtgctcgatttagtgtgagtagtttgggtttggggtctgagagaggagtccacccctgggatcttcaggtgtttcatttggtgatcaggacggaacagagagaactcaccatggagtttgggctgagcgtggcttttctgtggctattttaaaaggtgtccagtgtgacgtgcagttggtggagtctgggggcgcctgggtacggccggggggtcgctgagactctcctgtgcggcctctggattaagtttaggagtcatgccatgaactgggtccgccaggcctcgagggacgggcgtggaggtgggtcgtcggctagttaggtggcgaggtgggtcggcgtactatattattagtgacagaccgtcccgtagggaacggggtcccggtttacaaccgtacgttttacccgaaggaacgaactaaacgttacgaaacgtaacacgcttagtactctagactaaagtggagacgcctagacgacgtacgaacgacgaccggtccgttacttaagttacgtttaggtaggttaaaacgggcgtaagtccggtaagggtaaacggtaacccgggggacccggggaccctacggttaccggaacccgacgggttcgggggacccgtaaggggggaccctacggtcggtacccgg

SEQ ID NO: 54066 - DNA, 538 bp, Homo sapiens
  misc_feature: GYAE6OF02I3OPX.29.78.H01.1.454.CMB.1.raw
  modified_base (537)..(538): a, c, t, g, unknown or other
  misc_feature (537)..(538): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccgggcccgacttgaccactggggccaggggacgctggtcaccgtctcctcagcctccaccaagggcccatcggtcttccccctggccaccctccctccaacgacgccacctctcgggggccacagcacgccctgggctgcctggtcaaggactactccagtactctatctgagcggctggcaggcgcatagnn

SEQ ID NO: 54067 - DNA, 536 bp, Homo sapiens
  misc_feature: GYAE6OF02G7J2W.29.78.H01.1.454.CMB.1.raw
  modified_base (379)..(379): a, c, t, g, unknown or other
  misc_feature (379)..(379): n is a, c, g, or t
  modified_base (535)..(536): a, c, t, g, unknown or other
  misc_feature (535)..(536): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccggggcccgacttgaccactggggccaggggacnctggtcaccgtctcctcagccctccaccaagggcccatcggtcttccccctcggcaccctcctccaacgacgcacctctgggggcacagcagccctgggctgcctggtcaaggactacttccagtactctatctgagcggctggcaggcgcatagnn

SEQ ID NO: 54068 - DNA, 534 bp, Homo sapiens
  misc_feature: GYAE6OF02G8W9E.29.78.H01.1.454.CMB.1.raw
  modified_base (534)..(534): a, c, t, g, unknown or other
  misc_feature (534)..(534): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccggggcccgacttgaccactggggccaggggacgctggtcaccgtctcctcagcctccaccaagggcccatcggtcttccccctggccaccctcctcccaacgacgcacctctggggcacagcagccctgggctgcctggtcaaggactacttccagtactctatctgagcggctggcaggcgcatagn

SEQ ID NO: 54069 - DNA, 542 bp, Homo sapiens
  misc_feature: GYAE6OF02IIKHW.29.78.H01.1.454.CMB.1.raw
  modified_base (381)..(381): a, c, t, g, unknown or other
  misc_feature (381)..(381): n is a, c, g, or t
  modified_base (542)..(542): a, c, t, g, unknown or other
  misc_feature (542)..(542): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaaatggagagcctgagactcgacgacacggccgtctattattgtgttaaaggcgagctggaatacgggaccggggcccgacttgaccactgggggccaggggacnctggtcaccgtctcctcagcctccaccaagggcccatccggtcttccccctggccaccctcctccaacgacgccacctctcgggggcacagccagcccgtgggctgcctggtcaaggactacttccagtactctatctgagcggctggcacggcgcatagn

SEQ ID NO: 54070 - DNA, 531 bp, Homo sapiens
  misc_feature: GYAE6OF02IJYWL.29.78.H01.1.454.CMB.1.raw
  modified_base (530)..(531): a, c, t, g, unknown or other
  misc_feature (530)..(531): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgccaggctccagggaaggggctggagtggggtctcggctattagtggcagtggtggcgctatatattatgcagacgccctgaagggccggttcaccatttccagagacaattcgaagaacacgctgtatctgcaaaatggagagcctgagactcgacgacacggccgtctattattgtgttaaaggcgagctggaatacgggaccgggcccgacttgaccactggggccaggggacgctggtcaccgtctcctcagcctccaccaagggcccatcgtctccccctggccaccctcctccaagacgccacctctcggggcacagcagccctgggctgcctggcaaggctactcagtactctatctgagcggctggcaaggcgcatagnn

SEQ ID NO: 54071 - DNA, 623 bp, Homo sapiens
  misc_feature: GYAE6OF02H1KLO.29.78.H01.1.454.CMB.1.raw
  modified_base (622)..(622): a, c, t, g, unknown or other
  misc_feature (622)..(622): n is a, c, g, or t
tcagatagagtactcacgaccggtgctcgatttagtgtgagtagtttgggtttgggggcgcctgggtacggccggggggtcgctgagactctcctgtgcggcctctggattaagtttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaaatggagagcctgagactcgacgacacggccgtctattattgtgttaaaggcgagctggaatacgggaccggggcccgacttgaccactggggccaggggacgctggtcaccgtctcctcagcctccaccaagggcccatccggtcttccccctggccacccctcctccaagacgccacccttcgtcgggggccacgacgccacgccccgtcgggccgtcggcccgttcgggtaccgaaacgggtacccttaaccgtttcccgaacgttacccttaccttaacgttccgttagggaccggtccggggtaccgttcggggaccgaacgggcccgaccgtagtacggnc

SEQ ID NO: 54072 - DNA, 564 bp, Homo sapiens
  misc_feature: GYAE6OF02GVYA2.29.78.H01.1.454.CMB.1.raw
  modified_base (563)..(564): a, c, t, g, unknown or other
  misc_feature (563)..(564): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacggggaccggggcccgacttgaccacgtggggccaggggacgctggtcaccgtctcctcacgccctccaccaacgggcccactccggtccttcccccgtcggccacccctccctcccaacgacgccacccgtccgtcgggggccacgacgcacgcccgtgggctcgcctggtcaaggactacttccagtactctatctgacggcggctggcacggcgcatagnn

SEQ ID NO: 54073 - DNA, 447 bp, Homo sapiens
  misc_feature: GYAE6OF02HI5R6.29.78.H01.1.454.CMB.1.raw
  modified_base (429)..(447): a, c, t, g, unknown or other
  misc_feature (429)..(447): n is a, c, g, or t
tcagatagagtactcacgaccggtgctcgatttagtgtgagtagtttgggtttgggaggctcggtcaaggtcacctgtactctgagcagtggacacagcagctacgccatcgcttggcatcagcagaggccagacacgggccctcgttacttgatgacagtcaacaatgatggcagtcacagcaagggggacggatccctgatcgcttctcagtctccagctctgggcctgagcgctacctcacaatctccggcctccagtctgaggatgaggctgactattactgtcagacctggggcactggcattcaggtcttcggaccggggaccaaggtcaccgtcgtcggtcagcccaaggccaaccccgatgtcactctcgttccccgccctcctcagtactctatctgacgcggctggcaaggcgcatagnnnnnnnnnnnnnnnnnnn

SEQ ID NO: 54074 - DNA, 615 bp, Homo sapiens
  misc_feature: GYAE6OF02JMVVV.29.78.H01.1.454.CMB.1.raw
  modified_base (613)..(613): a, c, t, g, unknown or other
  misc_feature (613)..(613): n is a, c, g, or t
tcagatagagtactcacgaccggtgctcgatttagtgtgagtagtttgggtttgggggcgcctgggtacggccggggggtcgctgagactctcctgtgcggcctcgtggattaagtttaggagtcatgccatgaactgggtccgccaggctccagggaagggctggagtgggtctcggctattagtggcagtggtggcgctatatattatgcagacgccctgaagggccgttcaccatttccagagacaattcgaagaacacgctgtatctgacaaatggagagcctgagactcgacgacacggccgtctattattgtagttaaaggcgagcgtaggaatacggggaccgggccgacttgaccacgtcggggccaggggacgcgtggtcaccggtctcctcgacgccctccacgaacgggcccaacgtccggtccttcccccgtcggccctaccccgttcctacccaacgaccgcctaacccgtccgtacgggggccaccgacggaccgacgcccgtcgggaccgtcgcccgttcggtaccaacgggtacctaaccgttccgaacgtactcgttactccgtgacggcggtcgtcggacgaacggcgcacgtgncg

SEQ ID NO: 54075 - DNA, 520 bp, Homo sapiens
  misc_feature: GYAE6OF02GM0P7.29.78.H01.1.454.CMB.1.raw
  modified_base (399)..(399): a, c, t, g, unknown or other
  misc_feature (399)..(399): n is a, c, g, or t
tcagatagagtactcacgaccggtgctcgatttagtgtgagtagtttgggtttggggtccgagccatggtgcagactccccagagctctcctcctcctccactgcacagggtctctctcccagcctgtgctgactcaatcgccctctgcctctgcctccctgggaggctcggtcaaggtcacctgtactctgagcagtggacacagcagctacgccatcgcttggcatcagcagaggccagacacgggccctcgttacttgatgacagtcaacaatgatggcagtcacagcgaagggggacgggatcccgtgatcgcttctcagtctccagctctgggcctgagcgctacctcacaatcctccggcctccgagtctgaggatggaggctgactattacngtcagaccgtggggcacgtggctattcgaggttctcgggaccgggaccaagggtcctaccggtcggtcggtcacggacccaacggcccaacccgcgtcgacccacttccgtcgttcccccg

SEQ ID NO: 54076 - DNA, 168 bp, Homo sapiens
  misc_feature: GYAE6OF02G97JW.29.78.H01.1.454.CMB.1.raw
  modified_base (168)..(168): a, c, t, g, unknown or other
  misc_feature (168)..(168): n is a, c, g, or t
tcagatagagtactcacgaccggtgctcgatttagtgtgagtagtttgggtttgggggtctccactcccgccttgacggggctgccatcagcccaaggccaaccccactgtcactctgttcccaccctcctcagtactctatctgagcgggctggcaaggcgcatagn

SEQ ID NO: 54077 - DNA, 499 bp, Homo sapiens
  misc_feature: GYAE6OF02IZZD5.29.78.H01.1.454.CMB.1.raw
  modified_base (300)..(300): a, c, t, g, unknown or other
  misc_feature (300)..(300): n is a, c, g, or t
  modified_base (497)..(498): a, c, t, g, unknown or other
  misc_feature (497)..(498): n is a, c, g, or t
tcagatagagtactcacgaccggtgctcgatttagtgtgagtagtttgggtttggtggtctctctcccagcctgtgctgactcaatcgccctctgcctctgcctccctgggaggctcggtcaaggtcacctgtactctgagcagtggacacagcagctacgccatcgcttggcatcagcagaggccagacacgggccctcgttactgatgacagtcaacaatgattggcacgtcacagcaagggggacggatccctgatcgacttcgtcagtctccagctctgggcctgagcgctacctnacatcctccggctccagtctgagatgaggctgactattactgtcagaccgtggggcacgtgcattcaggttcttacgggaccgggtaccaaggtccaccggttcgtcggtcacgacccaaggccaaccctatcgtcactctcgttcccacctctccagtcctctatccgtgacgcgggctcggcaacggcacatagnnc

SEQ ID NO: 54078 - DNA, 580 bp, Homo sapiens
  misc_feature: GYAE6OF02IS2LK.29.78.H01.1.454.CMB.1.raw
  modified_base (246)..(246): a, c, t, g, unknown or other
  misc_feature (246)..(246): n is a, c, g, or t
tcagatagagtactcacgaccggtgctcgatttagtgtgagtagtttgggtttggggtctgagagaggagtccacccctgggatcttcaggtgttttcatttggtgatcaggacggaacagagagaactcaccatggagtttgggctgagcgtggtcgttttctaggtggctaattttaaaaggtgtccagtgtgacgtgcagttggtggagtctgggggcgcctggggtacgggccggggggtcnctgagactctcctgtgcggcctctggattaaggttttaggagtcatgccatgaactgggtccgcaggctccgagggaaggggctgggagtgggctggctattagtggcagtggtggcgctatatattatgcagacgccctggaagggccggttcacctatttccgagacgacaattcgaaagaacacgcttagtatctgcaaagtggagagccgtagagactcgacgacacggccgtctattattgtagttaaaggcgaagcgtaggaacgtaccggggaccgggcccggtacgttcgacctacggtcggggaccgaggggacgtcgtggtccg

SEQ ID NO: 54079 - DNA, 598 bp, Homo sapiens
  misc_feature: GYAE6OF02HRM30.29.78.H01.1.454.CMB.1.raw
  modified_base (375)..(375): a, c, t, g, unknown or other
  misc_feature (375)..(375): n is a, c, g, or t
tcagatagagtactcacgaccggtgctcgatttagtgtgagtagtttgggtttggggtctgagagaggagtccacccctgggatcttcaggtgttttcatttggtgatcaggacggaacagagagaactcaccatggagtttgggctgagcgtggcgttttctagtggctattttaaaaggtgtccagtgtgacgtgcagttggtggagtctgggggcgcctggggtacggccgggggggtcgctgaggactctcctgtgcggcctctggattaagttttaggagtcatgccatgaactgggtcgccaggctccgagggaagggctgggagtgggtctcggctattaggtggcagtggtggcgctatagtattangtacagtacgccctggaacgggtccggttacaccgtactttccagacgactaattcgaagtaacacgctagtatctgactaaagtggagagtcctgacgacgtcgacgaacacggccgtatacttattggtagtaaaggccgaagtcgtaggtaagtaccggggaccgggcccgaacgttcgaaccgtacggtcggggccgacgggggaccgcgtggtacccg

SEQ ID NO: 54080 - DNA, 539 bp, Homo sapiens
  misc_feature: GYAE6OF02IQQOD.29.78.H01.1.454.CMB.1.raw
  modified_base (285)..(285): a, c, t, g, unknown or other
  misc_feature (285)..(285): n is a, c, g, or t
  modified_base (538)..(539): a, c, t, g, unknown or other
  misc_feature (538)..(539): n is a, c, g, or t
tcagatagagtactcacgaccggtgctcgatttagtgtgagtagtttgggtttgggggcgcctgggtacggccggggggtcgctgagactctcctgtgcggcctctgggattaagttttaggagtcatgcccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatgganagcctgagactcgacgacacggccgtctattattgtgttaaaggcgagctggaatacgggaccgggccacttgaccactggggccaggggacgctggtcaccgtctcctcagcctccaccaagggcccatcggtctcccctggcaccctcctccaagacgcacctctcgggggcacagcagccctgggctgcctggtcaacggactacgttccgagtactctatctgagcggactggcaacggcgcagtacgnn

SEQ ID NO: 54081 - DNA, 493 bp, Homo sapiens
  misc_feature: GYAE6OF02H4FND.29.78.H01.1.454.CMB.1.raw
  modified_base (473)..(473): a, c, t, g, unknown or other
  misc_feature (473)..(473): n is a, c, g, or t
tcagatagagtactcacgaccggtgctcgatttagtgtgagtagtttgggtttggggtccgagccatggtgcagactccccagagctctcctcctcctccactgcacagggtctctctcccagcctgtgctgactcaatcgccctctgcctctgcctccctgggaggctcggtcaaggtcacctgtactctgagcagtggacacagcagctacgccatcgcttggcatcagcagaggccagacacgggccctgttacttgatgacagtcaacaatgatggcagtcacagcgaagggggacggatccctgatcgcttctcagtctccagctctgggcctgagcgctacctcacaatctccggcctccagtctgaggatgaggctgactattactgtcagaccgtggggcacgtggcattcgagttctcgggacgggaccaggtcaccggtcgcggtcagcccaagcccaacccnctcgccactctcgttacccc

SEQ ID NO: 54082 - DNA, 496 bp, Homo sapiens
  misc_feature: GYAE6OF02GUVCT.29.78.H01.1.454.CMB.1.raw
  modified_base (369)..(369): a, c, t, g, unknown or other
  misc_feature (369)..(369): n is a, c, g, or t
  modified_base (475)..(475): a, c, t, g, unknown or other
  misc_feature (475)..(475): n is a, c, g, or t
  modified_base (488)..(488): a, c, t, g, unknown or other
  misc_feature (488)..(488): n is a, c, g, or t
tcagatagagtactcacgaccggtgctcgatttagtgtgagtagtttgggtttggggtccgagccatggtgcagactccccagagctctcctcctcctccactgcacagggtctctctcccagcctgtgctgactcaatcgccctctgcctctgcctccctgggaggctcggtcaaggtcacctgtactctgagcagtggacacagcagctacgccatcgcttggcatcagcagaggccagacacgggcctcgttactgatgacagtcaacaatgatggcagtcacagcgaagggggacggatccctgatcgcttctcagtctccagctctgggcctgagcgctacctcacaatctccggctccagtcngagatgagctgactattactgtcagaccgtgggcacgtggcattcgaggttcttcgggaccgggacagggtcaccggtcgtcggtcacgccgaacggcccaacccnctcgtccacttcncgtccccg

SEQ ID NO: 54083 - DNA, 524 bp, Homo sapiens
  misc_feature: GYAE6OF02IMO4V.29.78.H01.1.454.CMB.1.raw
  modified_base (521)..(521): a, c, t, g, unknown or other
  misc_feature (521)..(521): n is a, c, g, or t
  modified_base (523)..(524): a, c, t, g, unknown or other
  misc_feature (523)..(524): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccgggcccgacttgaccactggggccaggggacgctggtcaccgtctcctcagcctccacagggcccatcgtctcccctgcacctcctccagacgcacctctggggcacagcggccctgggctgcctggtcaaggactacttccagtactctatctgagcgggctggcaggcgcangnn

SEQ ID NO: 54084 - DNA, 570 bp, Homo sapiens
  misc_feature: GYAE6OF02IT4IM.29.78.H01.1.454.CMB.1.raw
  modified_base (389)..(389): a, c, t, g, unknown or other
  misc_feature (389)..(389): n is a, c, g, or t
  modified_base (568)..(568): a, c, t, g, unknown or other
  misc_feature (568)..(568): n is a, c, g, or t
tcagatagagtactcacgaccggtgctcgatttagtgtgagtagtttgggtttgggggcgcctgggtacggccgggggggtcgctgagactcttcctgtgcggcctctggattaagttttaggagtcatgccatgaactgggtccgccgaggctccaggggtaaggggctggagtgggttctcggctattagtggcagtggtggcgctatatattagtgcaggacgccctgaaggggcccggttcaccattttcccagagacaattcgaagaacacgctagtatctgacaaatggagagcctgagctcgacgacacggcgtctattatgtgttaaaggcgagctggaatacgggaccgggccgacttgaccacttggggccaggggacnctggtcaccgtctcctcagcctccacgaaggcccatccggtcttcccctggcctaccctcctccaacgacgaccacctcgtcggggccacgacgcacgcccgtgggcctcgccgtcggtcgaacggactacgtccagtactactacgtctgacggcggcgtggcgaggtcgcgtagtgncg

SEQ ID NO: 54085 - DNA, 692 bp, Homo sapiens
  misc_feature: GYAE6OF02JPYSA.29.78.H01.1.454.CMB.1.raw
tcagatagagtactcacgaccggtgctcgatttagtgtgagtagtttgggtttgggggtcggccgtgggtacggccggggggtcgctgagactctcctgtgcggcctctggattaagttttaggagtcatgccatgaactgggtccgccaggctccagggaaggggctggagtgggtcgtcggctattagtggcagtggtggcgctatatattatgcagacggccctgaagggccgttcaccagtttccagagacaattcgaagacacgctgtatctgcaaatggagagcctgagacgtcgacgacacggccgtcgtattatgtagttaaaggcgagctaggaatacgggaccgggaccgtagttgacccgacgtggggtccagggggacctcgtggtccgaaccggttctccctacacgtccctaccgaaccgaacgggaccccaacgtcccggttaccttcccccgttcgggaccctaccccgtacccttacccaaacggacgaccgtaacccgtcgtcgggggaccacgacgaccgacgccccgtacgggccgtcgtcccgttacgggttaccaacgggtaccttaccgttaccgtaacggttaccgttaccgtaaacgttccggtacggtaacggtccggggtaccgttacgggtaccggtaacgggccgtaccgacgttacggctcg

SEQ ID NO: 54086 - DNA, 611 bp, Homo sapiens
  misc_feature: GYAE6OF02H388I.29.78.H01.1.454.CMB.1.raw
  modified_base (380)..(380): a, c, t, g, unknown or other
  misc_feature (380)..(380): n is a, c, g, or t
  modified_base (609)..(609): a, c, t, g, unknown or other
  misc_feature (609)..(609): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcagctggaatacgggaccggggcccgacttgaccacgtgggggccaggggacncgtggtcaccgtctcctcagcctccaccaagggcccatccggtccttccccctcggccaccctccctcccaacgacgccaacccttcgtcgggggccacgacgccacgccccgtagggcctcggtcccgtcgggttaccaaacgggaccttaaccgtttaccgacgttaccgtcttacgtctaggacggtccgggccgttcgggacgaacgggccgacgtacgtacggncg

SEQ ID NO: 54087 - DNA, 549 bp, Homo sapiens
  misc_feature: GYAE6OF02GDYBO.29.78.H01.1.454.CMB.1.raw
  modified_base (383)..(383): a, c, t, g, unknown or other
  misc_feature (383)..(383): n is a, c, g, or t
  modified_base (548)..(549): a, c, t, g, unknown or other
  misc_feature (548)..(549): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacggggaccggggcccgacttgaccactgggggccagggggacnctggtcaccgtctcctcagcctccaccaagggcccatccggtccttccccctcggccaccctcctccaacgacgccacctcgtcggggccacgagcacgccctgggctcgccgtggtcaaggctacttccagtactctatctgacgcggctggcaggcgcatagnn

SEQ ID NO: 54088 - DNA, 558 bp, Homo sapiens
  misc_feature: GYAE6OF02IJW97.29.78.H01.1.454.CMB.1.raw
  modified_base (557)..(558): a, c, t, g, unknown or other
  misc_feature (557)..(558): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaaatggagagcctgagactcgacgacacggccgtctattattgtgttaaaggcgagctggaatacgggaccggggcccgacttgaccactggggccagggggacgctggtcaccgtctcctcagcctccaccaagggcccatccggtccttccccctggccaccctcctcccaacgacgccaccctcgtcgggggccacgacgcagcccctggggcctcgccctggtccaagggactaccgttccagtactctatctgacgcggctggcacggcgcatgnn

SEQ ID NO: 54089 - DNA, 485 bp, Homo sapiens
  misc_feature: GYAE6OF02FMAJ5.29.78.H01.1.454.CMB.1.raw
tcagatagagtactcacgaccggtgctcgatttagtgtgagtagtttgggtttggagtctgcaccatggctcggacccactcctcttcctcaccctcctcctccactgcacagggtctctctcccagcctgtgctgactcaatcgccctctgcctctgcctccctgggaggctcggtcaaggtcacctgtactctgagcagtggacacagcagctacgccatcgcttggcatcagcagaggccagacacgggccctcgttactgatgacagtcaacaatgatggcagtcacagcaagggggacggatccctgatcgcttctcagtctccagctctgggcctgagcgctacctcacaatctccggcctccagtctgaggatgagctgactattactgtcagactggggcacgtggcattcagtctcgggacgggacaggtcaccgtcgtcggtcacgcccaggccacccgactcgtcacgtctccg

SEQ ID NO: 54090 - DNA, 572 bp, Homo sapiens
  misc_feature: GYAE6OF02GX54U.29.78.H01.1.454.CMB.1.raw
  modified_base (155)..(155): a, c, t, g, unknown or other
  misc_feature (155)..(155): n is a, c, g, or t
  modified_base (242)..(242): a, c, t, g, unknown or other
  misc_feature (242)..(242): n is a, c, g, or t
  modified_base (266)..(266): a, c, t, g, unknown or other
  misc_feature (266)..(266): n is a, c, g, or t
  modified_base (462)..(462): a, c, t, g, unknown or other
  misc_feature (462)..(462): n is a, c, g, or t
tcagatagagtactcacgaccggtgctcgatttagtgtgagtagtttgggtttggggtctgagagaggagtccacccctgggatcttcaggtgttttcatttggtgatcaggacggaacagagagaactcaccatggagtttgggctgagcgtgngtttctaggtggctattttaaaaggtgtcagtgtgacgtgcagttggtggagtctgggggcgcctggggtacggccggggggggtcnctgagactctcctgtgcggccctntggattaagttttaggagtcatgccatgaactgggtcccgccaggctccgagggaaggggctgggagtgggtctcgggctattagtggcaggtggtggcgctatatattatgcagacgccctggaacgggccggttcacctatttccagtagacaattcgaaagaacacgctgatctgcaaagtggagagcctganactcgacgacgacggcgtctattagttgtagttaaaggcgagtcgtgaacgtcgggaccgggtcccgacgttcgacacggtcgggccgacgggggacgtcgtaggtcccg

SEQ ID NO: 54091 - DNA, 508 bp, Homo sapiens
  misc_feature: GYAE6OF02GK911.29.78.H01.1.454.CMB.1.raw
  modified_base (489)..(489): a, c, t, g, unknown or other
  misc_feature (489)..(489): n is a, c, g, or t
tcagatagagtactcacgaccggtgctcgatttagtgtgagtagtttgggtttggggtccgagccatggtgcagactccccagagctctcctcctcctccactgcacagggtctctctcccagcctgtgctgactcaatcgccctctgcctctgcctccctgggaggctcggtcaaggtcacctgtactctgagcagtggacacagcagctacgccatcgcttggcatcagcagacggccagacacgggccctgttacttgatgacagtcaacaatgatggcagtcacagcgaagggggcggatccctgatcgcttctcagtctcagctctgggcctgagcgctacctcacatcctccggcctccagtctgacggatggacggctagacttattactgtcagtaccgtggggcacgtggcagttcaggttccttcgggaccgggacaacggtcaccggtcggtcggtacacgcccaacggcccaacccngtcgccacttctcgtcccc

SEQ ID NO: 54092 - DNA, 584 bp, Homo sapiens
  misc_feature: GYAE6OF02JJDQE.29.78.H01.1.454.CMB.1.raw
  modified_base (380)..(380): a, c, t, g, unknown or other
  misc_feature (380)..(380): n is a, c, g, or t
  modified_base (581)..(581): a, c, t, g, unknown or other
  misc_feature (581)..(581): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgccaggctccagggaggggctggagtgggtctcggctattagtggcagtggtggcgctatatattatgcagacgccctgaagggccggttcaccatttccagagacaattcgaaagaacacgctgtatctgcaaatggagagcctgagactcgacgacacggccgtctattatgtgttaaaggcgagctaggaatacgggaccgggcccgaacttgaccactggggccagggggacncgtggtcaccgtctcctcagccctccacaagggcccagtcgtcttcccctggccaccctcctccaacgacgcacctcgtcggggccacgagcacgccctgggacctcgccgtcggtaccaacggaccttaccgttcctacgtacctcgtacgtcctaggacggtccgggtcgtcggaccgaacgggccgacgtacgtacgnacg

SEQ ID NO: 54093 - DNA, 543 bp, Homo sapiens
  misc_feature: GYAE6OF02HU5WO.29.78.H01.1.454.CMB.1.raw
  modified_base (453)..(453): a, c, t, g, unknown or other
  misc_feature (453)..(453): n is a, c, g, or t
  modified_base (542)..(543): a, c, t, g, unknown or other
  misc_feature (542)..(543): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccggggcccgattgaccactggggccagggggacgctggtcaccgtctcctcagcctccaccaacgggcccatccggtccttccccctcggccaccctcctccaagcncacctcgtggggcacagcacgccctgggctcgcctcggtcaacggactactccagtactctatctgagcgggctggcacggcgcatagnn

SEQ ID NO: 54094 - DNA, 597 bp, Homo sapiens
  misc_feature: GYAE6OF02H63RX.29.78.H01.1.454.CMB.1.raw
tcagatagagtactcacgaccggtgctcgatttagtgtgagtagtttgggtttggggtctgagagaggagtccacccctgggatcttcaggtgttttcatttggtgatcaggacggaacagagagaactcaccatggagtttgggctgagctggctttttcttgtggctattttaaaaggtgtccagtgtgacgtgcagttggtggagtctgggggcgcctggggtacgggccgggggggtcgctgagactctcctgtgcggcctctggattaagttttaggagtcatgccatgaactgggtccgccgaggcctccgaggggaaggggctgggaggtggggtctcggcttagttagtggcaggtgggtggcgctatatattatgcagacgccctggacgggccgttcacctatttccagagacaattcgaaagaacacgctgtatctgacaaatggagagcctgacgactcgaccgacgaccggccgtctattattgtaggttaaaggcgagtcgtagggaacgtacggggacccggggcccgaccgttcgacccgtacggtcgggggcccgagggggaccggtccgtgggtacccg

SEQ ID NO: 54095 - DNA, 683 bp, Homo sapiens
  misc_feature: GYAE6OF02FP3RF.29.78.H01.1.454.CMB.1.raw
  modified_base (678)..(678): a, c, t, g, unknown or other
  misc_feature (678)..(678): n is a, c, g, or t
tcagatagagtactcacgaccggtgctcgatttagtgtgagtagtttgggtttgggggggacgcctgggtacggccggggggttcgctgagacgtctcctagtgcgggcctctgggattaaagtttttaggacgtcatgccgacgtgtaacctgggtcccgcccaggccttcccagggaagggctggagtgggtctcgggctagttacgtggcagtggtggcgctatatacttactgcagacgcccgtcggaagggccggttcgaccatttccagagtacaattcgaagaaccaaccgcctagtatctagactaaaatggaagtagtcctgagactcgaaccgaccacggccgtcgtacttattcgtgttaaaggccgagcgtaggaaatacgggaccgggcccgacttgaccgacgtggggccaggggacgcgtggtccaccgtctcctcgacgccctccaccgacggcccacgtccggtccttcccccgtcggccgacccgtcccgtcccgaacgacgcgaccgtcgtcggggcacgacgcgacgcccgtcgggcctcggccgtcggtaccgaaacggtacgttaaccgttaccgaacgttacttccttacgttccggttacggtacgggtccgggtccgtacggggaccgaaacgggccggtaccgaacgtacgngtacg

SEQ ID NO: 54096 - DNA, 741 bp, Homo sapiens
  misc_feature: GYAE6OF02I5HVC.29.78.H01.1.454.CMB.1.raw
  modified_base (235)..(236): a, c, t, g, unknown or other
  misc_feature (235)..(236): n is a, c, g, or t
tcagatagagtactcacgaccggtgctcgatttagtgtgagtagtttgggtttggggcgcctgggtacgggccggggggtcgctgagactctcctgtgcggcctctggattaagttttaggagtcatgccatgaacgtgggtccgccaggctccgagggaaggggcgtggaggtgggtcgtcggctattagtggcgagtggtggcgctatatattatgcagacgccgtgaggccnngttcacacttaccagagaacaactacgaagaacacgacgtacgtaatacgtagagactaagtaggaagtacgacgagacgacgtacgacgtacgtacgtacgttacgttagttagttagttaggtaacggtacggtacggtaccgtacggtaacggtaaccggggaacccgggtaccggtaccgtacggaccgtacggtacgggaccggacgggtacgtaccgtacggtaccgtacccgtaccgtaccgtacgaccgtacccgtacccgaacccgtaacccggtacccgtaccgtacccggttacccgttacccgtaccggacccgtacccgtacccgtacccgtaacggaccgactaccgtaccgggtacgggaccgacgacgacgaccgtacccggtacggtaccggtaccgtaccgttaccgtaaccgtaacgtaccttaccgttaccgtaacgtaccgtacgttacgttacgtacggacgggacggtacggtacggtacgg

SEQ ID NO: 54097 - DNA, 561 bp, Homo sapiens
  misc_feature: GYAE6OF02H20SH.29.78.H01.1.454.CMB.1.raw
  modified_base (453)..(453): a, c, t, g, unknown or other
  misc_feature (453)..(453): n is a, c, g, or t
  modified_base (558)..(558): a, c, t, g, unknown or other
  misc_feature (558)..(558): n is a, c, g, or t
tcagatagagtactcacgaccggtgctcgatttagtgtgagtagtttgggtttggtgggtcgtctctcccagcctgtgcgtgactcaatcgccctctgcctctgcctccctgggagctcggtcaaggtcacctgtactctgagcagtggacacagcagctacgccatcgcttggcatcagcagaggccagacactggccctgttacttgatgacagtcaacaatgatggcagtcacaggcaaagggggacggatcccgtgatcgcttctcgagtctccagctctggcctggagcgctaccgtcacatctccgcctcagtctgagatgaggtctgactattactgtcagtaccgtggggcacgtggactattcgaggtccttacgggaccggggaccaaagggttccaaccggttcggttacggtactacggacccaaagggccccaaacccgngttacgtactaccttcgtcgttccccaccgttcctacgtacgttacctacgtacgtccgtaggacgtccgggacttacgggactaacgggccacgtaagtacggntcg

SEQ ID NO: 54098 - DNA, 492 bp, Homo sapiens
  misc_feature: GYAE6OF02IQMAZ.29.78.H01.1.454.CMB.1.raw
  modified_base (487)..(487): a, c, t, g, unknown or other
  misc_feature (487)..(487): n is a, c, g, or t
  modified_base (491)..(492): a, c, t, g, unknown or other
  misc_feature (491)..(492): n is a, c, g, or t
tcagatagagtactcacgaccggtgctcgatttagtgtgagtagtttgggtttggtggtctctctcccagcctgtgctgactcaatcgccctctgcctctgcctccctgggaggctcggtcaaggtcacctgtactctgagcagtggacacagcagctacgccatcgcttggcatcagcagaggccagacacgtgccctgttacttgatgacagtcaacaatgatggcagtcacagcgaagggggacggatccctgatcgcttctcagtctccagctctgggcctgacgcgctacctcacaatcctccggcctcagtctgagatgagctgactatactgtcagaccgtggggcacgtggctattcgaggttcttcgggaccgggaccaaggtccaccgtcgtcgtcacgcccaaggcccaacccgatcgtccactctcgttccccaccttcctcacgtactctatctgacgcggctggacgaggcgnatgnn

SEQ ID NO: 54099 - DNA, 538 bp, Homo sapiens
  misc_feature: GYAE6OF02H35M6.29.78.H01.1.454.CMB.1.raw
  modified_base (321)..(321): a, c, t, g, unknown or other
  misc_feature (321)..(321): n is a, c, g, or t
  modified_base (385)..(385): a, c, t, g, unknown or other
  misc_feature (385)..(385): n is a, c, g, or t
tcagatagagtactcacgaccggtgctcgatttagtgtgagtagtttgggtttggggtccgagccatggtgcagactccccagagctctcctcctcctccactgcacagggtctctctcccagcctgtgctgactcaatcgccctctgcctctgcctccctgggaggctcggtcaaggtcacctgtactctgagcagtggacacagcagctacgccatcgcttggcatcagcagaggccagacacgggccctcgttactgatgacagtcaaacaatgatggcagtcacagcgaaggggggacggatcccgtgatcgcttcncagtctccagctcgtgggcctgacgcgctacctcaacaatccgtccggcctccagtctagaggntgaggctagacttattactgtcagaccgtggggctacgtggctagttcgaggttccgttacgggaccgggactaacggtccgaccggtcggtcggtaccacggcccgaacggaccccaacccgtcgtcgtacctacctccgtccgttcccccg

SEQ ID NO: 54100 - DNA, 722 bp, Homo sapiens
  misc_feature: GYAE6OF02G3R3F.29.78.H01.1.454.CMB.1.raw
  modified_base (246)..(246): a, c, t, g, unknown or other
  misc_feature (246)..(246): n is a, c, g, or t
tcagatagagtactcacgaccggtgctcgatttagtgtgagtagtttgggtttggggtctgagagaggagtccacccctgggatcttcaggtgttttcatttggtgatcaggacggaacagagagaactcaccatggagtttgggctgagcggtgtgtttctaggtcggctaattttaaaggtgtcagtgtgacgtgcagttggtggagtcgtgggggcgccgtggggtacgggccgggggggtcncgtgagactctcctgtcgcggcctctggatttaagtttaggatcatgccatgaactgggtccgccaggctccgaggggagggctggagtgggtctcggctagtagtgctaggtggtggcgctatatattatcgacagaccgccctaggaacgggtccgttacaccgtatttcccgaagacgtaacgaagtttaccggaaacggaaaccacggtacgttaggttaacttccgttaggaacctaaaagttggggaaacgacggtacccgttaggaaacggtaccgttacggaaccggaacccgtaccggggtcccgtttactttaacgttttaagtttcgggttaaaggtttaaaacgggccgtaaggtaccgtagggtaaacggttaacccgggggacccggggtcccgtaacgtttcggaacccgtacgggttacgggggacccgtaacggggggtacctcggttccggtacccgg

SEQ ID NO: 54101 - DNA, 577 bp, Homo sapiens
  misc_feature: GYAE6OF02HVEZQ.29.78.H01.1.454.CMB.1.raw
  modified_base (575)..(575): a, c, t, g, unknown or other
  misc_feature (575)..(575): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccgggcccattgaccactggggccaggggacgctggtcaccgtctcctcagccctccaccgaagggcccatccggtccttccccctcggccaccctcctaccaacgacgccaccgtcgtcggggccacgacgccacgcccgtgggcctcgcccgtcgggtcaacgggtactaccttaccgacgttacctctacgtctgacggccgggctggccaacgggccgaccatacgncg

SEQ ID NO: 54102 - DNA, 571 bp, Homo sapiens
  misc_feature: GYAE6OF02JS01W.29.78.H01.1.454.CMB.1.raw
  modified_base (242)..(242): a, c, t, g, unknown or other
  misc_feature (242)..(242): n is a, c, g, or t
  modified_base (560)..(560): a, c, t, g, unknown or other
  misc_feature (560)..(560): n is a, c, g, or t
tcagatagagtactcacgaccggtgctcgatttagtgtgagtagtttgggtttggggtctgagagaggagtccacccctgggatcttcaggtgttttcatttggtgatcaggacggaacagagagaactcaccatggagtttgggctgagcgtggcgttttctagtggctattttaaaaggtgtccagtgtgacgtgcagttggtggagtctgggggcgcctgggtacggccgggggggtcncgtgagactctcctgtgcggcctctggattaagttttaggagtcatgccatgaactggttccgcaggctccagggaaggggctggagtgggtctcgggctagttagtggcaggtggtggcgctatatattatgctagacgccctggaagggccgttcaccgtatttccagtagactaattcgaagaacacgctagtatctagacaaatggagagcctgagactcgacgacacggcgtctattatgtagttaaggcgagctggaagtaccggggacgggcccgtacgttacgccgaacggtcggggaccgaggggaccncgtcggtaccg

SEQ ID NO: 54103 - DNA, 568 bp, Homo sapiens
  misc_feature: GYAE6OF02I2SYI.29.78.H01.1.454.CMB.1.raw
  modified_base (160)..(160): a, c, t, g, unknown or other
  misc_feature (160)..(160): n is a, c, g, or t
  modified_base (445)..(445): a, c, t, g, unknown or other
  misc_feature (445)..(445): n is a, c, g, or t
tcagatagagtactcacgaccggtgctcgatttagtgtgagtagtttgggtttgggggaagaggaagactgacggtccacccctgggatcttcaggtgttttcatttggtgatcaggacggaacagagagaactcaccatggagtttgggctgagcgtgngtttctaggtggctatttaaaggtgtcagtgtgacgtgcagttggtggagtctgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagtagacaattcgaagaacacgctgtatctgcaaatgganagcctgagactcgacgacacggccgtctattattgtgttaaaggcgagctggaagtacggggacccggggacccgacgttggacccgtacgtcgggggacccagggggaccgcgtggtacccg

SEQ ID NO: 54104 - DNA, 565 bp, Homo sapiens
  misc_feature: GYAE6OF02IQO4S.29.78.H01.1.454.CMB.1.raw
  modified_base (480)..(480): a, c, t, g, unknown or other
  misc_feature (480)..(480): n is a, c, g, or t
  modified_base (494)..(494): a, c, t, g, unknown or other
  misc_feature (494)..(494): n is a, c, g, or t
  modified_base (563)..(564): a, c, t, g, unknown or other
  misc_feature (563)..(564): n is a, c, g, or t
tcagatagagtactcacgaccggtgctcgatttagtgtgagtagtttgggtttgggggcgcctgggtacggccgggggggtcgctgagactctcctgtgcggcctctggatttaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgacaaatggagagcctgagactcgacgacacggccgtctattattgtgttaaaggcgagctggaagtacgggaccggggccgacttgaccacgtggggccaggggacgcgtggtcaccgtctcctcacgccctccaccgaacgggcccatccggtccttcccccgtcggcctaccctccctccaagcgcacctcgtcggggcacngcacgccgtgggcncgccgtggtacaacggactaccttccagtactctactctgacggcggcgtggacacgggcgacgatagnng

SEQ ID NO: 54105 - DNA, 556 bp, Homo sapiens
  misc_feature: GYAE6OF02JLAU3.29.78.H01.1.454.CMB.1.raw
  modified_base (466)..(466): a, c, t, g, unknown or other
  misc_feature (466)..(466): n is a, c, g, or t
  modified_base (554)..(554): a, c, t, g, unknown or other
  misc_feature (554)..(554): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccgggcccgacttgaccactggggccaggggacgctggtcaccgtctcctcacgcctccaccacgggcccatcggtccttccccctggccaccctcctccaacgcgccacctctggggcacngcagccctgggctcgccgtggtcaacggacctacttaccgacgtactctatcctgacggcggcgtggccgaacgggccgacagtacgnac

SEQ ID NO: 54106 - DNA, 543 bp, Homo sapiens
  misc_feature: GYAE6OF02GGSLV.29.78.H01.1.454.CMB.1.raw
  modified_base (537)..(537): a, c, t, g, unknown or other
  misc_feature (537)..(537): n is a, c, g, or t
  modified_base (541)..(543): a, c, t, g, unknown or other
  misc_feature (541)..(543): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagccggaatacggggaccggggcccgacttgaccactggggccagggggacgctgggtcaccgtctcctcagcctccaccaagggcccatcggtcttccccctggccaccctcctccaagacgcacctcgtggggccacacgcacgccctgggctgcctggtcaaggactacttccagtactctatctgagcgggctggcaggcgcanacgnnn

SEQ ID NO: 54107 - DNA, 639 bp, Homo sapiens
  misc_feature: GYAE6OF02FR7N2.29.78.H01.1.454.CMB.1.raw
  modified_base (418)..(418): a, c, t, g, unknown or other
  misc_feature (418)..(418): n is a, c, g, or t
  modified_base (637)..(637): a, c, t, g, unknown or other
  misc_feature (637)..(637): n is a, c, g, or t
tcagatagagtactcacgaccggtgctcgatttagtgtgagtagtttgggtttggggggcgcctcgggtacggccgggggggtcgcgtcgggtaggactctcctgtgcggcctctggattaaagttttaggagttcgaatggaccaagtgaacctcgggtccggccaggcctaccgacgggaaacggggctggagtgggtctcgggcctacttacgtcggcagtggtggcgcgtagtatagttataggcagacgccctgaagggccggttcaccatttccagagacaattcgaagaacacgctgtatctgcaaatggagagcctgagactcgacgacacggccgtctattattgtgttaaaggcgagctggaatacggggaccgggcccgacgttgaccacgtggggccagggggacncgtggtcaccgtcgtcctcgacgccctccaccgaacggggcccagtccggtcttcccccgtgggccctaccctccctaccaacgacgccacctccgtcgggggccacgagcacgcccgtgggctcgccgtgggtccaacgggacttaccgttaccacggttacctcgtattcgtaggacggccggggtcgttcgggcgtaacgggccgacgagtacgancg

SEQ ID NO: 54108 - DNA, 563 bp, Homo sapiens
  misc_feature: GYAE6OF02I8LW5.29.78.H01.1.454.CMB.1.raw
  modified_base (561)..(561): a, c, t, g, unknown or other
  misc_feature (561)..(561): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccgggccgacttgaccacgtggggccaggggacgctggtcaccggtctcctcagcctccaccgaaggcccacgtcgtccttccccctggcccaccctcctccaacgacgcacctcgtcggggccacgacgccacgcccgtgggctcggcctggtcaacggactacttccagtacctctactctcgagtccgggcgtcggcgaacggccgcagtagncg

SEQ ID NO: 54109 - DNA, 545 bp, Homo sapiens
  misc_feature: GYAE6OF02H66MJ.29.78.H01.1.454.CMB.1.raw
  modified_base (544)..(545): a, c, t, g, unknown or other
  misc_feature (544)..(545): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccgggccgacttgaccactggggccagggggacgctgggtcaccggtctcctcagccctccacccaaggggcccacgtccggtcctttccccctcggccaccctccctcccaagacgcacctctggggcacagcagccctggctgcctggtcaaggactacttccagtactctatctgagcggctggcacggcgcatagnn

SEQ ID NO: 54110 - DNA, 169 bp, Homo sapiens
  misc_feature: GYAE6OF02HMTAS.29.78.H01.1.454.CMB.1.raw
  modified_base (168)..(169): a, c, t, g, unknown or other
  misc_feature (168)..(169): n is a, c, g, or t
tcagatagagtactcacgaccggtgctcgatttagtgtgagtagtttgggtttgggggtctccactcccgccttgacggggctgccatcagcccaaggccaaccccactgtcactctgttcccaccctcctcagtactctatctgagcgggctggcaaggcgcatagnn

SEQ ID NO: 54111 - DNA, 591 bp, Homo sapiens
  misc_feature: GYAE6OF02GZ9OH.29.78.H01.1.454.CMB.1.raw
tcagatagagtactcacgaccggtgctcgatttagtgtgagtagtttgggtttggggtctgagagaggagtccacccctgggatcttcaggtgttttcatttggtgatcaggacggaacagagagaactcaccatggagtttgggctgagcgtggcgttttctgtggctattttaaaaggtgtccagtgtgacgtgcagttggtggagtctgggggcgcctggggtacggccgggggggtcgcgtgagactctcctgtgcggcctctggattaagttttaggagtcatgccatgaactgggtccgccaggctccgagggaaggggctgggaggtgggtctcggctagttagtggcagtggtggcgctagtatattatgcagacgcctggaagggccgttcaccatttccagagacaagttcgaaagaacacgctgtatctgactaaagtggagagcctaggacaccgtcgaaccgacgacggtcccgtatattattggtagttaaaggcgaagcgttaggaacgttaccggggaccgggccctaacgttcgaacccgtaggtcgggggccagggggacgccgtaggtcccg

SEQ ID NO: 54112 - DNA, 561 bp, Homo sapiens
  misc_feature: GYAE6OF02I0JVQ.29.78.H01.1.454.CMB.1.raw
  modified_base (400)..(400): a, c, t, g, unknown or other
  misc_feature (400)..(400): n is a, c, g, or t
  modified_base (479)..(479): a, c, t, g, unknown or other
  misc_feature (479)..(479): n is a, c, g, or t
  modified_base (552)..(552): a, c, t, g, unknown or other
  misc_feature (552)..(552): n is a, c, g, or t
  modified_base (559)..(559): a, c, t, g, unknown or other
  misc_feature (559)..(559): n is a, c, g, or t
  modified_base (561)..(561): a, c, t, g, unknown or other
  misc_feature (561)..(561): n is a, c, g, or t
tcagatagagtactcacgaccggtgctcgatttagtgtgagtagtttgggtttgggggcgcctgggtacggccgggggggtcgctgaggactctcctgtgcggcctctggattaaacgttttaggagtcattgccatgaactgggtccgcaggctccagggaaggggcgtggagtgggtctcggctattagtggtcagtggtggcgctatatattatgcagacggccctgaagggccggttcaccatttccagagaccaattcgaagtaactacgcctgtatctgcaaatggagagcctgagactcgacgacacggccgtactattattgttagttaaaggcgtagccgtggaataccggggaccgggcccgacttcgacctacgtggggccagggggcncgtggtcaccgtctcctcacgcctccaccaggccatcgtctcccctgcacctctcacgcgctacctcgtgggcacgacncacgccgtaggtctcgcctggtccgaaggacctacgtacgagtactctactctagacggcggctggcacggcncgatagntn

SEQ ID NO: 54113 - DNA, 547 bp, Homo sapiens
  misc_feature: GYAE6OF02ID1C2.29.78.H01.1.454.CMB.1.raw
  modified_base (546)..(547): a, c, t, g, unknown or other
  misc_feature (546)..(547): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaaatggagagcctgagactcgacgacacggccgtctattattgtgttaaaggcgagctggaatacgggaccgggcccgattgaccactggggccaggggacgctggtcaccgtctcctcagcctccaccaagggcccatcggtcttccccctggcaccctcctccaagacgccacctcgtcgggggccacgagccagcccgtgggcctcgcctcggtcaacggactacttccagtactctatctgacgcggctggcaacggccgcatagnn

SEQ ID NO: 54114 - DNA, 536 bp, Homo sapiens
  misc_feature: GYAE6OF02FUHJL.29.78.H01.1.454.CMB.1.raw
  modified_base (536)..(536): a, c, t, g, unknown or other
  misc_feature (536)..(536): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccgggcccgacttgaccactggggccaggggacgctggtcaccgtctcctcagcctccaccaagggcccatcggtcttccccctggccaccctcctccaagacgccacctcgtggggccacagcacgccctgggctgcctggtcaaggactacttccagtactctatctgagcggctggcacggcgcatagn

SEQ ID NO: 54115 - DNA, 167 bp, Homo sapiens; identical to SEQ ID NO: 53056
  misc_feature: GYAE6OF02HUEYO.29.78.H01.1.454.CMB.1.raw
  modified_base (167)..(167): a, c, t, g, unknown or other
  misc_feature (167)..(167): n is a, c, g, or t

SEQ ID NO: 54116 - DNA, 567 bp, Homo sapiens
  misc_feature: GYAE6OF02HX09D.29.78.H01.1.454.CMB.1.raw
  modified_base (380)..(380): a, c, t, g, unknown or other
  misc_feature (380)..(380): n is a, c, g, or t
  modified_base (566)..(566): a, c, t, g, unknown or other
  misc_feature (566)..(566): n is a, c, g, or t
tcagatagagtactcacgaccggtgctcgatttagtgtgagtagtttgggtttgggggcgcctgggtacggccggggggtcgctgagactctcctgtgcggcctcgtggaattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccgggcccattgaccacgtcggggccaggggacnctggtcggacctctcctcagcctccaccaagggcccacgtccggtccttccccgtcggccaccctccctccaacgacgcaccgtcgtcgggggcacagcacgcccgtgggctcgcctcggtacaacggacttactccacgtactctactcgtcgacggcgggctggacgacggccgacgtagtcgnc

SEQ ID NO: 54117 - DNA, 586 bp, Homo sapiens
  misc_feature: GYAE6OF02JEMKT.29.78.H01.1.454.CMB.1.raw
  modified_base (239)..(239): a, c, t, g, unknown or other
  misc_feature (239)..(239): n is a, c, g, or t
  modified_base (272)..(272): a, c, t, g, unknown or other
  misc_feature (272)..(272): n is a, c, g, or t
tcagatagagtactcacgaccggtgctcgatttagtgtgagtagtttgggtttgggggcgcctgggtacgggccggggggtcgctgagactctcctgtgcggcctctggattaagtttaggagtcatgccatgactgggtccgccaggctccgagggaaggggcgtggaggtgggtcgtcggctattagtggcagtggtggcgctatatattatgcagacgcctgaacgggccggttcnacctactttaccagagacactacgaacgaacangactagtatctagacaatggagagctgagactcgacgacacggccgtctattattgtagttaaaggcgagacgtaggaagtacgggaccggggacccgacgtcgaccacgtgggccgacggggacgcgtggtcgaccgtcgtcctcgacgcctccaccgaacggacccgacgtacggtccttcccctcgccaccctccctaccaacgacgccacctcgtcgggcgacgacgacgacgcccgtcggcgcgccgtcgtacgaacgacgtacctaccgtacgtactctactactagacgcggcgtcggacgacgcgc

SEQ ID NO: 54118 - DNA, 168 bp, Homo sapiens
  misc_feature: GYAE6OF02GITVD.29.78.H01.1.454.CMB.1.raw
  modified_base (168)..(168): a, c, t, g, unknown or other
  misc_feature (168)..(168): n is a, c, g, or t
tcagatagagtactcacgaccggtgctcgatttagtgtgagtagtttgggtttgggggtctccactcccgccttgacggggctgccatcagcccaaggccaaccccactgtcactctgttcccgccctcctcagtactctatctgagcgggctggcaaggcgcatagn

SEQ ID NO: 54119 - DNA, 549 bp, Homo sapiens
  misc_feature: GYAE6OF02GVIHW.29.78.H01.1.454.CMB.1.raw
  modified_base (548)..(549): a, c, t, g, unknown or other
  misc_feature (548)..(549): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccggggcccgacttgaccactgggggccagggggacgctggtcaccgtctcctcagcctccaccaagggcccatccggtcttccccctggccaccctcctcccaacgacgccaccctcgtcgggggccacgagccagccctgggcctgcctggtcaaggacctacttccagtactctatctgacgcggctggcaggcgcatagnn

SEQ ID NO: 54120 - DNA, 560 bp, Homo sapiens
  misc_feature: GYAE6OF02GLKNM.29.78.H01.1.454.CMB.1.raw
  modified_base (559)..(560): a, c, t, g, unknown or other
  misc_feature (559)..(560): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccggggcccgacttgaccacgtggggccagggggacgctggtcaccggtctcctcagcctccaccaagggcccatccggtccttccccctcggccaccctccctcccaacgacgccaccctccgtcgggggccacacgccacgccccgtgggctcgcctggtcaaggactacttccagtactctatctgagcgggctggcacggccgcactagnn

SEQ ID NO: 54121 - DNA, 497 bp, Homo sapiens
  misc_feature: GYAE6OF02ICBC2.29.78.H01.1.454.CMB.1.raw
  modified_base (268)..(268): a, c, t, g, unknown or other
  misc_feature (268)..(268): n is a, c, g, or t
  modified_base (371)..(371): a, c, t, g, unknown or other
  misc_feature (371)..(371): n is a, c, g, or t
  modified_base (437)..(437): a, c, t, g, unknown or other
  misc_feature (437)..(437): n is a, c, g, or t
  modified_base (456)..(456): a, c, t, g, unknown or other
  misc_feature (456)..(456): n is a, c, g, or t
  modified_base (461)..(461): a, c, t, g, unknown or other
  misc_feature (461)..(461): n is a, c, g, or t
  modified_base (466)..(466): a, c, t, g, unknown or other
  misc_feature (466)..(466): n is a, c, g, or t
  modified_base (473)..(473): a, c, t, g, unknown or other
  misc_feature (473)..(473): n is a, c, g, or t
  modified_base (490)..(490): a, c, t, g, unknown or other
  misc_feature (490)..(490): n is a, c, g, or t
  modified_base (494)..(494): a, c, t, g, unknown or other
  misc_feature (494)..(494): n is a, c, g, or t
  modified_base (497)..(497): a, c, t, g, unknown or other
  misc_feature (497)..(497): n is a, c, g, or t
tcagatagagtactcacgaccggtgctcgatttagtgtgagtagtttgggtttggtggtctctctcccagcctgtgctgactcaatcgccctctgcctctgcctccctgggaggctcggtcaaggtcacctgtactctgagcagtggacacagcagctacgccatcgcttggcatcagcagaggccagacacgggccctgttacttgatgacagtcaacaatgatggcagtcacagcgaaaggggggacggatcccgtgatcgcttcncagtctcagctcgtgggcctggagccgctacctcacaatctccggcctcagtctgaggatggagctgacttatactgtcagccgtgggcacgtggcagttcgnggttccgttacgggaccggggacaagggtccaccggttcgtcggtcacgccaacggcccaacccgntcgtcacttctcgttcccncctcncatcnctatcgngcgcggtctagcaggcnagtnctn

SEQ ID NO: 54122 - DNA, 541 bp, Homo sapiens
  misc_feature: GYAE6OF02F61XC.29.78.H01.1.454.CMB.1.raw
  modified_base (540)..(541): a, c, t, g, unknown or other
  misc_feature (540)..(541): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccgggcccgacttgaccactggggccaggggacgctggtcaccgtctcctcacgcctccaccaagggcccatcggtcttccccctggccaccctcctccaacgacgcaccctcgtgggggccacagcagccctgggctgcctggtcaaggactacttccagtactctatctgagcgggctggcaaggcgcgatagnn

SEQ ID NO: 54123 - DNA, 869 bp, Homo sapiens
  misc_feature: GYAE6OF02H58JH.29.78.H01.1.454.CMB.1.raw
tcagatagagtactcacgaccggtgctcgatttagtgtgagtagtttgggtttggggtccgagccatggtgcagactccccagagctctcctcctcctccactgcacagggtctctctcccagcctgtgctgactcaatcgccctctgcctctgcctccctgggaggctcggtcaaggtcacccgtactctcgagcacgtggacgacagacgacgacgtacgaccgactcgtcgttcggtcgactacgacgacgacgaggaccgacgaacgaccgggtccccgtaccgtttacgtttacgtagtacgtacgaacgtactaacaaatagagtaggtcgacgtacgacgaacggacggaacggggggaacggggtacgtaccctacggtagtaccgtccgttccttacgacgtccgttaccacgccgttccgttcgggccggtcgacgaccgtcccttaccctacctaaccaaacgttcccgttcccgggtaccccgtacccgtacgttacgtacgggtaagggtaacgtcgggtaccgggtacgttacgttaaaccgttaactttttaaacgtccggttaccggaacggtaacccgggttccgggggtacggtaaacccgttggggtacccgttaacgtttttacccggtacggggtttacccgggtttaccccgggggtaaaccccggggggaaacccgttaacgggttacccggttaccccgggttccccggggtttaccggggtaaccctaacccgggaacccccggtaacccgggttaacccccgaaccccccgttaacccggttcggttaaccccgttacccgttacccgttttcccccgggttaacccccggttaccccccccc

SEQ ID NO: 54124 - DNA, 493 bp, Homo sapiens
  misc_feature: GYAE6OF02IPEHP.29.78.H01.1.454.CMB.1.raw
  modified_base (476)..(476): a, c, t, g, unknown or other
  misc_feature (476)..(476): n is a, c, g, or t
tcagatagagtactcacgaccggtgctcgatttagtgtgagtagtttgggtttggggttccggagccatggtgcagactcccacgagctctcctcctcctccactgcacagggtctctctcccagcctgtgctgactcaatcgccctctgcctctgcctccctgggaggctcggtcaaggtcacctgtactctgagcagtggacacagcagctacgccatcgcttggcatcagcagaggccagacacgggcccctcgttacttgatgacagtcaacaatgatggcagtcacagcaagggggcggatccctgatcgcttctacagtctccagctctgggcctgaagcgctacctcacaatctccggcctccagtctgaggatgaggctgactattactgtcagacctggggcacgttggcattcagttctcggaccgggcaaggtcacgtcgtcgtcagcccaaggcccaaccccgntgccactctgttccccg

SEQ ID NO: 54125 - DNA, 537 bp, Homo sapiens
  misc_feature: GYAE6OF02F24SD.29.78.H01.1.454.CMB.1.raw
  modified_base (536)..(537): a, c, t, g, unknown or other
  misc_feature (536)..(537): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccggggcccgacttgaccactggggccaggggacgctggtcaccgtctcctcagcctccaccaagggcccatcggtcttcccctcggcaccctcctccaacgacgcacctctcggggcacacgcacgccctgggctgcctggtcaaggactacttccagtactctatctgagcgggctggcaggcgcatagnn

SEQ ID NO: 54126 - DNA, 684 bp, Homo sapiens
  misc_feature: GYAE6OF02JIN6C.29.78.H01.1.454.CMB.1.raw
  modified_base (242)..(242): a, c, t, g, unknown or other
  misc_feature (242)..(242): n is a, c, g, or t
  modified_base (264)..(264): a, c, t, g, unknown or other
  misc_feature (264)..(264): n is a, c, g, or t
  modified_base (348)..(348): a, c, t, g, unknown or other
  misc_feature (348)..(348): n is a, c, g, or t
tcagatagagtactcacgaccggtgctcgatttagtgtgagtagtttgggtttggggtctgagagaggagtccacccctgggatcttcaggtgttttcatttggtgatcaggacggaacagagagaactcaccatggagtttgggctgagcgtgtcttttctagtggctaatttaaaaggtgtccagtgtgacgtgcagttggtggagtctgggggcgccgtgggtacgggccggggggtcncgtgagctctctgtgcggcctntggatttaagtttaggagtcatgccatgaactggtccgccaggctccgagggaagggctggagtggtctcggatagttgtggcngtggtggcgctatatattagtgcgagacgcccgtaggaacgggtcccggtttacacccgtaagtttcccaagtaagaacctaaagttacggaaagtaaacccgacgtacgttagtacttacgtacgaacgtaaaggtggaacgacgtaccgtagaacgtaccgtacggaccgaaccgtaccggtaccttacttaagtttagttaggtaaacggttaaacggcggtaacgtacggttaacgggtaaaccgggtcccgggggaacccgggtaccgtaaccggttaccggaaccgtacgggtcggggaccggacggggtaccggccggttcggtacccg

SEQ ID NO: 54127 - DNA, 607 bp, Homo sapiens
  misc_feature: GYAE6OF02JJBJV.29.78.H01.1.454.CMB.1.raw
  modified_base (605)..(605): a, c, t, g, unknown or other
  misc_feature (605)..(605): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattatgtgttaaaggcgagctggaatacggggaccgggcccgacttgaccacgtgggggccaggggacgcgtggtcaccgtctcctcagccctccaccgaacgggcccacgtccggtccttcccccgtcggccaccctccctccaacgacgccacctcgtcggggcacgacgccacgcccgtgggcctcgcccgtcgggtaccgaaacgggtaccttaccgttcccgaacgttaccttcctacgttccttggacggtccgggtcgtcgggacgtaacgggccgcgtacgtacgncg

SEQ ID NO: 54128 - DNA, 592 bp, Homo sapiens
  misc_feature: GYAE6OF02IAB4X.29.78.H01.1.454.CMB.1.raw
  modified_base (380)..(380): a, c, t, g, unknown or other
  misc_feature (380)..(380): n is a, c, g, or t
  modified_base (590)..(590): a, c, t, g, unknown or other
  misc_feature (590)..(590): n is a, c, g, or t
tcagatagagtactcacgaccggtgctcgatttagtgtgagtagtttgggtttggggtcggccgtgggtacggccggggggtcggcgtgagactctcctgtgcggcctctggattaagtttaggagtcatgccatgaactgggtccgccaggctccagggaaggggcgtggaggtgggtctcggctattagtggcagtggtggcgctatatattatgcagacgccctgaagggccggttcaccattttccagagacaattcgaagaacacgctgtatctgcaaaatggagagcctgagactcgagacacggccgtctattatgtgttaaaggcagctggaatacgggaccgggccacttgaccactggggccaggggacnctggtcaccggtctcctcagccctcaccgaacgggcccatccggtccttccccctggccaccccgtcctacccaacgacgccaaccctctacgggggccaacgaggcctacggcccttgggccctaggccctgggtaccaacgggactaaccttccaggtaccttcgtactctgacgtccgggatcgggacaacgggcgacgactaggcncg

SEQ ID NO: 54129 - DNA, 518 bp, Homo sapiens
  misc_feature: GYAE6OF02HPUHF.29.78.H01.1.454.CMB.1.raw
tcagatagagtactcacgaccggtgctcgatttagtgtgagtagtttgggtttggggtccgagccatggtgcagactccccagagctctcctcctcctccactgcacagggtctctctcccagcctgtgctgactcaatcgccctctgcctctgcctccctgggaggctcggtcaaggtcacctgtactctgagcagtggacacagcagctacgccatcgcttggcatcagcagaggccagacacgggccctcgttacttgatgacagtcaacaatgatggcagtcacagcgaagggggacggatccctgatcgcttctcagtctccagctctgggcctgacgcgctacctcacaactctaccggcctccagtctgaggatgaggctgactattactgtcagaccgtggggcacgtggctagttcagggttccttacgggaccggggaccaagggtccaccggtcggtcggtcacgcccgaacggcccaacccgacgtcgtccacttcgtcgtacccc

SEQ ID NO: 54130 - DNA, 560 bp, Homo sapiens
  misc_feature: GYAE6OF02I75VX.29.78.H01.1.454.CMB.1.raw
  modified_base (559)..(560): a, c, t, g, unknown or other
  misc_feature (559)..(560): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacggggaccgggcccgacttgaccacgtggggccaggggacgctggtcaccgtctcctcacgcctccaccaacgggcccatcggtccttcccccgtggccaccctccctccaacgacgccacctcgtcgggggccacgacgccacgcccgtgggcctcgcctcggtcaaggacctacttccagtactctatctgacgcgggcgtggcaaggccgcatagnn

SEQ ID NO: 54131 - DNA, 521 bp, Homo sapiens
  misc_feature: GYAE6OF02I6UC2.29.78.H01.1.454.CMB.1.raw
  modified_base (519)..(520): a, c, t, g, unknown or other
  misc_feature (519)..(520): n is a, c, g, or t
tcagatagagtactcacgaccggtgctcgatttagtgtgagtagtttgggtttggtggtctctctcccagcctgtgctgactcaatcgccctctgcctctgcctccctgggaggctcggtcaaggtcacctgtactctgagcagtggacacagcagctacgccatcgcttggcatcagcagaggccagacacgggccctcgttacttgatgacagtcaacaatgatggcagtcacagcgaagggggacggatccctgatcgcttctcagtctccagctcgtgggcctgagcgctacctcacaatcctccggcctcagtctgaggatgaggctgactattactgtcagaccgtggggcacgtggctattcgaggttcgttcgggaccggggaccaaggtccgaccggttcgtcggtcacgcccaacggcccaacccactcgtccaccttccgttcgttccccgccctcctcgagttacctctactcgtggacggcgggctcggcaacggccgcgatcggnnc

SEQ ID NO: 54132 - DNA, 168 bp, Homo sapiens; identical to SEQ ID NO: 54118
  misc_feature: GYAE6OF02FVF7X.29.78.H01.1.454.CMB.1.raw
  modified_base (168)..(168): a, c, t, g, unknown or other
  misc_feature (168)..(168): n is a, c, g, or t

SEQ ID NO: 54133 - DNA, 490 bp, Homo sapiens
  misc_feature: GYAE6OF02FORKX.29.78.H01.1.454.CMB.1.raw
  modified_base (422)..(422): a, c, t, g, unknown or other
  misc_feature (422)..(422): n is a, c, g, or t
  modified_base (482)..(482): a, c, t, g, unknown or other
  misc_feature (482)..(482): n is a, c, g, or t
  modified_base (489)..(490): a, c, t, g, unknown or other
  misc_feature (489)..(490): n is a, c, g, or t
tcagatagagtactcacgaccggtgctcgatttagtgtgagtagtttgggtttggtggtctctctcccagcctgtgctgactcaatcgccctctgcctctgcctccctgggaggctcggtcaaggtcacctgtactctgagcagtggacacagcagctacgccatcgcttggcatcagcagaggccagacacgtgccctcgttacttgatgacagtcaacaatgatggcagtcacagcaagggggacgggatccctgatcgcttctcagtctccagctctgggcctgagcgctacctcacaatctccggcctccagtctgaggatgaggctgactattactgtcagacctggggcacgtggcattcgaggtcttcgggaccgggaccaaggtcacgtcgtcgtcagcccaaggcccaacccnctcgtccactctcgttccccacctctcagtactctactctgacgcgggctggacaggccncagtagnn

SEQ ID NO: 54134 - DNA, 626 bp, Homo sapiens
  misc_feature: GYAE6OF02G2PEG.29.78.H01.1.454.CMB.1.raw
  modified_base (292)..(292): a, c, t, g, unknown or other
  misc_feature (292)..(292): n is a, c, g, or t
  modified_base (472)..(472): a, c, t, g, unknown or other
  misc_feature (472)..(472): n is a, c, g, or t
  modified_base (510)..(510): a, c, t, g, unknown or other
  misc_feature (510)..(510): n is a, c, g, or t
  modified_base (622)..(622): a, c, t, g, unknown or other
  misc_feature (622)..(622): n is a, c, g, or t
  modified_base (624)..(624): a, c, t, g, unknown or other
  misc_feature (624)..(624): n is a, c, g, or t
tcagatagagtactcacgaccggtgctcgatttagtgtgagtagtttgggtttgggggcgcctgggtacggccggggggtcgctgagactctcctgtgcggcctcgtggagttaagtttaggagtcatgccatgaactgggtccgccaggctccgagggaaggggctggagtgggtctcggctattagtggcagtggtggcgctatatattatgcagacgccctgaagggccggttcaccatttccagagacaattcgaagaacacgctagtatctgcaaaatggagagccngagactcgacgacacggccgtctatttattgtagttaaaggcgagcgtggaaagtacggggacccggggcccgtaacgttcgacccgacgtggggggacccaggggggaccgtcggtggtccgaccggtctccctcacgccctccaaccgaacgggccccagtccggtcctttcccccgnggcccaccctcctaccgaagcgcacctcgtggggccanacgcacgcccgtgggctcgcccggtgacggaacgtctaccctacgtacttcctacgttacgtcgacggtaccgggccggtaccgaggaaccgggacgcccgaagttaacggngngc

SEQ ID NO: 54135 - DNA, 582 bp, Homo sapiens
  misc_feature: GYAE6OF02G2PWZ.29.78.H01.1.454.CMB.1.raw
  modified_base (581)..(582): a, c, t, g, unknown or other
  misc_feature (581)..(582): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacggggaccggggcccgacttgaccactgggggccagggggacgcgtggtcaccggtctcctcacgccctccaaccgaacgggcccactccggtcctttcccccgtcggccaccctccctcccaacgacgccacctccgtcgggggccacgacgcacgccctcgggcctcgccgtgggtacaacggaccttacttccacgttactctatcctgacggcgggcgtggcgacggcgcgactagnn

SEQ ID NO: 54136 - DNA, 500 bp, Homo sapiens
  misc_feature: GYAE6OF02FW8QR.29.78.H01.1.454.CMB.1.raw
  modified_base (481)..(481): a, c, t, g, unknown or other
  misc_feature (481)..(481): n is a, c, g, or t
tcagatagagtactcacgaccggtgctcgatttagtgtgagtagtttgggtttggggtccgagccatggtgcagactccccagagctctcctcctcctccactgcacagggtctctctcccagcctgtgctgactcaatcgccctctgcctctgcctccctgggaggctcggtcaaggtcacctgtactctgagcagtggacacagcagctacgccatcgcttggcatcagcagaggccagacacgggccctcgttacttgatgacagtcaacaatgatggcagtcacagcgaaggggggacggatcccgtgatcgcttctcagtctccagctctgggcctgagcgctacctcacaatcctccggcctccagtctgaggatgaggctgactattactgtcagacctggggcacgtggctattcgaggtctcgggaccgggaccaaggtcacgtcgtcggtcaggtccaacggccaccccgntcgtccactctcgtccccg

SEQ ID NO: 54137 - DNA, 555 bp, Homo sapiens
  misc_feature: GYAE6OF02IBZKY.29.78.H01.1.454.CMB.1.raw
  modified_base (554)..(555): a, c, t, g, unknown or other
  misc_feature (554)..(555): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccgggcccgacttgaccactgggggccaagggggacgctggtcaccgtctcctcagccctccaccaaggcccactcggtccttccccctcggccaccctcctccaacgacgccacctcgtggggccacgacgcacgccctcggactcgccgtcggtccaacggactaacttccagtacctctatctgagcggctggcaaggcgcatagnn

SEQ ID NO: 54138 - DNA, 515 bp, Homo sapiens
  misc_feature: GYAE6OF02HXHBC.29.78.H01.1.454.CMB.1.raw
  modified_base (512)..(513): a, c, t, g, unknown or other
  misc_feature (512)..(513): n is a, c, g, or t
  modified_base (515)..(515): a, c, t, g, unknown or other
  misc_feature (515)..(515): n is a, c, g, or t
tcagatagagtactcacgaccggtgctcgatttagtgtgagtagtttgggtttggtggtctctctcccagcctgtgctgactcaatcgccctctgcctctgcctccctgggaggctcggtcaaggtcacctgtactctgagcagtggacacagcagctacgccatcgcttggcatcagcagaggccagacacgggccctcgttacttgatgacagtcaacaatgatggcagtcacagcgaagggggacggatccctgatcgcttctcagtctccagctctgggcctggagcgctacctcacaatcctccggcctcagtctgagatgagctgactattactgtcagaccgtggggcacgtggcattcgaggttcttcgggaccggggacaacggtcaccggttcgtcggtcacgcccgaacggcccaaacccgctcgtccaccgttctcgttccccgccctcctctacgtacctctatccgtggacggcgggtctggcacgggcgcagtacgnngn

SEQ ID NO: 54139 - DNA, 581 bp, Homo sapiens
  misc_feature: GYAE6OF02JR2CL.29.78.H01.1.454.CMB.1.raw
  modified_base (379)..(379): a, c, t, g, unknown or other
  misc_feature (379)..(379): n is a, c, g, or t
  modified_base (477)..(477): a, c, t, g, unknown or other
  misc_feature (477)..(477): n is a, c, g, or t
  modified_base (578)..(578): a, c, t, g, unknown or other
  misc_feature (578)..(578): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattatgtagttaaaggcgagctggaatacggggaccgggccgacttgaccacgtggggccaggggacncgtggtcaccgtctcctcagccctccaccaacgggcccagtccggtccttcccccgtggcccaccctccctccaacgacgccacctcgtcggggcacncgcacgccgtcgggctcggccgtggtaccgaacggacctaccgttccgacgtactacgtacgtctgacggcggtcgtcggacgaacggccgacacgtacgntcg

SEQ ID NO: 54140 - DNA, 538 bp, Homo sapiens
  misc_feature: GYAE6OF02J1TT6.29.78.H01.1.454.CMB.1.raw
  modified_base (233)..(233): a, c, t, g, unknown or other
  misc_feature (233)..(233): n is a, c, g, or t
  modified_base (453)..(453): a, c, t, g, unknown or other
  misc_feature (453)..(453): n is a, c, g, or t
  modified_base (484)..(484): a, c, t, g, unknown or other
  misc_feature (484)..(484): n is a, c, g, or t
  modified_base (500)..(500): a, c, t, g, unknown or other
  misc_feature (500)..(500): n is a, c, g, or t
  modified_base (535)..(536): a, c, t, g, unknown or other
  misc_feature (535)..(536): n is a, c, g, or t
tcagatagagtactcacgaccggtgctcgatttagtgtgagtagtttgggtttggtggtcgtctctcccagcctgtgctgactcaatcgccctctgcctctgcctccctgggaggctcggtcaaggtcacctgtactctgagcagtggacacagcagctacgccatcgcttggcatcagcagaggccagacacgggccctgtactgatgacagtcaacatgatggcagtcacngcaagggggacggatcctgatcgcttctcagtcctccagctcgtggccctggacgccgcctaccgtcaactaactcctccggcctccagtctgaggatggaggcctagaactattactgtacgagtaccgtggggcacgtggactattcgagggttctaccggggaaccgggtacaacgggtccaccggtcggtcgtcgacgcccgaaggcccaacccgntcgtccacgtcctcgttccccgccctccacnccttactctagtccgnggaccgcggtcctagggaccaggtccgctagtcgnncg

SEQ ID NO: 54141 - DNA, 559 bp, Homo sapiens
  misc_feature: GYAE6OF02GXV6E.29.78.H01.1.454.CMB.1.raw
  modified_base (558)..(559): a, c, t, g, unknown or other
  misc_feature (558)..(559): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccggggccgacttgaccacgtggggccaggggacgcgtggtcaccgtctcctcacgccctccaccgaacgggcccagtccggtccttcccccgtggccaccctcctccaacgacgcacctcgtcggggcacagcacgcccgtgggctcgccgtgtcaacggactacttccagtacctctactctggacggcggcgtggacgaggcgcgatagnn

SEQ ID NO: 54142 - DNA, 518 bp, Homo sapiens
  misc_feature: GYAE6OF02F4V1X.29.78.H01.1.454.CMB.1.raw
tcagatagagtactcacgaccggtgctcgatttagtgtgagtagtttggggtttggggagagctctggggagtctgcaccatggctcggaccccactcctcttcctcaccctcctcctccactgcacagggtctctctcccagcctgtgctgactcaatcgccctctgcctctgcctccctgggaggctcggtcaaggtcacctgtactctgagcagtggacacagcagctacgccatcgcttggcatcagcagaggccagacacgggccctcgttacttgatgacagtcaacaatgatggcagtcacagcgaagggggacggatccctgatcgcttctcagtctccagctctgggcctgagcgctacctcacaatcctccggcctccagtctgaggatggagctgacttattactgtcagaccgtggggcacgtggctagttcgaggttcttacggggaaccggggaccaagggtccaccggttcggtcggtcacgcccgaacggcccaacccgacg

SEQ ID NO: 54143 - DNA, 533 bp, Homo sapiens
  misc_feature: GYAE6OF02GEI8O.29.78.H01.1.454.CMB.1.raw
  modified_base (532)..(532): a, c, t, g, unknown or other
  misc_feature (532)..(532): n is a, c, g, or t
tcagatagagtactcacgaccggtgctcgatttagtgtgagtagtttgggtttgggggcgcctgggtacggccggggggtcgctgagactctcctgtgcggcctctggattaagtttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaaggcgagctggaatacgggaccggggcccgacttgaccactggggccaggggacgctggtcaccgtctcctcagcctccaccaagggcccatcgtcttccccctcggccaccctcctccaacgacgcacctctggggcacagcagccctgggctgcctggtcaagactactccagtactctatctgagcgggctggcaggcgcatagnc

SEQ ID NO: 54144 - DNA, 535 bp, Homo sapiens
  misc_feature: GYAE6OF02ILSIE.29.78.H01.1.454.CMB.1.raw
tcagatagagtactcacgaccggtgctcgatttagtgtgagtagtttgggtttggggtccgagccatggtgcagactccccagagctctcctcctcctccactgcacagggtctctctcccagcctgtgctgactcaatcgccctctgcctctgcctccctgggaggctcggtcaaggtcacctgtactctgagcagtggacacagcagctacgccatcgcttggcatcagcagaggccagacacgggccctcgttactgatgacagtcaacaatgatggcagtcacaggcgaagggggacggatcccgtgactcgcttctcagtctccagctcgtggcctgacgcgctacctcacatcctccggcctcgagtctgaggatgacggtctagacttattactgtcacgaccgtggggccagtcggctagttcgaggttccgttacgggacccgggactaacgggtccaccgggttccgtcggaccacggccccgaaggccccaaacccgcgttcgaccacttccgtacgttccccc

SEQ ID NO: 54145 - DNA, 541 bp, Homo sapiens
  misc_feature: GYAE6OF02GZY1P.29.78.H01.1.454.CMB.1.raw
  modified_base (540)..(541): a, c, t, g, unknown or other
  misc_feature (540)..(541): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccggggcccgacttgacccactgggggccagggggacgctggtcaccgtctcctcagcctccaccaagggcccatcggtcttcccctggcaccctcctccaacgacgcacctcgtcggggcacagcagccctgggctgcctggtcaaggactacttccagtactctatctgacgcgggctggcaggccgcatagnn

SEQ ID NO: 54146 - DNA, 548 bp, Homo sapiens
  misc_feature: GYAE6OF02GVL6H.29.78.H01.1.454.CMB.1.raw
  modified_base (547)..(548): a, c, t, g, unknown or other
  misc_feature (547)..(548): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccgggcccgacttgaccactggggccaggggacgctggtcaccgtctccctcagcctccaccaacgggcccatccggtcttccccctggccaccctcctcccaacgacgccacctccgtcgggggcacgacgcagccctgggcctgcctggtcaaggactacttccacgtactctatctgacgcggctggcaggccgcatagnn

SEQ ID NO: 54147 - DNA, 656 bp, Homo sapiens
  misc_feature: GYAE6OF02J1TUO.29.78.H01.1.454.CMB.1.raw
  modified_base (406)..(406): a, c, t, g, unknown or other
  misc_feature (406)..(406): n is a, c, g, or t
  modified_base (654)..(654): a, c, t, g, unknown or other
  misc_feature (654)..(654): n is a, c, g, or t
tcagatagagtactcacgaccggtgctcgatttagtgtgagtagtttgggtttgggggtcgccgtgggtacggccggggggtcggcgtgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctacttattggtgtttaaaaggcgaaggcttagggaaattaccggggaccggggcccgaacgtttcggaaccacgtgggggccagggggaccncgtggtcaccgtctccctcaggccctccaccgaacgggacccacgtccggtccttcccccgtcggcccaaccctcccgtaccctaacgacgcctaccctccgtacgggggccaccgacgaccgtacgcccgtcgggccttcggcccgttacggtaccgaacggtacctaccgtttaccgacgttacctcgttacgtcgtacgacggtccgggtacgtcgggaccgaacgggccgtacgacgttacgcncg

SEQ ID NO: 54148 - DNA, 544 bp, Homo sapiens
  misc_feature: GYAE6OF02ILGGK.29.78.H01.1.454.CMB.1.raw
  modified_base (520)..(520): a, c, t, g, unknown or other
  misc_feature (520)..(520): n is a, c, g, or t
  modified_base (543)..(543): a, c, t, g, unknown or other
  misc_feature (543)..(543): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccggggcccgacttgaccacgtggggccagggggacgcgtggtcaccgtctcctcagcctccaccagggcccatcgtcttccccctggccaccctccctccaacgacgcacctcgtcgggggccacacgcacgcccgtgggctgcctggcaaggactactcagtactctatctgngcggctggcgaacggcgcatagnc

SEQ ID NO: 54149 - DNA, 516 bp, Homo sapiens
  misc_feature: GYAE6OF02HZZPJ.29.78.H01.1.454.CMB.1.raw
  modified_base (319)..(319): a, c, t, g, unknown or other
  misc_feature (319)..(319): n is a, c, g, or t
tcagatagagtactcacgaccggtgctcgatttagtgtgagtagtttgggtttggggtccgagccatggtgcagactccccagagctctcctcctcctccactgcacagggtctctctcccagcctgtgctgactcaatcgccctctgcctctgcctccctgggaggctcggtcaaggtcacctgtactctgagcagtggacacagcagctacgccatcgcttggcatcagcagaggccagacacgggccctcgttacttgatgacagtcaaacaatgatggcagtcacagcgaagggggcggatccctgatcgcttcncagtctccagtctcgtgggcctgacgcgctacctcacactctccggcctcagtctgaggatgaggtctgactattactgtcagacctggggccacgtggctattcgaggttccgttacgggaccgggaccaagggtcctaccggtcggtcggcacgcccgaaggcccaaccccgctcgtaccacttcctgttccccc

SEQ ID NO: 54150 - DNA, 562 bp, Homo sapiens
  misc_feature: GYAE6OF02GASL1.29.78.H01.1.454.CMB.1.raw
  modified_base (469)..(469): a, c, t, g, unknown or other
  misc_feature (469)..(469): n is a, c, g, or t
  modified_base (473)..(473): a, c, t, g, unknown or other
  misc_feature (473)..(473): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcagctattagtggcagtggtggcgctatatattatgcagacgccctgaagggccggttcaccatttccagagacaattcgaagaacacgctgtatctgcaaatggagagcctgagactcggacgacacggccggtctattattgtgttaaaggcgagctggaataccgggaccggggcccgacttgaccacgtggggccaggggacgctggtcaccgtctcctcagccctccaccacggcccatcggtcttcccctgccaccctcctccacgacgccacctctcggggcacncgcncgccctgggcctcgccgtgtccgaacggactacttccgacgttactcgtaactcgtcggagccgggcgtcggcacggcgcgtagtagcg

SEQ ID NO: 54151 - DNA, 569 bp, Homo sapiens
  misc_feature: GYAE6OF02H5MHL.29.78.H01.1.454.CMB.1.raw
  modified_base (242)..(242): a, c, t, g, unknown or other
  misc_feature (242)..(242): n is a, c, g, or t
tcagatagagtactcacgaccggtgctcgatttagtgtgagtagtttgggtttggggtctgagagaggagtccacccctgggatcttcaggtgttttcatttggtgatcaggacggaacagagagaactcaccatggagtttgggctgagctggctttttcttgtggctattttaaaaggtgtccagtgtgacgtgcagttggtggagtctgggggcgcctggggtacggccgggggggtcnctgagactctcctgtgcggcctctggattaagttttaggagtcatgccatgaactgggtccgccaggctccgagggaggggcgtgggagtgggtctcggctattagtggcagtggtggcgctatatattatgcagacgccctgagggcccgttcaccctatttccagagacaattcgaaagaacacgctgtatctgacaaatggagagcctgacgactcggacgacacggccgtactattattgtagtaaaggcgagctaggaagtaccggggacccgggcccgacttcggacccgacgtcggggccagggggaccgcgtggtcccg

SEQ ID NO: 54152 - DNA, 541 bp, Homo sapiens
  misc_feature: GYAE6OF02HOU87.29.78.H01.1.454.CMB.1.raw
  modified_base (540)..(541): a, c, t, g, unknown or other
  misc_feature (540)..(541): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccgggcccgacttgaccactggggccaggggacgctggtcaccgtctcctcagcctccaccaaggggcccatccggtcttccccctggccaccctcctcccaagacgccacctctcgggggcacagccagccctgggctgcctggtcaaggactacttccagtactctatctgagcgggctggcaaggcgcatagnn

SEQ ID NO: 54153 - DNA, 583 bp, Homo sapiens
  misc_feature: GYAE6OF02G61J4.29.78.H01.1.454.CMB.1.raw
  modified_base (293)..(293): a, c, t, g, unknown or other
  misc_feature (293)..(293): n is a, c, g, or t
  modified_base (581)..(581): a, c, t, g, unknown or other
  misc_feature (581)..(581): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctagtatctgcaaatggagagcctganactcgacgacacggccgtctattattgtgttaaaggcgagctaggaatacgggaccggggcccgacgttgaccaacgtggggccagggggacgctggtcaccgtctcctcacgccctccaccgaacggcccactcggtccttccccctcggccaccctccctccaacgacgcacctcgtcgggggcacgacgcacgcccgtcggctcgtcgtcgtacgaacgactaccgttacacgttactactacgtcgtacgacggcggtcgcggtacgacggacgacgagtacgncg

SEQ ID NO: 54154 - DNA, 730 bp, Homo sapiens
  misc_feature: GYAE6OF02IB13J.29.78.H01.1.454.CMB.1.raw
  modified_base (177)..(177): a, c, t, g, unknown or other
  misc_feature (177)..(177): n is a, c, g, or t
  modified_base (182)..(182): a, c, t, g, unknown or other
  misc_feature (182)..(182): n is a, c, g, or t
  modified_base (199)..(199): a, c, t, g, unknown or other
  misc_feature (199)..(199): n is a, c, g, or t
  modified_base (204)..(204): a, c, t, g, unknown or other
  misc_feature (204)..(204): n is a, c, g, or t
  modified_base (219)..(219): a, c, t, g, unknown or other
  misc_feature (219)..(219): n is a, c, g, or t
  modified_base (222)..(222): a, c, t, g, unknown or other
  misc_feature (222)..(222): n is a, c, g, or t
  modified_base (230)..(230): a, c, t, g, unknown or other
  misc_feature (230)..(230): n is a, c, g, or t
tcagatagagtactcacgaccggtgctcgatttagtgtgagtagtttgggtttggggtctgagagaggagtccacccctgggatcttcaggtgttttcatttggtgatcaggacggaacagagagaactcaccatggagtttgggctgagcggcgtgttctaggtcgctattaaggntcatntgcgtgcagtgtgatcngggcnctggcgcgggggtcntgnctctctgngcgtctgtagtattagttgagtcatcgctagtcgtacgtcggccgacgtagcgtacgagggtacgggcgtaggtacggtcggtcgtcggtacttagttaggtcgagtaggtggtggtacgtacgtagtaatagttagtacgacgacgaccgtaccgtacggtacgggtaccgttaccgtaccgtaccgttaccgtaacgtaacgtaacgtaacgtaacggtaaacgtaaaccgtaaccgtacgttacgtacgtacgtacgtaacgtaaggtacgggtacgtacgtaccgtacgtacggtaaccgtaccggtaaccggtaccggtaccgtaccgttaacgttacgtttaacgttacggttaacggttaaacggtacggtacggtacggtacgggtaaccgggtaacccggggtaacccggggtacccggtaccggtaccggtaccggtaccgggtaccgggtaccgggtaccggggtaccgggtaccggtaccggtaccgg

SEQ ID NO: 54155 - DNA, 562 bp, Homo sapiens
  misc_feature: GYAE6OF02G1WUA.29.78.H01.1.454.CMB.1.raw
  modified_base (477)..(477): a, c, t, g, unknown or other
  misc_feature (477)..(477): n is a, c, g, or t
  modified_base (561)..(562): a, c, t, g, unknown or other
  misc_feature (561)..(562): n is a, c, g, or t
tcagatagagtactcacgaccggtgctcgatttagtgtgagtagtttgggtttgggggtcggccgtgggtacggccggggggtcggcgtgagactctcctgtgcggcctctggattaagttttaggagtcatgccatgaactgggtccgccaggctccagggaagggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattatgtgttaaaggcgagctggaatacgggaccgggcccgacttgaccactggggccaggggacgctggtcacgtctcctcagcctccacagggcccatcgtcttccccctggccaccctcctccaagacgccaacctcgtcggggccacagcacgcccgngcgtcgcgtcgacgaacgacttacctacgacgttactctacgtcgtacggacggccggtcgtcggacgacggcgaccgagtagnn

SEQ ID NO: 54156 - DNA, 498 bp, Homo sapiens
  misc_feature: GYAE6OF02F3T1C.29.78.H01.1.454.CMB.1.raw
  modified_base (318)..(318): a, c, t, g, unknown or other
  misc_feature (318)..(318): n is a, c, g, or t
  modified_base (390)..(390): a, c, t, g, unknown or other
  misc_feature (390)..(390): n is a, c, g, or t
tcagatagagtactcacgaccggtgctcgatttagtgtgagtagtttgggtttggggtccgagccatggtgcagactccccagagctctcctcctcctccactgcacagggtctctctcccagcctgtgctgactcaatcgccctctgcctctgcctccctgggaggctcggtcaaggtcacctgtactctgagcagtggacacagcagctacgccatcgcttggcatcagcagaggccagacacgggccctcgttacttgatgacagtcaacaatgatggcagtcacagcaagggggacggatccctgatcgcttcncagtctccagctctgggcctgagcgctacctcacatctccggcctcagtctgagatgaggctgactattacngtcagacctggggacacgtggctattcgaggttcttcgggaccgggaccaaggtcaccgtcgtcggtcacgcccaacggccaaccccatcgtcactccgtgttccccg

SEQ ID NO: 54157 - DNA, 493 bp, Homo sapiens
  misc_feature: GYAE6OF02FTUMU.29.78.H01.1.454.CMB.1.raw
  modified_base (423)..(423): a, c, t, g, unknown or other
  misc_feature (423)..(423): n is a, c, g, or t
  modified_base (491)..(493): a, c, t, g, unknown or other
  misc_feature (491)..(493): n is a, c, g, or t
tcagatagagtactcacgaccggtgctcgatttagtgtgagtagtttgggtttggtggtctctctcccagcctgtgctgactcaatcgccctctgcctctgcctccctgggaggctcggtcaaggtcacctgtactctgagcagtggacacagcagctacgccatcgcttggcatcagcagaggccagacacgggcctcgttacttgatgacagtcaacaatgatggcagtcacagcaagggggacggatccctgatcgcttctcagtctccagctctgggcctgagcgctacctcacaatctccggcctccagtctgaggatgaggctgactattactgtcagacctggggcacgtggcattcaggtcttcggaccgggaccaaggtccaccgtcgtcggtcacgcccaaggcccaaccccntcgtcactctcgttcccaccctcctcacgtacctctatctgagccgggctggcaaggccgacagtagnnn

SEQ ID NO: 54158 - DNA, 533 bp, Homo sapiens
  misc_feature: GYAE6OF02FP3BS.29.78.H01.1.454.CMB.1.raw
  modified_base (532)..(533): a, c, t, g, unknown or other
  misc_feature (532)..(533): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccgggccccgacttgaccactgggggccaggggacgctggtcaccgtctcctcagccctccaccaggcccatcgtctccccctggcaccctcctccacgacgcacctctggggcacagcacgccctggctgcctggtcaacggactacttccagtactctatctgacgcggctggcacggcgcatagnn

SEQ ID NO: 54159 - DNA, 795 bp, Homo sapiens
  misc_feature: GYAE6OF02IOGY8.29.78.H01.1.454.CMB.1.raw
tcagatagagtactcacgaccggtgctcgatttagtgtgagtagtttgggtttgggggtcgggccgtgggtacggcccggggggtcgctgaggacttcctccgtgttcgcggtccgtctggattaaggttttaggagtcaatgccatgaactcgggtccgcgaggtctccagggaagggctgggtagttgggttctcggtcgttaaagttaggtcggacgtaggtggtgggtcgctaagtatagttacgtgcaggacggcccgtggaagggccgttcaacctagtttccggagagacaattcgaagacacgcctagtactctggtacaaagtggaagacggacctaggacgtaaccttcggaaccgtacgtaaccggggtcccgtactagttaacgttcggtaagggttaaaagggccgtaaggcgttaggaacgtaccgggtaccgggccgtattcgaccgacgtggggtaccaggggacctactcggcaccggttcctccgtacgaacggtcccctactaacccgtaagggtccctacgtcggttaccgttcccccgaggtcccgacccgtacctacccgtaacggacgttccaacccgttacgtccggggaacccgtaccgacggacgaccgtacccggtcggggaccctagggtacccttagggttacctaaacggacgttaccgttaccgaacgggttaccttaacgtacggttccggttacggtaacggttccggtaccggttaacggtcccggtaacgggtaccggtcggtaaacgttcgggtcctcg

SEQ ID NO: 54160 - DNA, 540 bp, Homo sapiens
  misc_feature: GYAE6OF02HFX8B.29.78.H01.1.454.CMB.1.raw
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccggggcccgacttgaccactggggccaggggacgctggtcaccgtctcctcagcctccaccaagggcccatcggtcttccccctggccaccctcctccaacgacgcacctcgtcggggcacgacgcacgcccgtgggctcgcctggtcaaggactacttccagtactctatctgagcggctggcaggcgcatagc

SEQ ID NO: 54161 - DNA, 775 bp, Homo sapiens
  misc_feature: GYAE6OF02JEN7I.29.78.H01.1.454.CMB.1.raw
  modified_base (756)..(756): a, c, t, g, unknown or other
  misc_feature (756)..(756): n is a, c, g, or t
tcagatagagtactcacgaccggtgctcgatttagtgtgagtagtttgggtttggggtccgagccatggtgcagactccccagagctctcctcctcctccactgcacagggtctctctcccagccctgtgctgactacaactccgccctcgtcgtcctctcgtccctcccggtggggacggtccgttcggtacgtaacggtcctaccgttacgttacttcgtaggacgacgtaggtacggaaccaacgacgacgacgtaccgtaccgacctacgtccgtcgttcggacctactacgacgacgaagggaccggaccgaacggaaccggtacccggggtccccgtttaccggttttaaccgttaggtacgttacgaaccgtacggttaaccaaaactaagtaggtaaggttcgggacgtacgtaccaacgacggaacggggaaacgggggggaccggtacctccgtagtacgtccgtaccttctacgtacgttcctacgacgtccttcggtccgggtctaggaccgtccgtacccttaccgtccaactaccgtcccggtcccgtccctacgtacgtcgtaggaagtacgtaggacgtcgtacgttaactttacgttacgtcgtacgacggtccggtacgggcctacggtcgtacttacgtccggttacggttccggtaccgggaccgggtaaccgtacggtaccgtccggtcggtcggaccgaccggaccgaccggaccccacccgtcgtccgtaccncgttccgtcccgttccccg

SEQ ID NO: 54162 - DNA, 592 bp, Homo sapiens
  misc_feature: GYAE6OF02HN2U2.29.78.H01.1.454.CMB.1.raw
tcagatagagtactcacgaccggtgctcgatttagtgtgagtagtttgggtttggggggaagaggaagactgacggtccacccctgggatcttcaggtgttttcatttggtgatcaggacggaacagagagaactcaccatggagtttgggctgagcgtggcttttcttggtggctaatttttaaaaggtgtccagtgtgacgtgcagttggtggagtctgggggcgcctgggtacggccgggggggtcgctgagactctcctgtgcggcctctggattaagttttaggagtcatgccatgaactgggtccgccaggctccgaggggaaggggctgggaggtgggtctcggctagttaggtggcaggtgggtggcgctatatattatgcagacgccctggaagggtccgttacacctatttccagagacaattcgaaagaacacgctgtatctgacaagtggagagcctgagacctcgacgacgacggccgtactatttattgtagttaaaggcgagcgtaggaacgtacggggacccgggcccgtacttcggaccgacggtcggggccgacgggggcgacggtggtacccg

SEQ ID NO: 54163 - DNA, 521 bp, Homo sapiens
  misc_feature: GYAE6OF02GCS97.29.78.H01.1.454.CMB.1.raw
  modified_base (442)..(442): a, c, t, g, unknown or other
  misc_feature (442)..(442): n is a, c, g, or t
  modified_base (460)..(460): a, c, t, g, unknown or other
  misc_feature (460)..(460): n is a, c, g, or t
  modified_base (465)..(465): a, c, t, g, unknown or other
  misc_feature (465)..(465): n is a, c, g, or t
  modified_base (518)..(519): a, c, t, g, unknown or other
  misc_feature (518)..(519): n is a, c, g, or t
tcagatagagtactcacgaccggtgctcgatttagtgtgagtagtttgggtttggtggtctctctcccagcctgtgctgactcaatcgccctctgcctctgcctccctgggaggctcggtcaaggtcacctgtactctgagcagtggacacagcagctacgccatcgcttggcatcagcagaggccagacacgggccctcgttacttgatgacagtcaacaatgatggcagtcacagcgaagggggacggatccctgactcgcttctcagtctccagctcgtgggcctgacgccgctacctcacactcctccggcctccagtctgaggatggaggctgactattactgtcagaccgtggggcagtcggctattcgaggttccgttacggggaccggggaccaagggtccaccggttcgtcgtcacgcccaaggcccaacccntcgccactctcgtccccncctcncacgtacctctactctcggacgtcgggctgggaccgaacggccgactagacgnncg

SEQ ID NO: 54164 - DNA, 585 bp, Homo sapiens
  misc_feature: GYAE6OF02HQD3Z.29.78.H01.1.454.CMB.1.raw
  modified_base (584)..(585): a, c, t, g, unknown or other
  misc_feature (584)..(585): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacggggaccgggcccgacttgaccacgtgggggccaggggacgctggtcaccgtctcctcacgccctccaccgaacgggcccacgtccggtccttcccccgtcggccaccctccctacccaacgacgccaccctcgtcgggggccacgacgcacgcccgtcgggcctcgcccgtcgggtaccgaacggacctaccttcccagttaccttctactctcgcgcgggcgtggcgacggccgcacgtgnn

SEQ ID NO: 54165 - DNA, 603 bp, Homo sapiens
  misc_feature: GYAE6OF02GE5EY.29.78.H01.1.454.CMB.1.raw
  modified_base (602)..(602): a, c, t, g, unknown or other
  misc_feature (602)..(602): n is a, c, g, or t
tcagatagagtactcacgaccggtgctcgatttagtgtgagtagtttgggtttgggggcgcctgggtacggccgggggggtcgctgagactcctcctgtgcggcctctggattaagttttaggagtcatgccatgaactgggtccgccaggctccagggaagggctggagtgggtctcggctattagtggcagtggtggcgctatatattatgcagacgccctgaagggccggttcaccatttccagagacaattcgaagaacacgctgtatctgacaaatggagagcctgagactcgacgacacggccgtctattattgtagttaaaggcgagctggaagtaccggggaccggggcccgacttgaccacgtcggggccaggggacgcgtggtccaccgtctcctcacgccctccaccgaacgggcccacgtccggtccttcccccgtcggccctaccctccctacccaacgacgccaccctccgtcgggggccacgacgccgacgcccgtcgggcctcgccgtcggtacgaacggaccttaccgttccgacgtaccttctacgtctgacggcgggcgtcggacgacggccgacacgtacgnc

SEQ ID NO: 54166 - DNA, 537 bp, Homo sapiens
  misc_feature: GYAE6OF02HIX5Z.29.78.H01.1.454.CMB.1.raw
tcagatagagtactcacgaccggtgctcgatttagtgtgagtagtttgggtttggggtccgagccatggtgcagacctccccagagcttctcctccttcctccactgcacagggtctctctcccagcctgtgctgactcaatcgccctctgcctcttgcctcccgtgggagtctcggtcaaggtcacctgtactctgagcagtggacacgagcagctacgccagtcgcttggcatcagcagaggccagacacgggccctgttacttgatgacagtcaacaatgatggcagtcacgagcgaagggggacggatccctgagtcgtcttcgtcaggtctcagtctctcgggcctgagccgctacctcgactaactcctccggcctccagtctgagactgaaggctagtacttattactgtcacgaccgtggggaccacgtggactattcgaggttccgtacgggaccgggtaacaggtccaccggtcggtcggtacacggcccgaacgcccacccatccgacctacctcgtacgtccccg

SEQ ID NO: 54167 - DNA, 573 bp, Homo sapiens
  misc_feature: GYAE6OF02HX7LI.29.78.H01.1.454.CMB.1.raw
  modified_base (444)..(444): a, c, t, g, unknown or other
  misc_feature (444)..(444): n is a, c, g, or t
tcagatagagtactcacgaccggtgctcgatttagtgtgagtagtttgggtttggggtctgagagaggagtccacccctgggatcttcaggtgttttcatttggtgatcaggacggaacagagagaactcaccatggagtttgggctgagctggctttttcttgtggctattttaaaaggtgtccagtgtgacgtgcagttggtggagtctgggggcgcctggggtacggccgggggggtcgctgagactctcctgtgcggcctctggattaagttttaggagtcatgccatgaactgggtcgccaggctccagggaaggggctggagtgggtctcggctattagtggcagtggtggcgctatatattatgcagacgccctgaacgggccgttcaccatttcccagagacaattcgaagaacacgctgtatctgcaaagtgganagcctgagactcgacgaccacggccgtactattattgtacgttaaaaggcgaagctagggtaataccggggaccgggcccgacgttcgaacccgtacgtcggggccaagggggacgtccgtggtacccg

SEQ ID NO: 54168 - DNA, 645 bp, Homo sapiens
  misc_feature: GYAE6OF02GEMJC.29.78.H01.1.454.CMB.1.raw
  modified_base (455)..(455): a, c, t, g, unknown or other
  misc_feature (455)..(455): n is a, c, g, or t
tcagatagagtactcacgaccggtgctcgatttagtgtgagtagtttgggtttggggtctgagagaggagtccacccctgggatcttcaggtgttttcatttggtgatcaggacggaacagagagaactcaccatggagtttgggctgagcgtggcgttttctagtggctattttaaaaggtgtccagtgtgacgtgcagttggtggagtctgggggcgcctgggtacggccgggggggtcgctgagactctcctgtgcggcctctggattaagttttaggagtcatgccatgaactggtccgccaggctccagggaagggctggagtgggtctcggctatagtggcagtggtggcgctatatattatgcagacgccctgaagggccggttcaccgatttccagtagacaattcgaaagaacacgctgtaatctagctaaagtggagagcctganactcgaaccgacaccggtcccgtacttacgttattcggtagtttaaaagggccgtaagggtacccgggtaaaggttacccgggggaaccccggggggtaccccgtaaaccggtttcggaaccccgtacggttacgggggggacccaagggggggtaacccggtccgttacgggggtcccttaaccccggg

SEQ ID NO: 54169 - DNA, 534 bp, Homo sapiens
  misc_feature: GYAE6OF02F7L0R.29.78.H01.1.454.CMB.1.raw
  modified_base (533)..(534): a, c, t, g, unknown or other
  misc_feature (533)..(534): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccgggcccgacttgaccactgggggccagggggacgctggtcaccgtctcctcagcctccaccaagggcccatcggtcttccccctggccaccctcctccaagagcacctctggggcacagcagccctgggctgcctggtcaaggactacttccagtactctatctgagcgggctggcaggcgcatagnn

SEQ ID NO: 54170 - DNA, 546 bp, Homo sapiens
  misc_feature: GYAE6OF02IT4FK.29.78.H01.1.454.CMB.1.raw
  modified_base (545)..(546): a, c, t, g, unknown or other
  misc_feature (545)..(546): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgccaggctccagggaaggggctggagtggggtctcggctattagtggcagtggtggcgctatatattatgcagacgccctgaagggccggttcaccatttccagagacaattcgaagaacacgctgtatctgcaaatggagagcctgagactcgacgacacggccgtctattatgtgttaaaggcgagctggaatacgggaccggggcccgacttgaccactggggcccagggggacgcgtggtcaccggtctccctcagccctccaccaagggcccatcggtcttccccctcggcaccctccctccaacgagccacctcgtcggggcacagcagccctgggctcgcctgtcaacggactacttcagtactctatctgagcggctggcacggcgacactagnn

SEQ ID NO: 54171 - DNA, 516 bp, Homo sapiens
  misc_feature: GYAE6OF02JDL31.29.78.H01.1.454.CMB.1.raw
  modified_base (266)..(266): a, c, t, g, unknown or other
  misc_feature (266)..(266): n is a, c, g, or t
  modified_base (320)..(320): a, c, t, g, unknown or other
  misc_feature (320)..(320): n is a, c, g, or t
  modified_base (435)..(435): a, c, t, g, unknown or other
  misc_feature (435)..(435): n is a, c, g, or t
  modified_base (489)..(489): a, c, t, g, unknown or other
  misc_feature (489)..(489): n is a, c, g, or t
  modified_base (513)..(513): a, c, t, g, unknown or other
  misc_feature (513)..(513): n is a, c, g, or t
  modified_base (515)..(515): a, c, t, g, unknown or other
  misc_feature (515)..(515): n is a, c, g, or t
tcagatagagtactcacgaccggtgctcgatttagtgtgagtagtttgggtttggtggtctctctcccagcctgtgctgactcaatcgccctctgcctctgcctccctgggaggctcggtcaaggtcacctgtactctgagcagtggacacagcagctacgccatcgcttggcatcagcagaggccagacacgggccctcgttacttgatgacagtcaacaatgatggcagtcacagcgaagggggacggatccctgatcgcttcncagtctccagctcgtgggcctggagcgctacctcacatctccggcctcgagtcngagatgagctgactattactgtcagccgtgggcctacgtggctagttcgaggttcgttcgggaccggggacaagggtccaccggttcgtcggtacacgcccgaaggcccaacccngtcgtcactctcgttccccacctccactagtcctctactcgtggacgcgggtcncgggacacgggcacgtagtacggntnc

SEQ ID NO: 54172 - DNA, 505 bp, Homo sapiens
  misc_feature: GYAE6OF02F6WFC.29.78.H01.1.454.CMB.1.raw
  modified_base (357)..(357): a, c, t, g, unknown or other
  misc_feature (357)..(357): n is a, c, g, or t
tcagatagagtactcacgaccggtgctcgatttagtgtgagtagtttgggtttggggtccgagccatggtgcagactccccagagctctcctcctcctccactgcacagggtctctctcccagcctgtgctgactcaatcgccctctgcctctgcctccctgggaggctcggtcaaggtcacctgtactctgagcagtggacacagcagctacgccatcgcttggcatcagcagaggccagacacgggccctcgttacttgatgacagtcaacaatgatggcagtcacagcgaagggggcggatccctgatcgcttctcagtctccagctctgggcctgagcgctacctcacaatcnccggcctccagtctgagatgagctgactattactgtcagaccgtggggcacgtggctagttcgaggttctacgggaccgggtaccaggtccaccggtcggtcggtcacgtacccaacggcccaacccgctcgtcacttcctcgtcccc

SEQ ID NO: 54173 - DNA, 553 bp, Homo sapiens
  misc_feature: GYAE6OF02IP6CQ.29.78.H01.1.454.CMB.1.raw
  modified_base (551)..(553): a, c, t, g, unknown or other
  misc_feature (551)..(553): n is a, c, g, or t
tcagatagagtactcacgaccggtgctcgatttagtgtgagtagtttgggtttgggggcgcctgggtacggccggggggtcgccgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaaatggagagcctgagactcgacgacacggccgtctattattgtgttaaaggcgagctggaatacggggaccgggcccgacttgaccacgtgggccaggggacgctgggtcaccgtctcctcagcctccaccaagggcccatccggtccttccccctcggccaccctcctccaacgacgccacctcgtcgggggcacacgccacgccctgggctcgccgtggtcaaacggactacttccagtactctatctgagcggctggcgaaggcgcatagnnn

SEQ ID NO: 54174 - DNA, 604 bp, Homo sapiens
  misc_feature: GYAE6OF02G60YR.29.78.H01.1.454.CMB.1.raw
  modified_base (601)..(601): a, c, t, g, unknown or other
  misc_feature (601)..(601): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccggggcccgacgttcgaccacgtcggggccaggggacgctggtcaccgtctcctcagccctccaccgaacgggcccacgtccggtccttccccctcgggccaccctccctccaacgacgccacctcgtcggggcaccacgccacgcccgtcgggcctcggcccgtacgggtccgaacgggtaccttaccgttaccgacgttacctcttacgtcgtaggacgggccggcgtcggacgaacgggccgacgacgtagntcg

SEQ ID NO: 54175 - DNA, 511 bp, Homo sapiens
  misc_feature: GYAE6OF02JTDNE.29.78.H01.1.454.CMB.1.raw
  modified_base (325)..(325): a, c, t, g, unknown or other
  misc_feature (325)..(325): n is a, c, g, or t
  modified_base (391)..(391): a, c, t, g, unknown or other
  misc_feature (391)..(391): n is a, c, g, or t
  modified_base (410)..(410): a, c, t, g, unknown or other
  misc_feature (410)..(410): n is a, c, g, or t
  modified_base (493)..(493): a, c, t, g, unknown or other
  misc_feature (493)..(493): n is a, c, g, or t
tcagatagagtactcacgaccggtgctcgatttagtgtgagtagtttgggtttggggtccgagccatggtgcagactccccagagctctcctcctcctccactgcacagggtctctctcccagcctgtgctgactcaatcgccctctgcctctgcctccctgggaggctcggtcaaggtcacctgtactctgagcagtggacacagcagctacgccatcgcttggcatcagcagaggccagacacgggccctcgttacttgatgacagtcaacaatgatggcagtcacaggacgaaggggggacggactcccgtgactcgcttcncagtcctcagcctcgtgggcctggacgcgcctacctcacactccgtcccgcctccagtctgacggntggacgctgacttattacngtacgacgccgtgggcacgtggctagttcgaggtcgtcgggaccgggacaggtcaccggtcgcggtcacgcccaagcccaccncgtcgcactctccgtccc

SEQ ID NO: 54176 - DNA, 450 bp, Homo sapiens
  misc_feature: GYAE6OF02F5BKL.29.78.H01.1.454.CMB.1.raw
  modified_base (366)..(366): a, c, t, g, unknown or other
  misc_feature (366)..(366): n is a, c, g, or t
  modified_base (436)..(450): a, c, t, g, unknown or other
  misc_feature (436)..(450): n is a, c, g, or t
tcagatagagtactcacgaccggtgctcgatttagtgtgagtagtttgggtttgggaggctcggtcaaggtcacctgtactctgagcagtggacacagcagctacgccatcgcttggcatcagcagaggccagacacgggccctcgttacttgatgacagtcaacaatgatggcagtcacagcaagggggacggatccctgatcgcttctcagtctccagctctgggcctgagcgctacctcacaatctccggcctccagtctgaggatgaggctgactattactgtcagacctggggcactggcattcaggtcttcggaccggggaccaaggtcaccgtcgtcggtcagcccaaggcccaacccnctgtcactctcgttccccgccctcctcacgtacctctactctgagccgggctcgggcaaggccgcatagnnnnnnnnnnnnnnn

SEQ ID NO: 54177 - DNA, 507 bp, Homo sapiens
  misc_feature: GYAE6OF02HMAON.29.78.H01.1.454.CMB.1.raw
  modified_base (317)..(317): a, c, t, g, unknown or other
  misc_feature (317)..(317): n is a, c, g, or t
  modified_base (486)..(486): a, c, t, g, unknown or other
  misc_feature (486)..(486): n is a, c, g, or t
tcagatagagtactcacgaccggtgctcgatttagtgtgagtagtttgggtttggggtccgagccatggtgcagactccccagagctctcctcctcctccactgcacagggtctctctcccagcctgtgctgactcaatcgccctctgcctctgcctccctgggaggctcggtcaaggtcacctgtactctgagcagtggacacagcagctacgccatcgcttggcatcagcagaggccagacacgggcctcgttactgatgacagtcaacaatgatggcagtcacagcgaagggggacggatccctgatcgcttcncagtctccagctcgtgggcctgacgcgctacctcacatcctccggcctccagtctgagatgaggctgactattactgtcagacctggggcacgtggctagttcgaggttccgttacgggaccgggaccaggtccaccggtcgtcggtcacgcccgaaggcccaacccgngtacgtccactcctcgtcccc

SEQ ID NO: 54178 - DNA, 552 bp, Homo sapiens
  misc_feature: GYAE6OF02JIXPR.29.78.H01.1.454.CMB.1.raw
  modified_base (448)..(448): a, c, t, g, unknown or other
  misc_feature (448)..(448): n is a, c, g, or t
  modified_base (545)..(545): a, c, t, g, unknown or other
  misc_feature (545)..(545): n is a, c, g, or t
tcagatagagtactcacgaccggtgctcgatttagtgtgagtagtttgggtttggggtccgagccatggtgcagactccccagagctctcctcctcctccactgcacagggtctctctcccagcctgtgctgactcaatcgccctctgcctctcgccctcccgtgggaggctcggtcaaggtcacctgtactctgagcagtggacacagcagctacgccatcgcttggcatcagcagacgccagacacggcctcgttactgatgacagtacaacaatgatggcagtcaacgacggacggaaaggggggtaccggactcccgtaggaacgttccgtccttcgtacacggttcctaccgaggtcctcgtacgggccttaggacgccgtcctacctacaactactcccgtcccggaccttcgagtctaggacgatcgagtctgactattcngcagaccgtggctacgtggctagttccgagtcgtacgggaacgtcagtccacggtcgcggtcacgcccgaagcccaaccgtgtcgtacctacttccngtacccc

SEQ ID NO: 54179 - DNA, 864 bp, Homo sapiens
  misc_feature: GYAE6OF02HYC4R.29.78.H01.1.454.CMB.1.raw
  modified_base (863)..(863): a, c, t, g, unknown or other
  misc_feature (863)..(863): n is a, c, g, or t
tcagatagagtactcacgaccggtgctcgatttagtgtgagtagtttgggtttgggttggggtactcgtactcccagcccgtcgtgctgacctccaatcgcccctctcgcccttcgtgtccctccccgtttggggacggtcgtacggttcgaaaggttcgacccttgggtacctcctaggacgctaaggtagggacacgagcgaggcctaacgccaatccgcttggcgaatcagcgttagagggccagacgacgggaccgtcgttacttgactgaccacgtacaaacgaactacggactagggaccacgtacacgacggtaccgaaaggggggaaacggtactacccttaggaacttcggacgttaccgtccgaacggtacctacccgagtaccttttacgttacgggggccttggaacgaccgtacctttaacccgtacgaacctaagtcccgtaccccggggtcccttcccgaacgtttaccgtagggttaacgggggaccttacggggaaccggtcgttacggaaaccctttacgtttacccgttacggtaacccaacggtaacccgttacgggggggaccctacggttacgggtcccttaacccgtttcggaccgggttcccgttaccgggacccggggtaccgaacgggtaccgtacccggttaccggttccggtaccgaaccggaccccgaaacggaccccgaaccccgtaccgtcgggtaccctaccgtcccgttaccggttccccgtacccgtacccttaccgtaccgtaccttacgttacgtaccggtacggtacgggaccggggccggttaccggaccggtaacgggaccggtaccgtaacgtaacggtagcng

SEQ ID NO: 54180 - DNA, 591 bp, Homo sapiens
  misc_feature: GYAE6OF02J0307.29.78.H01.1.454.CMB.1.raw
tcagatagagtactcacgaccggtgctcgatttagtgtgagtagtttgggtttggggcgcctgggtacggccggggggtcgctgagactctcctgtgcggcctctggattaagttttaggagtcatgccatgaactgggtccgccaggctccagggaagggctggagtgggtctcggctattagtggcagtggtggcgctatatattatgcagacgccctgaaggccgttcaccatttccagagacaattcgaagaacacgctgtatctgcaaatggagagcctgagactcgacgacacggccgtctattattgtgttaaaggcgagctggaatacgggaccgggccgattgaccacgtggggccaggggaccgctggtcaccgtctcctcacgcctccaccgaggcccagtcggtcttccccctcggccaccctcctccaacgacgaccacctcgtcggggccacgacgccgacgcccgtacgggcctcgccgtcggtaccgaacggacctaccgttacccacgtacctctactccgttacgacggtccgggtccgttggaccgtaacgggccgtacgacgttagatacg

SEQ ID NO: 54181 - DNA, 667 bp, Homo sapiens
  misc_feature: GYAE6OF02I9XV6.29.78.H01.1.454.CMB.1.raw
  modified_base (182)..(182): a, c, t, g, unknown or other
  misc_feature (182)..(182): n is a, c, g, or t
  modified_base (302)..(302): a, c, t, g, unknown or other
  misc_feature (302)..(302): n is a, c, g, or t
  modified_base (665)..(665): a, c, t, g, unknown or other
  misc_feature (665)..(665): n is a, c, g, or t
tcagatagagtactcacgaccggtgctcgatttagtgtgagtagtttgggtttgggggtcgggcctgggtacggccggggggtcgctgagactctcctgtgcggcctctggattaagtttaggagtcatgccatgaactgggtccgccgaggtctccagggaaggggctgggtagtgggtcncggcttattagtggcagtggtggcgctatatattagtgcaggacgccctggaacgggccggttcaccgatttccagagacaattcgaagacacgctgtatctgcaaatggagagcctganactcgacgacacggccgtctattattcgtggttaaaggcggagcgtgggaagttacggggaccggggcccgtaagtttgaccgtacgttgggggcccaggggggacctcgtaggtacaccggttctcccgtcacggcccttcccgaacgaacggggcccaagttcccgggtaccttccccctggcccaaccctcccgtaccaaacgtacgaccaaccgtccgtcggggaccacgacgccgacgacccgttcgggacctcggcccgtgggtaccgaacggtacctaccgttaccgagttacccttcgttacgtccgtttaggacggtccgggtcgtaggtaccgaacgggccgacgagtacggncg

SEQ ID NO: 54182 - DNA, 550 bp, Homo sapiens
  misc_feature: GYAE6OF02HVLM4.29.78.H01.1.454.CMB.1.raw
  modified_base (344)..(344): a, c, t, g, unknown or other
  misc_feature (344)..(344): n is a, c, g, or t
tcagatagagtactcacgaccggtgctcgatttagtgtgagtagtttggggtttggggagagctctggggagtctgcaccatggctcggaccccactcctcttcctcaccctcctcctccactgcacagggtctctctcccagcctgtgctgactcaatcgccctctgcctctgccctcctgggaggctcggtcaaggtcacctgtactctgagcagtggacacagcagctacgccatcgcttggcatcagcagaggccagacacgggccctgttactgatgacagtacaacaatgatggcagtcaacaggacggaagggggacggatcccgtgactcgcttcncacgtcctccgagtcctcgtcgggcctggacgcgcctacctcaacactccgtccggcctccgagtcagaggtatgacgctagacttattacgtgtacacggtaccgtgggcacgtggactagttcgaggttccgtaccgggaaccgggtactaacgggtccaccggttcggtccggacaccggacccgaacggccccaacccgtcg

SEQ ID NO: 54183 - DNA, 503 bp, Homo sapiens
  misc_feature: GYAE6OF02JIPHS.29.78.H01.1.454.CMB.1.raw
  modified_base (420)..(420): a, c, t, g, unknown or other
  misc_feature (420)..(420): n is a, c, g, or t
  modified_base (443)..(443): a, c, t, g, unknown or other
  misc_feature (443)..(443): n is a, c, g, or t
  modified_base (500)..(500): a, c, t, g, unknown or other
  misc_feature (500)..(500): n is a, c, g, or t
tcagatagagtactcacgaccggtgctcgatttagtgtgagtagtttgggtttggtggtctctctcccagcctgtgctgactcaatcgccctctgcctctgcctccctgggaggctcggtcaaggtcacctgtactctgagcagtggacacagcagctacgccatcgcttggcatcagcagaggccagacacgggccctcgttacttgatgacagtcaacaatgatggcagtcacagcaagggggacggatccctgatcgcttctcagtctccagctctgggcctgagcgctacctcacaatctccggcctcagtctgagatgaggctgactattactgtcagaccgtgggcacgtggcattcgaggtctcggaccgggacaaggtcaccgttcgtcggtcacgcccaaggcccaacccntcgtcactctcgttcccacctcncacgtactctactcgtggacgcgggtcctaggaccaacgggccacctaagtacgcgntcg

SEQ ID NO: 54184 - DNA, 562 bp, Homo sapiens
  misc_feature: GYAE6OF02HDZDB.29.78.H01.1.454.CMB.1.raw
  modified_base (561)..(561): a, c, t, g, unknown or other
  misc_feature (561)..(561): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccggggcccgacttgaccactgggggccagggggaccgctcggtcaccggtctccctcagcctccaccaagggcccatcggtccttccccctcggccaccctcctccaacgacgccacctcgtcgggggcaccgagccagccctgggcctgcctggtcaacggacctaccttccacgtactctactctgacgcgggctggcgacggccgacatagnc

SEQ ID NO: 54185 - DNA, 585 bp, Homo sapiens
  misc_feature: GYAE6OF02H55ZE.29.78.H01.1.454.CMB.1.raw
  modified_base (584)..(585): a, c, t, g, unknown or other
  misc_feature (584)..(585): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaaatggagagcctgagactcgacgacacggccgtctattattgtgttaaaggcgagctggaatacggggaccgggcccgacttgaccacgtgggggccaggggacgctggtcaccgtctcctcacggccctccaaccgaacgggcccacgtccggtcctttcccccgtcggccaccctccctccaacgacgccacctcgtcgggggcacgacgccacgcccgtgggccgtcgccgtcggtacgaacggaccttaaccttccgacgtactctatcgtcgaggcgggtcgtggacgacgggcgcgatagnn

SEQ ID NO: 54186 - DNA, 555 bp, Homo sapiens
  misc_feature: GYAE6OF02F73NZ.29.78.H01.1.454.CMB.1.raw
  modified_base (554)..(555): a, c, t, g, unknown or other
  misc_feature (554)..(555): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacggggaccggggcccgacttcgaccacgtgggggccagggggacgctggtcaccgtctcctcacgccctccaccgaacgggcccagtccggtccttcccccgtggcccaccctcctccaagcgcacctcgtcggggcacacgcgacgcccgtgggcctcgcctgggtcaggactacttccagtactctatctgacgcggctggcaggcgcatgnn

SEQ ID NO: 54187 - DNA, 600 bp, Homo sapiens
  misc_feature: GYAE6OF02GE93M.29.78.H01.1.454.CMB.1.raw
tcagatagagtactcacgaccggtgctcgatttagtgtgagtagtttgggtttggggtctgagagaggagtccacccctgggatcttcaggtgttttcatttggtgatcaggacggaacagagagaactcaccatggagtttgggctgagcgtggcgttttctagtggctattttaaaaggtgtccagtgtgacgtgcagttggtggagtctgggggcgcctggggtacggccgggggggtcgctgagactctcctgtgcggcctctggatttaagttttaggagtcatgccatgaactgggtccgccaggctccgagggaaggggctggaggtgggtctcggctagttagtggcaggtggtggcgctagtattattatgcagacgcctggaacgggccggttacacctatttccagtagacaattcgaaagaacacgctgtatctgacaaatggagagcctgagactcgaacgacgacggtccgtctatttattggtagttaaagggcgaagtcgtaggtaacgtaacggggacccgggcccgtaccgttacggacccgacggtcgggggaccggaacggggacggccgtgggtacccg

SEQ ID NO: 54188 - DNA, 680 bp, Homo sapiens
  misc_feature: GYAE6OF02HXCLJ.29.78.H01.1.454.CMB.1.raw
  modified_base (179)..(179): a, c, t, g, unknown or other
  misc_feature (179)..(179): n is a, c, g, or t
  modified_base (193)..(193): a, c, t, g, unknown or other
  misc_feature (193)..(193): n is a, c, g, or t
  modified_base (200)..(200): a, c, t, g, unknown or other
  misc_feature (200)..(200): n is a, c, g, or t
  modified_base (202)..(202): a, c, t, g, unknown or other
  misc_feature (202)..(202): n is a, c, g, or t
  modified_base (208)..(208): a, c, t, g, unknown or other
  misc_feature (208)..(208): n is a, c, g, or t
  modified_base (224)..(224): a, c, t, g, unknown or other
  misc_feature (224)..(224): n is a, c, g, or t
  modified_base (259)..(259): a, c, t, g, unknown or other
  misc_feature (259)..(259): n is a, c, g, or t
tcagatagagtactcacgaccggtgctcgatttagtgtgagtagtttgggtttggggtctgagagaggagtccacccctgggatcttcaggtgttttcatttggtgatcaggacggaacagagagaactcaccatggagtttgggctgagcggtcgtgttctaggtcgctattaaaggntcagtgtgagtgcngtgtgtntntgggcnctggacgcgggggtcngtgacgctctctgtgcgtctgtagtattagttagntcatcgacagtagtacgtcggtccgcgtagcgtacgaggacggtcgtggtggtcggtcgtcgtcgtagttagtgtacgtaggtggtggtcgtacgtatatagttagtcgcgacgtaccgtaccgtacggtacgggtaccgttaccgtaccgtacgttaccgtacgtacgtaacgtaacgtaacgtaacgaacgacgtacgtacgtacgtcgtacgtacgtaacgtacggacgtacgtcgtacgtacgtacgtacgaccgaccgtaccggtaccgttacgttacgtttaacgttaggttaggttaaggtacgtacgtacggtacggtaacgggtaaccgggtacccgggtaccggtaccgttaccgtaccggtaccggtaccgggtaccgggtaccgggtaccggtacggtaccggtaccgg

SEQ ID NO: 54189 - DNA, 550 bp, Homo sapiens
  misc_feature: GYAE6OF02FGRBS.29.78.H01.1.454.CMB.1.raw
  modified_base (549)..(550): a, c, t, g, unknown or other
  misc_feature (549)..(550): n is a, c, g, or t
tcagatagagtactcacgaccggtgctcgatttagtgtgagtagtttgggtttgggggcgcctgggtacggccgggggggtcgctgagactctcctgtgcggcctctggattaagtttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacggggaccgggcccgacttgaccactgggggccaggggacgctggtcaccgtctcctcacgccctccaccaacgggcccatcggtccttccccctcggccacccctcctccaacgacgccacctcgtgggggccacgacgcagccctgggctgcctggtcaacgactacttccagtactctactctgacgcggctggcacggcgcatagnn

SEQ ID NO: 54190 - DNA, 526 bp, Homo sapiens
  misc_feature: GYAE6OF02HA1WJ.29.78.H01.1.454.CMB.1.raw
tcagatagagtactcacgaccggtgctcgatttagtgtgagtagtttgggtttggggtccgagccatggtgcagactccccagagctctcctcctcctccactgcacagggtctctctcccagcctgtgctgactcaatcgccctctgcctctgcctccctgggaggctcggtcaaggtcacctgtactctgagcagtggacacagcagctacgccatcgcttggcatcagcagaggccagacacgggccctcgttacttgatgacagtcaacaatgatggcagtcacagcgaaggggggacggatcccgtgactcgcttctcagtctccagctcgtgggcctggacgcgctacctcacatcctccggcctccagtctgagatgaggctgactattactgtcagaccgtggggcacgtggctagttcgaggttccgttacgggaccgggtaccaagggtccaccggtcggtcggtcacggccccaacggcccaaccccgcgtcgtaccacttccgtccgttccccg

SEQ ID NO: 54191 - DNA, 659 bp, Homo sapiens
  misc_feature: GYAE6OF02H7AU6.29.78.H01.1.454.CMB.1.raw
  modified_base (417)..(417): a, c, t, g, unknown or other
  misc_feature (417)..(417): n is a, c, g, or t
tcagatagagtactcacgaccggtgctcgatttagtgtgagtagtttgggtttgggggcgccgtgggtacggccgggggggtccgcctggtacgacgtcttcctgtgtcggcctctggattaagttttaggagtcatgccaatgaactgggtccgccgaggtcgtccagggaaggggctgggtacgtgggtctcggcttagttagtggcagtggtggcgctatatattatgcaggacgccctgaagggccggttcaccgactttccagagacaattcgaagaacacgcctgtatctgctaaatggagtagcctgagactcgacgtacgacggcccgtcgtattacttggtaggttaaaggcgagctgggaatacgggaccggggcccgacgttagaccacgtcggggacaggggacncgtggtcaccgtctcctcagccctaccgaccaacggggcccacgtccggtcctttcccccgtggcccaccctcctcccaagacgccacctcgtcggggcctacgacgccgacgccccgtgggcctgcccgtagggtccgaacgggacttaaccgttccgtagttaccgttcgttacgtcgttacggacgggaccggggtccgtacgggacgtaacgggccgtacggtaacggttcggagcgg

SEQ ID NO: 54192 - DNA, 615 bp, Homo sapiens
  misc_feature: GYAE6OF02HOXHQ.29.78.H01.1.454.CMB.1.raw
  modified_base (612)..(612): a, c, t, g, unknown or other
  misc_feature (612)..(612): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccggggcccgattcgaccacgtggggccaggggacgcgtggtcaccgtctccctcacgccctaccaccgaacgggcccaacgtccggtaccgtttccccccgtgggccctaccccgttcctccctaaacggacgcctaacccgttcgtcgggggccacgacgcacgcccgtgggcctcgcccgtggtccaaacgggactaccgttccgagttacctctactcgtagtcggcgggtcctggaccgtaacgggccgaccgaacttacgngac

SEQ ID NO: 54193 - DNA, 547 bp, Homo sapiens
  misc_feature: GYAE6OF02IB4Z4.29.78.H01.1.454.CMB.1.raw
  modified_base (529)..(529): a, c, t, g, unknown or other
  misc_feature (529)..(529): n is a, c, g, or t
  modified_base (546)..(547): a, c, t, g, unknown or other
  misc_feature (546)..(547): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccattttccagagacaattcgaagaacacgctgtatctgcaaatggagagcctgagactcgacgacacggcccgtctattattgtgttaaaggcgagctggaatacgggaccggggccgacttgaccactggggccaggggacgctggtcaccgtctcctcagcctccaccaagggcccatccggtccttccccctggccacccctccctcccaagacgccacctcgtgggggccacagcagccctgggctgcctggtcaaggactacttccagtactctatctgagcgggcnggcaaggccgcatacgnn

SEQ ID NO: 54194 - DNA, 565 bp, Homo sapiens
  misc_feature: GYAE6OF02HBP0X.29.78.H01.1.454.CMB.1.raw
  modified_base (564)..(565): a, c, t, g, unknown or other
  misc_feature (564)..(565): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccggggcccgacttgaccactgggggccaggggacgctggtcaccgtctcctcagcctccaccaagggcccatcggtccttccccctcggccaccctccctccaacgacgccaccctccgtcgggggccacgacgccacgccccgtggggcctggccctggtccaagggacctaccttccacgtactctactctgacggcgggctggcaggcgcagtagnn

SEQ ID NO: 54195 - DNA, 634 bp, Homo sapiens
  misc_feature: GYAE6OF02HGX1J.29.78.H01.1.454.CMB.1.raw
  modified_base (387)..(387): a, c, t, g, unknown or other
  misc_feature (387)..(387): n is a, c, g, or t
  modified_base (632)..(632): a, c, t, g, unknown or other
  misc_feature (632)..(632): n is a, c, g, or t
tcagatagagtactcacgaccggtgctcgatttagtgtgagtagtttgggtttgggggcgcctgggtacggccgggggggtcgctgatactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtagttaaaggcgagctagggaatacggggaccggggcccacgttcgaccacgtgggggccaggggacncgtggtcaccgtctcctcacgccctccaccgaacgggcccagtccggtccttcccccgtcggccaccctccctccaacgacgccacctcgtcggggccacgacgccacgcccgtcgggcctcggcccgttcgggtaccgaaacgggtacccttaaccgttaccctaacgttacccttaccgttacttccgttacggacgggtccggggtcgttcgggaccgaacgggccgtaccgaacgttaggncg

SEQ ID NO: 54196 - DNA, 554 bp, Homo sapiens
  misc_feature: GYAE6OF02GFOGO.29.78.H01.1.454.CMB.1.raw
tcagatagagtactcacgaccggtgctcgatttagtgtgagtagtttgggtttggggtctgagagaggagtccacccctgggatcttcaggtgttttcatttggtgatcaggacggaacagagagaactcaccatggagtttgggctgagctggctttttcttgtggctattttaaaaggtgtccagtgtgacgtgcagttggtggagtctgggggcgcctggggtacggccgggggggtcgctgagactctcctgtgcggcctctggattaaggttttaggagtcatgccatgaactgggtccgccaggctccagggaaggggctggagtgggtctcggctattagtggcagtggtggcgctatatattatgcagacgccctgaagggccgttcaccatttccagacgacaatacaaggggggggaacacgctgtatctgcaatggagagcctgagactcgacgacacgccgtctattattgtgttaagcgagctggagtacgggaccgggcccggacgttcgacgacgtcgggccgagggacgcgtggtccg

SEQ ID NO: 54197 - DNA, 559 bp, Homo sapiens
  misc_feature: GYAE6OF02HWB5Z.29.78.H01.1.454.CMB.1.raw
  modified_base (536)..(536): a, c, t, g, unknown or other
  misc_feature (536)..(536): n is a, c, g, or t
  modified_base (558)..(559): a, c, t, g, unknown or other
  misc_feature (558)..(559): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccaggggaaggggctggagtgggtctcggctattagtggcagtggtggcgctatatattatgcagacgccctgaagggccggttcaccatttccagagacaattcgaagaacacgctgtatctgcaaaatggagagcctgagactcgacgacacggccgtctattatgtgttaaaggcgagctggaatacggggaccgggcccgacttgaccacgtgggggccagggggacgcgtggtcaccgtctcctcagccctccaccgaacggcccactcggtccttcccccgtcggccaccctccctccaacgacgccacctcgtcggggcacgacgcacgcccgtgggcctcgcctggtcaacggactacttccagtactctatctgngcggctggcgacggcgcatagnn

SEQ ID NO: 54198 - DNA, 619 bp, Homo sapiens
  misc_feature: GYAE6OF02I01PZ.29.78.H01.1.454.CMB.1.raw
  modified_base (266)..(266): a, c, t, g, unknown or other
  misc_feature (266)..(266): n is a, c, g, or t
  modified_base (616)..(616): a, c, t, g, unknown or other
  misc_feature (616)..(616): n is a, c, g, or t
tcagatagagtactcacgaccggtgctcgatttagtgtgagtagtttgggtttggtggtctctctcccagcctgtgctgactcaatcgccctctgcctctgcctccctgggaggctcggtcaaggtcacctgtactctgagcagtggacacagcagctacgccatcgcttggcatcagcagaggccagacacgggccctcgttacttgatgacagtcaacaatgatggcagtcacagcgaagggggacggatccctgatcgcttcncacgtctaccgagcctcgtgggcctggacgcgctacctcacaatccgccggctccagtctggaaggatggagctgacttattactgtacagacccgtggggacctacgtggactagttcgacgggttccgttaccggggaaccggggtaaccaagggttcccgaccggttcggtaccggtaccgaaccggaccccgaagggtaccccaaaccccgtacgttccgtaccctaaccgttccgttaccgtttacccccaacccgtttccctacgtaacgttacccttcgtagttccgtacgggacggtccgggtaccgttacgggaccgtaacgggtccacgtaagtacggcngtc

SEQ ID NO: 54199 - DNA, 743 bp, Homo sapiens
  misc_feature: GYAE6OF02F9JDJ.29.78.H01.1.454.CMB.1.raw
  modified_base (154)..(154): a, c, t, g, unknown or other
  misc_feature (154)..(154): n is a, c, g, or t
tcagatagagtactcacgaccggtgctcgatttagtgtgagtagtttgggtttggggtctgagagaggagtccacccctgggatcttcaggtgttttcatttggtgatcaggacggaacagagagaactcaccatggagtttgggctgagcggngtgtttctaggtcggctaatttaaaggtgtcagtgtgacgtgctagttggtggagtcgtgggggcgccgttggggtacgggccgggggggttcgcgtgacgactctccgtgtggccggtcctacgtgggtaatttaacggttttaaggagtacgatcgactagtacgtacgtcggaccgacgacggtccgtacggaggggacggtcggtaggtacggtcggtacgtacggtagttacggttaggtggacgtaggtcggtcgtactaacttaagtaagttaagtacgtcggacgtacggtacccggtaccggtacgggtacgggttacccgttaacctaaccgttacgtacgaacgtaacgtaaccgtaacgtacgaaacgaacgtacgttacgtacgtacgtacgtaagaacgtaggtacgtacgtacgccgaacgacgtaccgaccgtaccgacgttcgtacttagttagttagtaaggtaacggtaacgcgtacggtacggtaacggtaacccgggtccgggacccgttacggaccgtaccggacgggacgggtccggaccggtacggtccgtaccggtaccgtacg

SEQ ID NO: 54200 - DNA, 534 bp, Homo sapiens
  misc_feature: GYAE6OF02G8EF6.29.78.H01.1.454.CMB.1.raw
  modified_base (465)..(465): a, c, t, g, unknown or other
  misc_feature (465)..(465): n is a, c, g, or t
  modified_base (530)..(530): a, c, t, g, unknown or other
  misc_feature (530)..(530): n is a, c, g, or t
  modified_base (534)..(534): a, c, t, g, unknown or other
  misc_feature (534)..(534): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacggggaccgggcccgacttgaccactggggccaggggacgctggtcaccgtctcctcagcctccaccaagggcccatcggtcttccccctggccaccctcctccaagacgcacctctggggcacngcagccctgggctgcctggtcaacggactacttccagtactctatctgagcggctggcaggcgcntagn

SEQ ID NO: 54201 - DNA, 533 bp, Homo sapiens
  misc_feature: GYAE6OF02F0H0A.29.78.H01.1.454.CMB.1.raw
  modified_base (510)..(510): a, c, t, g, unknown or other
  misc_feature (510)..(510): n is a, c, g, or t
  modified_base (532)..(533): a, c, t, g, unknown or other
  misc_feature (532)..(533): n is a, c, g, or t
tcagatagagtactcacgaccggtgctcgatttagtgtgagtagtttgggtttgggggcacctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacggggaccgggcccgacttgaccactggggccaggggacgctggtcaccgtctcctcagcctccaccaaggggccccatccggtcttccccctggccaccctcctccaacgagcacctctcggggcacagcagccctggctgcctggtcaagctacttcagtactctatcngagcggcgtggcaggcgcatgnn

SEQ ID NO: 54202 - DNA, 626 bp, Homo sapiens
  misc_feature: GYAE6OF02GG73Y.29.78.H01.1.454.CMB.1.raw
  modified_base (623)..(623): a, c, t, g, unknown or other
  misc_feature (623)..(623): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccgggcccgacttgaccacgtggggccaggggacgctggtcaccgtctcctcagcctccaccgaagggcccatccggtccttccccctcggccaccctccctacccaacgacgccacctcgtcgggggccaccgacgccacgcccgtcgggcctcggcccgttcgggtaccaaacgggtaccttaacctttcccgtaacgttaccttaccttaacgttccgttacggtacggtccggggtccgttcgggaccgtaacgggccggacgtaacgttaggnacg

SEQ ID NO: 54203 - DNA, 562 bp, Homo sapiens
  misc_feature: GYAE6OF02GXC7X.29.78.H01.1.454.CMB.1.raw
  modified_base (561)..(562): a, c, t, g, unknown or other
  misc_feature (561)..(562): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccggggcccgacttgaccactgggggccagggggaccgcgtggtcaccgtctccctcacgcctccaccaacgggcccacgtccggtccttccccctcggccaccctccctcccaacgacgccacctccgtcggggccacagccacgccctgggctcgccgtggtcaacggactactccacgtactctatctgacggcggctggcgaaggcgcatgnn

SEQ ID NO: 54204 - DNA, 534 bp, Homo sapiens
  misc_feature: GYAE6OF02F74HC.29.78.H01.1.454.CMB.1.raw
  modified_base (533)..(534): a, c, t, g, unknown or other
  misc_feature (533)..(534): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccgggcccgacttgaccactgggggccagggggacgctggtcaccgtctcctcagcctccaccaaggcccatcggtctccccctggcaccctcctccaacgacgcacctctcggggcacagcagccctgggctgcctggtcaaggactacttccagtactctatctgagcggctggcaggcgcatagnn

SEQ ID NO: 54205 - DNA, 569 bp, Homo sapiens
  misc_feature: GYAE6OF02F29MI.29.78.H01.1.454.CMB.1.raw
  modified_base (568)..(569): a, c, t, g, unknown or other
  misc_feature (568)..(569): n is a, c, g, or t
tcagatagagtactcacgaccggtgctcgatttagtgtgagtagtttgggtttgggggcgcctgggtacgaccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccgggcccgacttgaccacgtggggccaggggacgcgtggtcaccgtctccctcgacgccctcccaccgaacgggcccactccggtccttcccccgtcggcccaccctccctccaacgacgccacctcgtcggggccacgacgcacgcccgtgggctcgccgtgtaccgaagactactccacgtctctactctcgacgcggcgtggacgacggcgacagtagnn

SEQ ID NO: 54206 - DNA, 505 bp, Homo sapiens
  misc_feature: GYAE6OF02FU4WV.29.78.H01.1.454.CMB.1.raw
  modified_base (380)..(380): a, c, t, g, unknown or other
  misc_feature (380)..(380): n is a, c, g, or t
  modified_base (483)..(483): a, c, t, g, unknown or other
  misc_feature (483)..(483): n is a, c, g, or t
tcagatagagtactcacgaccggtgctcgatttagtgtgagtagtttgggtttggggtccgagccatggtgcagactccccagagctctcctcctcctccactgcacagggtctctctcccagcctgtgctgactcaatcgccctctgcctctgcctccctgggaggctcggtcaaggtcacctgtactctgagcagtggacacagcagctacgccatcgcttggcatcagcagaggccagacacgggccctgttacttgatgacagtcaacaatgatggcagtcacagcgaagggggacggatcccgtgatcgcttctcagtctccagctcgtgggcctgacgcgctacctcaacaatcctccggcctccagtctgagntgagctgactattctgtcagtccgtgggcacgtggctagttcgaggttcctcgggaccgggacaggtcaccggtcgtcggtcacgcccgaacggcccaacccnctcgtaccactcctcgtccccg

SEQ ID NO: 54207 - DNA, 542 bp, Homo sapiens
  misc_feature: GYAE6OF02HA1O8.29.78.H01.1.454.CMB.1.raw
  modified_base (235)..(235): a, c, t, g, unknown or other
  misc_feature (235)..(235): n is a, c, g, or t
  modified_base (378)..(378): a, c, t, g, unknown or other
  misc_feature (378)..(378): n is a, c, g, or t
  modified_base (500)..(500): a, c, t, g, unknown or other
  misc_feature (500)..(500): n is a, c, g, or t
  modified_base (541)..(541): a, c, t, g, unknown or other
  misc_feature (541)..(541): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttnaccatttccagagacaattcgaagaacacgctgtatctgcaaatggagagcctgagactcgacgacacggccgtctattatgtgttaaaggcgagctggaaatacgggaccggggcccacttgaccactggggccaggggacnctggtcaccgtctcctcagcctcaccaaggccatcgtctcccctggcacctcctccaacgagcacctcctggggcacgagcagcctcgggctcgcctggtcaaggactacttccgagtactntactccttgacgcgggtactggcgaacggcgacgatacggnc

SEQ ID NO: 54208 - DNA, 580 bp, Homo sapiens
  misc_feature: GYAE6OF02GKJMJ.29.78.H01.1.454.CMB.1.raw
  modified_base (243)..(243): a, c, t, g, unknown or other
  misc_feature (243)..(243): n is a, c, g, or t
tcagatagagtactcacgaccggtgctcgatttagtgtgagtagtttgggtttggggtctgagagaggagtccacccctgggatcttcaggtgttttcatttggtgatcaggacggaacagagagaactcaccatggagtttgggctgagctggctttttcttgtggctattttaaaaggtgtccagtgtgacgtgcagttggtggagtctgggggcgccgtggggtacggccgggggggtcncgtgagactctcctgtgcggcctctggattaagtttaggagtcatgccatgaactgggtccgccaggcctccgagggaagggctggagtgggtctcggctattagtggcaggtggtggcgctatatattatgcagacgccgtgaacgggccgttcacctatttccagacgacaattacgaaagaacacgctagtactctagacaaatggagacgcctgagacgtcgacgacacggccgttctattattgtagttaaaggcgagcgtaggaagtaccgggggaccgggtcccacgttcggaccctacggtcgggggccaaggggccacgtggtacccg

SEQ ID NO: 54209 - DNA, 503 bp, Homo sapiens
  misc_feature: GYAE6OF02IA1Y8.29.78.H01.1.454.CMB.1.raw
  modified_base (424)..(424): a, c, t, g, unknown or other
  misc_feature (424)..(424): n is a, c, g, or t
  modified_base (446)..(446): a, c, t, g, unknown or other
  misc_feature (446)..(446): n is a, c, g, or t
  modified_base (469)..(469): a, c, t, g, unknown or other
  misc_feature (469)..(469): n is a, c, g, or t
  modified_base (501)..(502): a, c, t, g, unknown or other
  misc_feature (501)..(502): n is a, c, g, or t
tcagatagagtactcacgaccggtgctcgatttagtgtgagtagtttgggtttggtggtctctctcccagcctgtgctgactcaatcgccctctgcctctgcctccctgggaggctcggtcaaggtcacctgtactctgagcagtggacacagcagctacgccatcgcttggcatcagcagaggccagacacgggccctcgttacttgatgacagtcaaacaatgatggcagtcacagcgaagggggacggatcccgtgatcgcttctcagtctcagctcgtgggcctgacgcgctacctcacaactctccggctccagtctgagatgagctgactatactgtcagaccgtgggcacgtggctattcgaggtcttcgggacgggaccagggtcaccgtcgtcgtcacgccaacggcccaacccngtcgtccactcctcgttacccncccttcactacgtcctctatcgnggacgcgggcctggcgaaggccagagtacgcnng

SEQ ID NO: 54210 - DNA, 536 bp, Homo sapiens
  misc_feature: GYAE6OF02HOJYF.29.78.H01.1.454.CMB.1.raw
  modified_base (535)..(536): a, c, t, g, unknown or other
  misc_feature (535)..(536): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccgggcccgacttgaccactggggccaggggacgctggtcaccgtctcctcagcctccaccaaggcccatcggtcttccccctggcaccctcctccaagacgcacctctcggggcacacgcagccctgggctcgcctggtcaaggactacttccagtactctatctgagcggctggcaggccgcgactagnn

SEQ ID NO: 54211 - DNA, 668 bp, Homo sapiens
  misc_feature: GYAE6OF02GC9J5.29.78.H01.1.454.CMB.1.raw
tcagatagagtactcacgaccggtgctcgatttagtgtgagtagtttgggtttggtggtctctctcccagcctgtgctgactcaatcgccctctgcctctgcctccctgggaggctcggtcaaggtcacctgtactctgagcagtggacacagcagctacgccatcgcttggcatcagcagaggccagacacgggccctcgttacttgatgacagtcaacaatgatggcagtcacagcaagggggacggatccctgatcgcttctcagtcctccagctcgtgggcctgagccgctacctcacaatcctccggcctccagtctgaggatggaggctgactattactgtcagaccgtggggcctacgtcggactagtttcgacggggttccttaccggggaacccggggtaaccaaacggggttcccgaacccggttccgggtaccgggttacccaaccgggcccccgtaaaacggggccccccaaaacccccgtacgttcggttacccaacccgtttccgtttacccgggtttccccccgtacccccgtttccccgttaccgtaaacgggtttacccttacccgttaacgttcccggtttgggaaccgggtcccgggggtacccttacggggaccgtaaacggggccgtaccgaagtttacggctagcg

SEQ ID NO: 54212 - DNA, 611 bp, Homo sapiens
  misc_feature: GYAE6OF02ITVLD.29.78.H01.1.454.CMB.1.raw
  modified_base (607)..(607): a, c, t, g, unknown or other
  misc_feature (607)..(607): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttcccagagacaattcgaagaacacgctgtatctgcaaatggagagcctgagactcgacgacacggccgtctattattgtgttaaaggcgagctggaatacgggaccgggcccgacttgaccacgtggggccaggggacgctggtcaccgtctcctcagcctccaccgaagggcccactcggtccttcccccgtggccaccctcctcccaacgacgccaccctccgtcgggggccaccgacgccgacgcccgtcggggcctcgcccgtgggtaccgaaacgggaccttaaccttcccgaagttaccgttaccttacgtcttacggacggccgggtcgtcggaccgaacgggccggcgaagttacggntacg

SEQ ID NO: 54213 - DNA, 176 bp, Homo sapiens
  misc_feature: GYAE6OF02HG0YB.29.78.H01.1.454.CMB.1.raw
  modified_base (176)..(176): a, c, t, g, unknown or other
  misc_feature (176)..(176): n is a, c, g, or t
tcagatagagtactcacgaccggtgctcgatttagtgtgagtagtttgggtttgggggaagaggaagactgacggtccacccctgggatcttcaggtgttttcatttggtgatcaggacggaacagagagaactcaccatggagtttgggctgagcgggctggcaaggcgcatagn

SEQ ID NO: 54214 - DNA, 559 bp, Homo sapiens
  misc_feature: GYAE6OF02G2X1I.29.78.H01.1.454.CMB.1.raw
  modified_base (548)..(548): a, c, t, g, unknown or other
  misc_feature (548)..(548): n is a, c, g, or t
tcagatagagtactcacgaccggtgctcgatttagtgtgagtagtttgggtttggggtctgagagaggagtccacccctgggatcttcaggtgttttcatttggtgatcaggacggaacagagagaactcaccatggagtttgggctgagctggcttttcttgtggctattttaaaaggtgtccagtgtgacgtgcagttggtggagtctgggggcgcctgggtacggccgggggggtcgctgagactctcctgtgcggcctctggattaagtttaggagtcatgccatgaactgggtccgccaggctccagggaaggggctggagtgggtctcggctattagtggcagtggtggcgctatatattatgcagacgccctgaagggccggttcaccatttccagagacaattcgaagacacgctgtatctgcaaatggagagcctgagactcgacgacacggccgtctattattgtgttaaaggcgtagctaggaatacggggaccggggcccgacgttcgaccgtacgtggggtacccgagggggacncgtggtacccg

SEQ ID NO: 54215 - DNA, 567 bp, Homo sapiens
  misc_feature: GYAE6OF02HFW2Y.29.78.H01.1.454.CMB.1.raw
tcagatagagtactcacgaccggtgctcgatttagtgtgagtagtttgggtttgggggagagaggagtccacccctgggatcttcaggtgttttcatttggtgatcaggacggaacagagagaactcaccatggagtttgggctgagcgtggctttttcttagtggctattttaaaaggtgtccagtgtgacgtgcagttggtggagtctgggggcgcctggggtacggccgggggggtcgctgagactctcctgtgcggcctctggattaaagttttaggagtcatgccatgaactgggtccgccaggctccagggaaggggctgggagtgggtctcggctatagtggcagtggtggcgctatatattatgcagacgccctgaacgggccggttcaccatttccagagacaattcgaagaacacgctgtatctgcaaatggagagcctgagactcgacgacacggccgtactattagttgtagttaaaggcgagctggacgtacgggaccgggcccgacgttcggaccacgtggggccacggggaccgcgtcggtcgaccgtcccg

SEQ ID NO: 54216 - DNA, 579 bp, Homo sapiens
  misc_feature: GYAE6OF02FQ5HY.29.78.H01.1.454.CMB.1.raw
  modified_base (578)..(579): a, c, t, g, unknown or other
  misc_feature (578)..(579): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccggggcccgacttgaccactggggccaggggacgcgtggtcaccgtctcctcacgccctccaccgaacgggcccacgtccggtccttcccccgtcggccacccctccctacccaacgacgccaccctcgtcgggggccacacgccacgcccgtgggcctcgccgtcggtcaacggacttaccttccacgttacctctatctgacggccgggcgtggcgaaggccgcactagnn

SEQ ID NO: 54217 - DNA, 620 bp, Homo sapiens
  misc_feature: GYAE6OF02H9O0O.29.78.H01.1.454.CMB.1.raw
  modified_base (616)..(616): a, c, t, g, unknown or other
  misc_feature (616)..(616): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacggggaccgggggcccgacttgaccacgtcgggggccagggggacgcgtgggtcaccgtctccctcacgcctccaccgaagggcccacgtcgtccttcccctcggccaccctcctaccaacgacgccacctcgtcggggcacgagccacgcccgtgggcctcggcccgttcgggtaccgaaacgggaccttaaccgtttcccgaacgttaccttccgttaagttccgttacggacgggccggggtcgtcgggaccgaacgggccgacgacgtaggntacg

SEQ ID NO: 54218 - DNA, 605 bp, Homo sapiens
  misc_feature: GYAE6OF02G5MWK.29.78.H01.1.454.CMB.1.raw
  modified_base (603)..(603): a, c, t, g, unknown or other
  misc_feature (603)..(603): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccgggcccgacttgaccactggggccaggggacgcgtggtcaccgtctccctcagccctccaccaacgggcccatccggtccttcccccgtggcccaccctccctccaacgacgccaccctcgtcgggggcacgacgccacgcccgtcgggcctcgcccgtcgggtaccgaacgggaccttaaccttcccgtacgttaccttccttacttccgtaggacggccgggtccgttgggaccgaacgggccgacgacgtacgncg

SEQ ID NO: 54219 - DNA, 640 bp, Homo sapiens
  misc_feature: GYAE6OF02GNFQB.29.78.H01.1.454.CMB.1.raw
  modified_base (428)..(428): a, c, t, g, unknown or other
  misc_feature (428)..(428): n is a, c, g, or t
tcagatagagtactcacgaccggtgctcgatttagtgtgagtagtttgggtttggggtctgagagaggagtccacccctgggatcttcaggtgttttcatttggtgatcaggacggaacagagagaactcaccatggagtttgggctgagctggctttttcttgtggctattttaaaaggtgtccagtgtgacgtgcagttggtggagtctgggggcgccgtggggtacgggccgggggggtcgcgtgagactctcctgtgcggcctctggattaagtttaggagtcatgccatgaactgggtccgccaggctccgagggaaggggctggagtgggtctcggctattagtggcagtggtggcgctatatattatgcagacgccctggaacgggccgttcacctatttccagagacaattcgaagaacncgctgtactctagacaaagtgggaagagcccgttagaacgtaccgtacggaaccgaaccgaccgggtcccgttacttaacgttttaagtttggttaaggtttaaaacgggcgtacggtcgttagggaacggtaccgggggacccggggtaccccgtacgttacggacccgtacggtacgggggcccgaagggggaccgtcggtaggtacccg

SEQ ID NO: 54220 - DNA, 609 bp, Homo sapiens
  misc_feature: GYAE6OF02GEEK2.29.78.H01.1.454.CMB.1.raw
  modified_base (324)..(324): a, c, t, g, unknown or other
  misc_feature (324)..(324): n is a, c, g, or t
  modified_base (400)..(400): a, c, t, g, unknown or other
  misc_feature (400)..(400): n is a, c, g, or t
tcagatagagtactcacgaccggtgctcgatttagtgtgagtagtttgggtttggggtccgagccatggtgcagactccccagagctctcctcctcctccactgcacagggtctctctcccagcctgtgctgactcaatcgccctctgcctctgcctccctgggaggctcggtcaaggtcacctgtactctgagcagtggacacagcagctacgccatcgcttggcatcagcagaggccagacacggccctgttacttgatgacagtcaacatgatggcagtcacgaggacgaaagggggcggatcccgtgacgttcgctttcncagtctaccgagtcctcgtgggcctgacgccgtactaccctcaactaactccgtccggcctcgagtcctggaggtntgacgtctagtaacttattacgtgtacacggtaccgtggggacacggtaggacctagtttacgaacggttccgttaccgggaaccgggtaccgtaacgggttccaacccgggttcggtaccggtacctaacccggtaccccgaaaccggtcccctaaaccccggtcgttaccggtacccgtaacccgttccgttcccggttaccccccg

SEQ ID NO: 54221 - DNA, 547 bp, Homo sapiens
  misc_feature: GYAE6OF02ISF63.29.78.H01.1.454.CMB.1.raw
  modified_base (431)..(431): a, c, t, g, unknown or other
  misc_feature (431)..(431): n is a, c, g, or t
  modified_base (545)..(546): a, c, t, g, unknown or other
  misc_feature (545)..(546): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccggggcccgacttgaccactggggccagggggacgctggtcaccggtctcctcagcctccacaggcccatcgtcttcccctggcnccctctccagacgcacctctcggggcacgagcacgccctgggctcgcctggtcaaggacctactccagtacctctacgtctgacggcgggcgtggcgaagggccgacacgtagnng

SEQ ID NO: 54222 - DNA, 533 bp, Homo sapiens
  misc_feature: GYAE6OF02JQHFC.29.78.H01.1.454.CMB.1.raw
  modified_base (375)..(375): a, c, t, g, unknown or other
  misc_feature (375)..(375): n is a, c, g, or t
  modified_base (444)..(444): a, c, t, g, unknown or other
  misc_feature (444)..(444): n is a, c, g, or t
  modified_base (532)..(532): a, c, t, g, unknown or other
  misc_feature (532)..(532): n is a, c, g, or t
tcagatagagtactcacgaccggtgctcgatttagtgtgagtagtttgggtttggggcgcctgggtacggccggggggtcgctgagactctcctgtgcggcctctggattaagtttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccgggccgacttgaccactggggccaggggacnctggtcaccgtctcctcagcctccaccaaggcccatcggtcttcccctggccaccctcctccaacgacncacctctcggggcacgacgcacgccctgggctcgcctcggtcaaggctacttccagtactctatctgagcggctggcaggcgcatagnc

SEQ ID NO: 54223 - DNA, 575 bp, Homo sapiens
  misc_feature: GYAE6OF02IC4GO.29.78.H01.1.454.CMB.1.raw
  modified_base (574)..(575): a, c, t, g, unknown or other
  misc_feature (574)..(575): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtggggtctcggctattagtggcagtggtggcgctatatattatgcagacgccctgaagggccggttcaccatttccagagacaattcgaagaacacgctgtatctgcaaatggagagcctgagactcgacgacacggccgtctatttattgtgttaaaggcgagctggaatacgggaccgggcccgacttgaccactggggccagggggacgctggtcaccgtctcctcagcctccaccaagggcccatccggtccttcccccgtcggccaccctccctcccaacgacgcctaaccctcgtcggggggccacgacgccgacgccccgtgggcctggcccttgggtccaaacggacttactccagtacctctactctgacgccgggctggcgaaggcgcagtagnn

SEQ ID NO: 54224 - DNA, 581 bp, Homo sapiens
  misc_feature: GYAE6OF02GUSEF.29.78.H01.1.454.CMB.1.raw
  modified_base (477)..(477): a, c, t, g, unknown or other
  misc_feature (477)..(477): n is a, c, g, or t
tcagatagagtactcacgaccggtgctcgatttagtgtgagtagtttgggtttggggtctgagagaggagtccacccctgggatcttcaggtgttttcatttggtgatcaggacggaacagagagaactcaccatggagtttgggctgagctggctttttcttgtggctattttaaaaggtgtccagtgtgacgtgcagttggtggagtctgggggcgcctgggtacggccgggggggtcgctgagactctcctgtgcggcctctggattaagttttaggagtcatgccatgaactgggtccgccaggcctccgaggggaaggggctgggagtgggtctcggctagttagtggcagtggtggcgctatatattatgcagcgccctggaacgggccgttcaccatttccagagacaatcgaaagaacacgctgtatctgacaaagtggagagcctgagactcgacgacgacggccgtntattattgtagttaaaggcgagcgtagggaacgtacgggggacccggggacccgtacgttacgacccgacggtcggggacccgagggggaccgcggtggtcccg

SEQ ID NO: 54225 - DNA, 534 bp, Homo sapiens
  misc_feature: GYAE6OF02I876D.29.78.H01.1.454.CMB.1.raw
  modified_base (450)..(450): a, c, t, g, unknown or other
  misc_feature (450)..(450): n is a, c, g, or t
  modified_base (533)..(534): a, c, t, g, unknown or other
  misc_feature (533)..(534): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattatgtgttaaaggcgagctggaatacgggaccgggcccgacttgaccactgggggccagggggacgcgtggtcaccggtctcctcagcctcaccaggccatcgtctcccctggcacctcctccaagacgcacctcnggggccacacgcacgccctgggctgccgtggtcaaggactacgttccagtactctatctgacgcggctggcacggcgcatagnn

SEQ ID NO: 54226 - DNA, 586 bp, Homo sapiens
  misc_feature: GYAE6OF02HZFR8.29.78.H01.1.454.CMB.1.raw
  modified_base (565)..(565): a, c, t, g, unknown or other
  misc_feature (565)..(565): n is a, c, g, or t
  modified_base (584)..(584): a, c, t, g, unknown or other
  misc_feature (584)..(584): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggcgggcccgagttgaccacgtggggccaggggacgctggtcaccggtctcctcagcctcccaccgaacgggcccactcggtccttccccctcggccaccctccctaccaacgacgccaccctccgttcgggggccaccgacgccgacggcccgttacgggcctcggcctgggtccaacggactaaccgttccagtacctctacgtcgtacgacggcgggtcnggtcacggcgacagtacgncg

SEQ ID NO: 54227 - DNA, 834 bp, Homo sapiens
  misc_feature: GYAE6OF02FWY1T.29.78.H01.1.454.CMB.1.raw
tcagatagagtactcacgaccggtgctcgatttagtgtgagtagtttgggtttgggggtcgggcctcgggtacgggcccggggggttccgactgagactctccctgtgccggccgtcgtcggattaacgttttacggagttccactgacctatcgaactcgggtccggcccaaggtcctccagggaacgggctgggagtcgggtctcgggctacttagtggcagtggtggcccgcgtagtatattatgctagaccgccctgaacgggtcccgttacacctagttccagagtaccaattcgaagactacgctcgaatcgtgcaaatggaaacgtgacctaggacaccgtacggaccgactacggaccgttactaattaattaagtacgttaaaaggcctacgcgttcggaattcccggggaaccgggtccccacttcggaccctaccgtgggggtcccgaaggggaaccgcgtttgggaccctaccggtcctcccgtcgtacgtcccgtttacccgaccgaaccggggtcccctaacgttccgggtacccggtttaccccccgtagggggtaccctaccccgttaccccttacccgtaaacggtaccggtccctaaaccccgttcccgttaccgggggggttacctacggtacgggcctaacggtcccgttcgggtccgttcgggacccggttccgggtaaccgtaaacgggtacccttaccggtttacccgtacgtttaacccgttctaccggtacctacgggtaccggtacccggggtcccgttacgggaccggtaaccggtcccgttacccgtaaccgttaccggtctaccg

SEQ ID NO: 54228 - DNA, 616 bp, Homo sapiens
  misc_feature: GYAE6OF02JFA3S.29.78.H01.1.454.CMB.1.raw
  modified_base (614)..(614): a, c, t, g, unknown or other
  misc_feature (614)..(614): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccgggcccgacttgaccacgtggggccaggggacgcgtggtcaccgtctcctcagccctccaccaacgggcccactccggtccttcccccgtcggcccaccctccctcccaacgacgccaccctcgtcggggccacgacgccgacgcccgtcgggctcgccgtcggtaccgaaacggaccttaccgttcccgtaacgttaccttcttacgttccgttacggacgggtccgggtacgttcgggaccgtaacgggccgtcgtaacgtacgncg

SEQ ID NO: 54229 - DNA, 554 bp, Homo sapiens
  misc_feature: GYAE6OF02IFWYI.29.78.H01.1.454.CMB.1.raw
  modified_base (383)..(383): a, c, t, g, unknown or other
  misc_feature (383)..(383): n is a, c, g, or t
  modified_base (552)..(554): a, c, t, g, unknown or other
  misc_feature (552)..(554): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgaagacgccctgaagggtcggttcaccatttccagagacaattcgaagaacacgctgtatctgcaaatggagagcctgagactcgacgacacggccgtctattattgtgttaaaggcgagctggaatacggggaccggggcccgacttgaccacgtggggccagggggacncgtggtcaccgtctcctcagccctccaccaacgggcccactcggtccttccccctggccaccctcctccaagacgcacctcgtcggggcacagcacgccctcgggctcgccgtggtcaaggactacttccacgtactctatcgtgacgcgggctgcgaggcgacatagnnn

SEQ ID NO: 54230 - DNA, 600 bp, Homo sapiens
  misc_feature: GYAE6OF02GJ3SL.29.78.H01.1.454.CMB.1.raw
  modified_base (381)..(381): a, c, t, g, unknown or other
  misc_feature (381)..(381): n is a, c, g, or t
  modified_base (597)..(597): a, c, t, g, unknown or other
  misc_feature (597)..(597): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtagttaaaggcgagctggaatacgggaccgggcccgactgaccacgtcggggccaggggacncgtggtcaccgtctcctcacgcctcccaaccgaacgggcccacgtccggtcccttcccccgtcggcccacccctccctacccaacgacgccaccgttccgtcggggccacgacgccacgccccgtgggccgtcgccgtcggtaccgaacggtactaccgttaccgacgtacctctacgtctcgacggcgggcgtcggacgacggccgacacgtagntcg

SEQ ID NO: 54231 - DNA, 547 bp, Homo sapiens
  misc_feature: GYAE6OF02GLX7W.29.78.H01.1.454.CMB.1.raw
  modified_base (426)..(426): a, c, t, g, unknown or other
  misc_feature (426)..(426): n is a, c, g, or t
  modified_base (438)..(438): a, c, t, g, unknown or other
  misc_feature (438)..(438): n is a, c, g, or t
  modified_base (546)..(547): a, c, t, g, unknown or other
  misc_feature (546)..(547): n is a, c, g, or t
tcagatagagtactcacgaccggtgctcgatttagtgtgagtagtttgggtttgggggcgcctgggtaccggccggggggtcgctgagactctcctgtgcggcctctggattaagtttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccggggcccgacttgaccactggggccaggggacgcgtggtcaccgtctcctcagcctccacaggccatcgtctcccctgcnccctcctccagngcacctcgtcggggcacgacgcacgcccgtgggcctcgccgtcggtaccacggactacctccagtactctatcgtgacgcggtcgtggccgaaggccgacgagtacgnn

SEQ ID NO: 54232 - DNA, 534 bp, Homo sapiens
  misc_feature: GYAE6OF02HJ8H1.29.78.H01.1.454.CMB.1.raw
  modified_base (532)..(534): a, c, t, g, unknown or other
  misc_feature (532)..(534): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagccggaatacgggaccggggcccgacttgaccactgggcccagggggacgctgggtcaccgtctcctcagcctccaccaagggcccatcgtcttccccctggcaccctcctccaagacgcacctctggggcacagcacgccctgggctgcctggtcaaggctacttccatactctatctgagcggctggcaggcgcatagnnn

SEQ ID NO: 54233 - DNA, 552 bp, Homo sapiens
  misc_feature: GYAE6OF02F9VMX.29.78.H01.1.454.CMB.1.raw
  modified_base (548)..(548): a, c, t, g, unknown or other
  misc_feature (548)..(548): n is a, c, g, or t
  modified_base (550)..(550): a, c, t, g, unknown or other
  misc_feature (550)..(550): n is a, c, g, or t
tcagatagagtactcacgaccggtgctcgatttagtgtgagtagtttgggtttggtggtctctctcccagcctgtgctgactcaatcgccctctgcctctgcctccctgggaggctcggtcaaggtcacctgtactctgagcagtggacacagcagctacgccatcgcttggcatcagcagaggccagacacgggccctcgttacttgatgacagtcaacaatgatggcagtcacagcgaagggggacggatccctgatcgcttctcagtcctccagctcgtgggcctgacgcgctacctcacaatcctccggcctccagtctgaggatggaggctgactattactgtcagaccgtgggacacgtggctagttcgaggttcgttaccgggaccggggtacctaagggtccaccggttcgtccggtacacgacccgaacggccccaaccctacgtcgtaccacttccgttccgttccccgcccttccgtcgacgttacctcttacgtcgtcggacgtccggggtctacgggcaacgggccgacagtcgntncg

SEQ ID NO: 54234 - DNA, 601 bp, Homo sapiens
  misc_feature: GYAE6OF02GUDSM.29.78.H01.1.454.CMB.1.raw
  modified_base (598)..(598): a, c, t, g, unknown or other
  misc_feature (598)..(598): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggtcggttcaccatttccagagacaattcgaagaacacgctgtatctgcaaatggagagcctgagactcgacgacacggccgtctattattgtgttaaaggcgagctggaatacggggaccggggcccgacttgaccactggggccagggggacgctggtcaccgtctcctcagcctccacaacgggcccatcggtccttccccctcggccaccctccctccaacgacgccaccctcgtcgggggccacgacgccgacgccccgtcggggcctcggcccgtcgggttccaaacgggtacctaaccttcccgacgttaccttctacgttcctaggacggcgggtccgtgggacgacgggccgacgacgtagntcg

SEQ ID NO: 54235 - DNA, 551 bp, Homo sapiens
  misc_feature: GYAE6OF02HRR27.29.78.H01.1.454.CMB.1.raw
  modified_base (322)..(322): a, c, t, g, unknown or other
  misc_feature (322)..(322): n is a, c, g, or t
  modified_base (548)..(549): a, c, t, g, unknown or other
  misc_feature (548)..(549): n is a, c, g, or t
tcagatagagtactcacgaccggtgctcgatttagtgtgagtagtttgggtttggtggtctctctcccagcctgtgctgactcaatcgccctctgcctctgcctccctgggaggctcggtcaaggtcacctgtactctgagcagtggacacagcagctacgccatcgcttggcatcagcagaggccagacacgggccctcgttacttgatgacagtcaacaatgatggcagtcacagcgaagggggacggatccctgatcgcttctcagtctccagctctgggcctgagcgctacctcacatctccggcctcagtctgaggntgaggctgactattactgtcagccgtggggcacgtggctattcgagggttcgttaccgggaccggggtaccaagggtccaccggttcggtcggtactacggccccgaacggccccaacccgacgttcgtacctaccttccgttccgttcccccgcccttcctactacgttaccttcttactccgtggacggtccgggtactcgggaccaacgggccgacagtacgnncg

SEQ ID NO: 54236 - DNA, 662 bp, Homo sapiens
  misc_feature: GYAE6OF02HUGRX.29.78.H01.1.454.CMB.1.raw
  modified_base (383)..(383): a, c, t, g, unknown or other
  misc_feature (383)..(383): n is a, c, g, or t
tcagatagagtactcacgaccggtgctcgatttagtgtgagtagtttgggtttgggggcgcctgggtacggccggggggtcggctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtagttaaaggcgagctggaatacggggaccggggcccgacttgaccacgtggggccaggggacnctggtcaccgtctcctcacgccctaccaccgaacgggcccacgtccggtcctttcccccgtcggccaccctccctacccaacgacgccaaccctccgtcgggggccaccgacgccgaacggccccgtggggccgtcggcccgttacgggtaccgtaaacgggtacccttaaccgtttaccccgaacggtttacccttaccgttaacgttccgttacggaacgggtccggggtaccgttacgggaccgtaaacggggccgaccgtaacgttacggctacg

SEQ ID NO: 54237 - DNA, 577 bp, Homo sapiens
  misc_feature: GYAE6OF02ITN2Z.29.78.H01.1.454.CMB.1.raw
  modified_base (576)..(576): a, c, t, g, unknown or other
  misc_feature (576)..(576): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccgggccgacttgaccacgtggggccaggggacgcgtggtcaccgtctcctcagcctccaccgaagggcccatccggtccttccccctggccaccctcctcccaacgacgccacccgtcgtcgggggccacgacgccacgcccgtgggcctcgccgtcggtccgaaacggtactaaccgttcccagtaccttctacgtctgacggcgggcgtggacgacgggccgcatacgnc

SEQ ID NO: 54238 - DNA, 585 bp, Homo sapiens
  misc_feature: GYAE6OF02GE6SG.29.78.H01.1.454.CMB.1.raw
  modified_base (584)..(585): a, c, t, g, unknown or other
  misc_feature (584)..(585): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtagttaaaggcgagctggaagtacggggaccgggccgacttgacccacgtgggggccagggggaccgcgtcgggtcaccggtctccctcacgccctccaccgaacgggcccacgtccggtccttcccccgtcggccaccctcctaccaacgacgccacctcgtcggggaccacgacgccacgcccgtgggctcgcctcggtcaacggactacttaccgacgtactctacgtctgacggcgggcgtggacgacggcgactagtagnn

SEQ ID NO: 54239 - DNA, 617 bp, Homo sapiens
  misc_feature: GYAE6OF02IFFP5.29.78.H01.1.454.CMB.1.raw
  modified_base (616)..(616): a, c, t, g, unknown or other
  misc_feature (616)..(616): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggcgtggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtagttaaaggcgagctggaagtacgggaccggggcccgacgttcgaaccacgtcggggccgaggggacgcgtggtccaccgtctcctcagccctaccaccgaacgggcccacgtccggttccttcccccgtcgggcctacccctccctacccgaacgacgacctacccttccggtcgggggccacgacgccgacgcccgtcgggccgtcggcccgtggtccgaacggtactaccgttccacgtacctctacgtctcggtacggcgggtcgtggacgaacgggccgacgtacgtagnc

SEQ ID NO: 54240 - DNA, 564 bp, Homo sapiens
  misc_feature: GYAE6OF02FLHFM.29.78.H01.1.454.CMB.1.raw
  modified_base (242)..(242): a, c, t, g, unknown or other
  misc_feature (242)..(242): n is a, c, g, or t
tcagatagagtactcacgaccggtgctcgatttagtgtgagtagtttgggtttggggtctgagagaggagtccacccctgggatcttcaggtgttttcatttggtgatcaggacggaacagagagaactcaccatggagtttgggctgagctggctttttcttgtggctattttaaaaggtgtccagtgtgacgtgcagttggtggagtctgggggcgcctggggtacggccgggggggtcnctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtagttaaaggcgagctaggaagtacggggaccggggcccgtacgttcgaccctacgtcggggacccagggggaccgcgtggtcccg

SEQ ID NO: 54241 - DNA, 568 bp, Homo sapiens
  misc_feature: GYAE6OF02F9LGH.29.78.H01.1.454.CMB.1.raw
tcagatagagtactcacgaccggtgctcgatttagtgtgagtagtttgggtttggggtctgagagaggagtccacccctgggatcttcaggtgttttcatttggtgatcaggacggaacagagagaactcaccatggagtttgggctgagcgtggcgttttctgtggctattttaaaaggtgtccagtgtgacgtgcagttggtggagtctgggggcgcctgggtacggccgggggggtcgctgagactctcctgtgcggcctctggattaagtttaggagtcatgcatgaactgggtccgcaggctccgagggaaggggctggagtggggtctcgggctagttagtgggcaggtggtggcgctatatattatgcagacgcctgaagggccggttcacatttccagagacaattcgaagaacacgctgtatctgcaaatggagagcctgacgactcgacgacacggcgtactattatgtagttaaagcgagctaggaacgtacggggaccgggtccgaacgttggaacccgacgttcgggggaccagggggaccgtcgtaggtacccg

SEQ ID NO: 54242 - DNA, 662 bp, Homo sapiens
  misc_feature: GYAE6OF02IQZRZ.29.78.H01.1.454.CMB.1.raw
  modified_base (197)..(197): a, c, t, g, unknown or other
  misc_feature (197)..(197): n is a, c, g, or t
  modified_base (201)..(201): a, c, t, g, unknown or other
  misc_feature (201)..(201): n is a, c, g, or t
  modified_base (205)..(205): a, c, t, g, unknown or other
  misc_feature (205)..(205): n is a, c, g, or t
  modified_base (207)..(207): a, c, t, g, unknown or other
  misc_feature (207)..(207): n is a, c, g, or t
  modified_base (222)..(222): a, c, t, g, unknown or other
  misc_feature (222)..(222): n is a, c, g, or t
  modified_base (226)..(226): a, c, t, g, unknown or other
  misc_feature (226)..(226): n is a, c, g, or t
  modified_base (252)..(252): a, c, t, g, unknown or other
  misc_feature (252)..(252): n is a, c, g, or t
  modified_base (260)..(260): a, c, t, g, unknown or other
  misc_feature (260)..(260): n is a, c, g, or t
  modified_base (323)..(323): a, c, t, g, unknown or other
  misc_feature (323)..(323): n is a, c, g, or t
tcagatagagtactcacgaccggtgctcgattttagtgtgagtagttttggggtttgggggggtagggaggagggagtcccaccccgtgggatcttacagggtgttttctatttggttgatcaggacggaacagagaagaacctcaccatggagtttgggctgtaggcggtgtggttctagggttcgctattaagtnttanagtntnagtgcagtgtgatgngggncgtggggacggcggggtcgctagcgnggtctccngtagcgtctctggacttagttggccttacatctaccattcgaagtgggcctacgcggctacgngggacgtcgtgggtaccggtggcgtcgtcgagtggagggctaggtggtagggtgctaagttactagttatgtatagggaccgtagtaaggtaacggtcggtactaacgtacttacgaagtacgtaacgtaacgtacggaacggaccacgttacgactaacttcgacgagtaacgtacgaagttaccgagttacgaacgtccgttacgacgagtaccgacgttactagttatacgtacggttaagacggtaagcgtagggacgtaacggtaccgggtcgtacgtacggtactacggtggtaaccggcggtaacgacggttacggtttacccggattccgg

SEQ ID NO: 54243 - DNA, 501 bp, Homo sapiens
  misc_feature: GYAE6OF02FOE72.29.78.H01.1.454.CMB.1.raw
  modified_base (339)..(339): a, c, t, g, unknown or other
  misc_feature (339)..(339): n is a, c, g, or t
  modified_base (454)..(454): a, c, t, g, unknown or other
  misc_feature (454)..(454): n is a, c, g, or t
  modified_base (499)..(501): a, c, t, g, unknown or other
  misc_feature (499)..(501): n is a, c, g, or t
tcagatagagtactcacgaccggtgctcgatttagtgtgagtagtttgggtttggtggtctctctcccagcctgtgctgactcaatcgccctctgcctctgcctccctgggaggctcggtcaaggtcacctgtactctgagcagtggacacagcagctacgccatcgcttggcatcagcagaggccagacacgggccctcgttacttgatgacagtcaacaatgatggcagtcacagcaagggggacggatccctgatcgcttctcagtctccagctctgggcctgagcgctacctcacaatctccggcctccagtctgagatgaggctgactattacngtcagacctggggcacgtgcattcaggtcttcgggaccggggaccaaggtcaccgtcgtcggtcacgcccaaggcccaaccccgactcgtccactcctcgttccccgcccttccnctacgtacctctactccgtgacgcgggctcggcaggcgacgatgnnn

SEQ ID NO: 54244 - DNA, 600 bp, Homo sapiens
  misc_feature: GYAE6OF02IFC47.29.78.H01.1.454.CMB.1.raw
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcagctggaatacgggaccggggcccgacttgaccacgtggggccaggggacgctggtccaccgtctcctcagccctcaccaacgggcccatccggtccttccccctggccaccctcctccaacgacgccacctcgtcggggccacgagccacgccccgtgggccgtcgccgtcgggtccaaacggtactaccttacccgaacgtaccttaccttactcgtacggacggtccggggtcgtcgggaccgaacgggccggacgtacgtagtgacg

SEQ ID NO: 54245 - DNA, 586 bp, Homo sapiens
  misc_feature: GYAE6OF02HC6A6.29.78.H01.1.454.CMB.1.raw
  modified_base (585)..(585): a, c, t, g, unknown or other
  misc_feature (585)..(585): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccggggcccgacgttgaccacgtcggggccaggggacgcgtggtcaccggtctcctcacgccctccaccaacgggcccatccggtcttccccctggccaccctccctcccaacgacgccaccctcgtcgggggccacgacgccacgcccgtcgggcctcgcccgttggtaccaacggacctaaccttcccacgttaccgtctacgtctcgaggtccgggctcggcgaacggccgcatagnc

SEQ ID NO: 54246 - DNA, 578 bp, Homo sapiens
  misc_feature: GYAE6OF02HC5WX.29.78.H01.1.454.CMB.1.raw
  modified_base (556)..(556): a, c, t, g, unknown or other
  misc_feature (556)..(556): n is a, c, g, or t
  modified_base (571)..(571): a, c, t, g, unknown or other
  misc_feature (571)..(571): n is a, c, g, or t
  modified_base (577)..(578): a, c, t, g, unknown or other
  misc_feature (577)..(578): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtagttaaaggcgagctggaatacggggaccggggcccgacttcgaccactgggggccagggggacgcgtgggtcacccgtctccctcacgccctccaacccgaacggggcccactccgggtcctttcccccccgtcgggccctacccctcctcccaacgacgccaaccctcgtcgggggccacgacgcacgcccgtgggcctgcctggtcaaggactacttccagtctctagtctgngcggctggcagggcncatagnn

SEQ ID NO: 54247 - DNA, 627 bp, Homo sapiens
  misc_feature: GYAE6OF02JA1ER.29.78.H01.1.454.CMB.1.raw
  modified_base (388)..(388): a, c, t, g, unknown or other
  misc_feature (388)..(388): n is a, c, g, or t
  modified_base (442)..(442): a, c, t, g, unknown or other
  misc_feature (442)..(442): n is a, c, g, or t
  modified_base (623)..(623): a, c, t, g, unknown or other
  misc_feature (623)..(623): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgacaaatggagagcctgagactcgacgacacggccgtctattacttgtagttaaaggcgagctaggaactacgggaccgggcccgacgttcgaccacgtcggggccaggggacncgtggtcacgtctccgcacgcctccacgaacggcccagtccggtccttccccgnggccaccctctccaacgacgccacctcgcggggccacgacgcgacgcccgtacgggcctacgcccgtggtaccgaaacgggtaccttaccgttaccgtaacgttaccgttacgttaaccgtccgttacggacggggtaccgggtcgttcgggacccgtaagggtcccgacgtaccgttagntacg

SEQ ID NO: 54248 - DNA, 578 bp, Homo sapiens
  misc_feature: GYAE6OF02I68KZ.29.78.H01.1.454.CMB.1.raw
  modified_base (576)..(576): a, c, t, g, unknown or other
  misc_feature (576)..(576): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccggggccgacgttgaccactggggccaggggacgcgtggtcacgtcgtcctcagccctccaccagggcccatccgtcttcccccgtggccaccctcctccaacgacgccacctcgtcgggggcacgagcctacgcccgtgggcctacgcctgggtccaaagggaccttaccttccaacgtactctaactcgtcggagccgggtctgggtaccagggccgacgacgtacgtncg

SEQ ID NO: 54249 - DNA, 607 bp, Homo sapiens
  misc_feature: GYAE6OF02H0P3N.29.78.H01.1.454.CMB.1.raw
  modified_base (605)..(605): a, c, t, g, unknown or other
  misc_feature (605)..(605): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaaatggagagcctgagactcgacgacacggccgtctattattgtgttaaaggcgagctggaatacgggaccggggcccgacttgaccacgtcggggccaggggacgcgtggtcaccgtctcctcacgccctccaccgaagggcccactcggtccttccccctcggcctaccctccctccaacgacgccaccctcgtcggggccacgacgccacgcccgtcggggcctcgccgtcggtaccgaaacgggacctaccgttaccgtacgttacctccttactcgttacggacggcgggtccgtcgggaccgaacgggccgacgtagtacgncg

SEQ ID NO: 54250 - DNA, 629 bp, Homo sapiens
  misc_feature: GYAE6OF02H2CW5.29.78.H01.1.454.CMB.1.raw
  modified_base (625)..(625): a, c, t, g, unknown or other
  misc_feature (625)..(625): n is a, c, g, or t
tcagatagagtactcacgaccggtgctcgatttagtgtgagtagtttgggtttgggggcgcctgggtacggccgggggggtcgctgagactctcctgtgcggcctctggattaagtttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggcccgtctattattgtagtttaaaggcgagctggaatacgggaccgggccgacttgaccactggggccaggggacgctggtcaccgtctcctcacgccctccaccaacgggcccacgtccggtcctttcccccctcgggcctaccccgtccttcccaagacgccaccctcgtcggggccacgagccgagccccgtagggcctacgcccgtcgggtaccgaaacgggacctaaccgtttacccaggttaccttaccgttacgtccttacgggtacggaccggggtccgttacgggccgaacggggcccgtacacgttacggntacg

SEQ ID NO: 54251 - DNA, 552 bp, Homo sapiens
  misc_feature: GYAE6OF02HKPRF.29.78.H01.1.454.CMB.1.raw
  modified_base (551)..(552): a, c, t, g, unknown or other
  misc_feature (551)..(552): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccggggcccgacttgaccacgtggggccagggggacgcgtggtcaccgtctcctcagcctccaccaggcccatcggtccttccccctggccaccctcctccaacgagcacctctcggggcacagcagcccgtgggctcgccgtcggtcaacggactacttccacgtactctacgtctgacgcggcgtggcgacggccgcagtacgnn

SEQ ID NO: 54252 - DNA, 560 bp, Homo sapiens
  misc_feature: GYAE6OF02GALHR.29.78.H01.1.454.CMB.1.raw
  modified_base (559)..(560): a, c, t, g, unknown or other
  misc_feature (559)..(560): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccgggcccgacttgaccactggggccaggggacgctggtcaccgtctcctcagcctccaccaacgggcccatccggtccttcccccctggccaccctccctccaacgacgccaccctcgtcgggggccacgacgcacgcccgtggggcctcggccgtggtcaacggactacttccagtactctactctgagccggctggcaacggcgcactagnn

SEQ ID NO: 54253 - DNA, 559 bp, Homo sapiens
  misc_feature: GYAE6OF02FJLYL.29.78.H01.1.454.CMB.1.raw
  modified_base (558)..(559): a, c, t, g, unknown or other
  misc_feature (558)..(559): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccggggcccgacttgaccacgtggggccaggggacgctggtcaccgtctcctcagcctccaccaacgggcccacgtccggtccttccccctcggccaccctccctcccaacgacgccacctctcggggcacgagcacgccctgggctcgccgtggtccaaggactaccttccagtactctactctgacggcgggtctcggcaggcgcagtagnn

SEQ ID NO: 54254 - DNA, 544 bp, Homo sapiens
  misc_feature: GYAE6OF02IPAGQ.29.78.H01.1.454.CMB.1.raw
  modified_base (485)..(485): a, c, t, g, unknown or other
  misc_feature (485)..(485): n is a, c, g, or t
  modified_base (537)..(537): a, c, t, g, unknown or other
  misc_feature (537)..(537): n is a, c, g, or t
  modified_base (543)..(543): a, c, t, g, unknown or other
  misc_feature (543)..(543): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccggggccgacgttgaccactgggggccaggggacgctggtcaccggtctcctcagcctccaccgaagggcccatccggtcttccccctggccaccctcctccaagacgcacctcgtcggggcacagcacgccctgggcncgccgtggtcaaggactactccacgtactctatctgagcggctggcacggcncgatgng

SEQ ID NO: 54255 - DNA, 620 bp, Homo sapiens
  misc_feature: GYAE6OF02HV9ZQ.29.78.H01.1.454.CMB.1.raw
tcagatagagtactcacgaccggtgctcgatttagtgtgagtagtttgggtttggggtctgagagaggagtccacccctgggatcttcaggtgttttcatttggtgatcaggacggaacagagagaactcaccatggagtttgggctgagctggctttttcttgtggctattttaaaaggtgtccagtgtgacgtgcagttggtggagtctgggggcgcctggggtacggccgggggggtcgctgagactctcctgtgcggctctggattaagtttaggagtcatgccatgaactgggtccgcaggctccagggaagggctgggagtgggtctcggctattagtggcaggtggtggcgctatatattatgcagaccgccctaggaagggcccgttcaccgtattttcccagacgactaattccgaaagaacacgctagtactctgacaaatggagacgcctagagaacctcggaacgaccgaccgggtcctactactttaagttggtaaggttaaaacgggccgtaagtcgtagggaacgtaaccgggggacccggggtcccgtaacgtttaccggacccgtacggtcgggggcccgaagggggccgccgtgggtacccg

SEQ ID NO: 54256 - DNA, 572 bp, Homo sapiens
  misc_feature: GYAE6OF02J159K.29.78.H01.1.454.CMB.1.raw
  modified_base (381)..(381): a, c, t, g, unknown or other
  misc_feature (381)..(381): n is a, c, g, or t
  modified_base (564)..(564): a, c, t, g, unknown or other
  misc_feature (564)..(564): n is a, c, g, or t
  modified_base (571)..(571): a, c, t, g, unknown or other
  misc_feature (571)..(571): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaataccgggaccggggccgacttgaccacgtggggccaggggacncgtggtcaccgtctcctcgacgcctccaccaacgggcccagtccggtccttcccccgtggcccaccctccctaccaacgacgccaccgtcgtcggggccacgagccacgcccgtcgggcgtcgccgtacgtcaacggtactacgtccacgtctctactcgtgacgcggctggacgaggccganacgtagnc

SEQ ID NO: 54257 - DNA, 533 bp, Homo sapiens
  misc_feature: GYAE6OF02FQ0MK.29.78.H01.1.454.CMB.1.raw
  modified_base (532)..(533): a, c, t, g, unknown or other
  misc_feature (532)..(533): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggtcggttcaccatttccagagacaattcgaagaacacgctgtatctgcaaatggagagcctgagactcgacgacacggccgtctattattgtgttaaaggcgagctggaatacgggaccggggcccgacttgaccactggggccaggggacgctggtcaccgtctcctcagcctccaccaagggcccatcgtcttccccctggcaccctcctccaacgacgcacctctcggggcacagcacgccctgggctgcctgtcaaggactactccagtactctatctgagcggctggcaaggcgcatagnn

SEQ ID NO: 54258 - DNA, 493 bp, Homo sapiens
  misc_feature: GYAE6OF02H5HMB.29.78.H01.1.454.CMB.1.raw
  modified_base (265)..(265): a, c, t, g, unknown or other
  misc_feature (265)..(265): n is a, c, g, or t
  modified_base (446)..(446): a, c, t, g, unknown or other
  misc_feature (446)..(446): n is a, c, g, or t
  modified_base (485)..(485): a, c, t, g, unknown or other
  misc_feature (485)..(485): n is a, c, g, or t
  modified_base (491)..(492): a, c, t, g, unknown or other
  misc_feature (491)..(492): n is a, c, g, or t
tcagatagagtactcacgaccggtgctcgatttagtgtgagtagtttgggtttggtggtctctctcccagcctgtgctgactcaatcgccctctgcctctgcctccctgggaggctcggtcaaggtcacctgtactctgagcagtggacacagcagctacgccatcgcttggcatcagcagaggccagacacgggccctcgttacttgatgacagtcaacaatgatggcagtcacagcaagggggacggatccctgatcgcttcncagtctccagctcgtgggcctgagcgctacctcacatctccggcctccagtctgagatgaggctgactattactgtcagaccgtggggcacgtggcattcgaggtcgttcggaccggggacaacggtcaccgtcgtcggtcacgcccaaggcccaacccgctcgtccactctcgttccccnccctcctcacgtctctactcgtgacgcggctggcaggcncatagnnc

SEQ ID NO: 54259 - DNA, 566 bp, Homo sapiens
  misc_feature: GYAE6OF02GFNN4.29.78.H01.1.454.CMB.1.raw
  modified_base (305)..(305): a, c, t, g, unknown or other
  misc_feature (305)..(305): n is a, c, g, or t
  modified_base (326)..(326): a, c, t, g, unknown or other
  misc_feature (326)..(326): n is a, c, g, or t
  modified_base (337)..(337): a, c, t, g, unknown or other
  misc_feature (337)..(337): n is a, c, g, or t
  modified_base (429)..(429): a, c, t, g, unknown or other
  misc_feature (429)..(429): n is a, c, g, or t
tcagatagagtactcacgaccggtgctcgatttagtgtgagtagtttggggtttggggagagctctggggagtctgcaccatggctcggaccccactcctcttcctcaccctcctcctccactgcacagggtctctctcccagcctgtgctgactcaatcgccctctgcctctgcctccctgggaggctcggtcaaggtcacctgtactctgagcagtggacacagcagctacgccatcgcttggcatcagcagaggccagacacgggccctgttactgatgacagtcaacatgatggcagtcanagcgaagggggacggatccgngactcgcttcncagtctcgagctcgtgggcctggacgccgtactaccctcgaactactccgtccggcctcgagtcctggagtatggagtctagacttattcgngtccacgtccgtgggactcgtcggactacgttcgacggtttccgtaccggggacccgggtaacctaacgggtccctaaccggttcggtaccgggtaccaaccgggtacccccgaaagggccccctaaacccgtccgg

SEQ ID NO: 54260 - DNA, 602 bp, Homo sapiens
  misc_feature: GYAE6OF02IMQDU.29.78.H01.1.454.CMB.1.raw
  modified_base (600)..(600): a, c, t, g, unknown or other
  misc_feature (600)..(600): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccggggcccgacttcgaccacgtggggccaggggacgctggtcaccgtctcctcagcctccaccgaacgggcccagtccggtccttcccccgtcggccaccctcctccaacgacgccacctccgtcggggccacgacgccacgcccgtcgggcctcggccgtcggtccaaacgggtacctaccgttaccacgttaccttacctacgtctcggacggtccggggtcgtcgggccgaacgggccgacgtacgtacgncg

SEQ ID NO: 54261 - DNA, 592 bp, Homo sapiens
  misc_feature: GYAE6OF02JU8GP.29.78.H01.1.454.CMB.1.raw
  modified_base (553)..(553): a, c, t, g, unknown or other
  misc_feature (553)..(553): n is a, c, g, or t
  modified_base (590)..(590): a, c, t, g, unknown or other
  misc_feature (590)..(590): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacggggaccgggccgacttgaccacgtggggccaggggacgcgtggtcaccgtctcctcacgcctccaccgaacgggcccatccggtccttccccccgtaggccctacccgtcctacccaacgacgccacccgtcgtcggggccacacgccacgcccgtcgggctcgccgtcggtcaacggtacctacttcgtaacgtactcgtactcgtacgnggccgggtctacggacgtaacggccgacgactacggntg

SEQ ID NO: 54262 - DNA, 634 bp, Homo sapiens
  misc_feature: GYAE6OF02F9GY9.29.78.H01.1.454.CMB.1.raw
  modified_base (334)..(334): a, c, t, g, unknown or other
  misc_feature (334)..(334): n is a, c, g, or t
tcagatagagtactcacgaccggtgctcgatttagtgtgagtagtttgggtttggggtccggagccatggtgcagactccccagagctctcctcctcctccactgcacagggtctctctcccagcctgtgctgtactcaatcgccctctgcctctgccttacccgtgggagctcggtcaaggtcacctgtactctggagcaggtggacacagcagctacggccatcgcttggcatcagcagcggccagacacgggccctgttactgactgacagtcaacgatcgatggcagtcgacgagacgaagggggacggtactcccgtgactcgtcttcncgtagtcctcagctcgcggcctgagccgctaccgtcaactactcctcgccctcgagtcagacgatcgaggtctagtaactattacgacgttcacggtaccggtcgggacctacgtcggactacgttccgaacgggttccgttaccgggaacccggggtaacctaacggggttacccgtaacccgggttcccgggttaccgggtacccgtaaccggggtaccccgtaaacgggtaccccgtaaccccccgttaggttacccggttaccctaccggtttacccgtccggtttacccccccgg

SEQ ID NO: 54263 - DNA, 575 bp, Homo sapiens
  misc_feature: GYAE6OF02I7IUA.29.78.H01.1.454.CMB.1.raw
  modified_base (350)..(350): a, c, t, g, unknown or other
  misc_feature (350)..(350): n is a, c, g, or t
tcagatagagtactcacgaccggtgctcgatttagtgtgagtagtttggggtttggggagagctctggggagtctgcaccatggctcggaccccactcctcttcctcaccctcctcctccactgcacagggtctctctcccagcctgtgctgactcaatcgccctctgcctctgccctccgtgggagctcggtcaaggtccactgtactctgagcaggtggacacagcagctacgccatcgcttggcatcagcagaggccaggacacgggcccttcgttactgatgactagtacaacaatgatggacagtacagaggacgaagggggacgactcccgtagactcgcttcncacgtctaccgagctcgcggtcctggacgccgtacctaccacactaatccgtccggccctcgacgttcgaggtacggtactggacggtctagtacttacttacgtcgtacgacggtaccgtgggactacgtcggtactacgttcgacggttccgtacggggtaaccggactacgggtcctaccggttcggtacggaccacgtacccgaacggtcccaacccgtcg

SEQ ID NO: 54264 - DNA, 589 bp, Homo sapiens
  misc_feature: GYAE6OF02F3PD2.29.78.H01.1.454.CMB.1.raw
  modified_base (586)..(586): a, c, t, g, unknown or other
  misc_feature (586)..(586): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctaggaatacgggaccgggcccacttgaccacgtggggccaggggacgctggtccaccgtctcctcagcctccaccgagggcccatccggtccttccccgtcggccaccctcctccaacgacgccacctcgtcggggccacacgccgacgcccgtgggccgtcgccgtcggtaccgaacggaccttaacgttccgagttacctactacgtcgtacgacggtccgggtctcgggacgaacgggccgacgactaggnacg

SEQ ID NO: 54265 - DNA, 573 bp, Homo sapiens
  misc_feature: GYAE6OF02GL755.29.78.H01.1.454.CMB.1.raw
tcagatagagtactcacgaccggtgctcgatttagtgtgagtagtttgggtttggggtctgagagaggagtccacccctgggatcttcaggtgttttcatttggtgatcaggacggaacagagagaactcaccatggagtttgggctgagctggctttttcttgtggctattttaaaaggtgtccagtgtgacgtgcagttggtggagtctgggggcgcctggggtacggccgggggggtcgctgagactctcctgtgcggcctctggattaagtttaggagtcatgccatgaactgggtccgccaggctccagggaaggggctggagtgggtctcggctattagtggcagtggtggcgctatatattatgcagacgcctgaagggccgttcaccatttccagagacaattcgaagaacacgctgtatctgacaaagtggagagcctagacgtacgtcgaacgacgacggccgtctattattgtagttaaaggcgagcgtaggaagtacgggggaccgggcccgacgttgacccgtacggtcggggaccgagggggaccgtcgtcggtacccg

SEQ ID NO: 54266 - DNA, 585 bp, Homo sapiens
  misc_feature: GYAE6OF02JWAQF.29.78.H01.1.454.CMB.1.raw
  modified_base (404)..(404): a, c, t, g, unknown or other
  misc_feature (404)..(404): n is a, c, g, or t
  modified_base (434)..(434): a, c, t, g, unknown or other
  misc_feature (434)..(434): n is a, c, g, or t
tcagatagagtactcacgaccggtgctcgatttagtgtgagtagtttggggtttggggtaggagctctggggagtctgcaccatggctcggaccccactcctcttcctcaccctcctcctccactcgcacagggtctctctcccagcctgtgctgactcaatcgccctctcgcctctcgcctcccgtgggacgctcggtcaaggtcacctgtactctgagcagtggacacagcagctacgccatcgcttggcagtcacgcagacggccaaggaccgaccgggcccttacgttactgagtcgacacgtcaacaatgatggcagtcacgagacggaagggggacgactccgtagactcgctttcagtactctaccagcttccgcgggccttagacgcgcctacctnacctaacgtccgtccgccttaccgagttcnggacgatcggacgtctacgtacttagtcctgtacacggacggtcgggacttagcggtactagttcgacgttccggtaccgggaaccgggtaactagggtcccgaccggttcggtacggtcgaccggtacccgacggtaccccaaccgtcgg

SEQ ID NO: 54267 - DNA, 536 bp, Homo sapiens
  misc_feature: GYAE6OF02IG1OL.29.78.H01.1.454.CMB.1.raw
  modified_base (329)..(329): a, c, t, g, unknown or other
  misc_feature (329)..(329): n is a, c, g, or t
  modified_base (534)..(534): a, c, t, g, unknown or other
  misc_feature (534)..(534): n is a, c, g, or t
tcagatagagtactcacgaccggtgctcgatttagtgtgagtagtttgggtttggtggtctctctcccagcctgtgctgactcaatcgccctctgcctctgcctccctgggaggctcggtcaaggtcacctgtactctgagcagtggacacagcagctacgccatcgcttggcatcagcagaggccagacacgggccctcgttacttgatgacagtcaacaatgatggcagtcacagcgaaaggggggacggatcccctgactcgctttctcagtctccagcctcgtgggcctgagcgctacctcacatcctccggcctcagtctgagntggagctgacttattacgtgtcagtaccgtggggacacgtggactatttcgaggttccgttaccgggaccggggacaaggtccaccggttcggtcggtcacgcccaaggcccaacccatcgtccacttcgtccgttaccccaccctcctacacgttacctctatccgtaggacggccgggactcggacacggcgaccatacgcancg

SEQ ID NO: 54268 - DNA, 614 bp, Homo sapiens
  misc_feature: GYAE6OF02I2PKY.29.78.H01.1.454.CMB.1.raw
  modified_base (319)..(319): a, c, t, g, unknown or other
  misc_feature (319)..(319): n is a, c, g, or t
tcagatagagtactcacgaccggtgctcgatttagtgtgagtagtttgggtttggggtccgagccatggtgcagactccccagagctctcctcctcctccactgcacagggtctctctcccagcctgtgctgactcaatcgccctctgcctctgcctccctgggaggctcggtcaaggtcacctgtactctgagcagtggacacagcagctacgccatcgcttggcatcagcagagccagacacgggccctcgttacttgatgacagtcaacaatgatggcagtcacagcgaagggggacggatcccgtgatcgcttcncagtctccagcctcgtgggcctgacgcgctacctcacaactcctcccggcctccgagttcctggagagtcggacggtctaggtaacttagttactggtaccacggtaccggtcgggggcctaacgtcgggtacctacgtttaccggtacgggttcccgttaccgggggaaccggggaaccctaacggggttccccgaccgggttccgggttccgggtaccaacccggacccgtaaccgggccccctaaacccgtacgttccggtacctacccgttcccggttcccgttaaccccc

SEQ ID NO: 54269 - DNA, 587 bp, Homo sapiens
  misc_feature: GYAE6OF02JT27O.29.78.H01.1.454.CMB.1.raw
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccgttcaccatttccagagacaattcgaagaacacgctgtatctgcaaatggagagcctgagactcgaacgacacggccgtctattattgtagttaaaggcgagctaggaatacgggaccggggccacgttgaccacgtcggggaccaggggacgcgtggtcaccgtctcctcagccctccaccgaacgggcccactccggtccttcccccgtcggccaccctcctaccaacgacgccacccgtcgtcggggcaccacgccacgcccgtcggcgtcgccgtcggtacaacggtactaccttaccgacgtactctacgtctcgacggccggtcgtcggacgaacggccgcgagtagatg

SEQ ID NO: 54270 - DNA, 575 bp, Homo sapiens
  misc_feature: GYAE6OF02H6O2D.29.78.H01.1.454.CMB.1.raw
  modified_base (382)..(382): a, c, t, g, unknown or other
  misc_feature (382)..(382): n is a, c, g, or t
  modified_base (574)..(574): a, c, t, g, unknown or other
  misc_feature (574)..(574): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggcccgtctattattgtgttaaaggcgagctggaatacggggaccgggcccgacttgaccacgtggggccaggggacncgtggtcaccgtctcctcacgccctccaaccgaacgggcccaacgtccggttcccttcccccgtcggccaccctccctacccaacgacgccaccctcgtcgggggccacgacgcacgcccgtcgggctcgcctcggtacaacggactacttccagtacctctatctgcggcggctggcgaaggccgcatagnc

SEQ ID NO: 54271 - DNA, 564 bp, Homo sapiens
  misc_feature: GYAE6OF02HQ4N5.29.78.H01.1.454.CMB.1.raw
  modified_base (395)..(395): a, c, t, g, unknown or other
  misc_feature (395)..(395): n is a, c, g, or t
tcagatagagtactcacgaccggtgctcgatttagtgtgagtagtttgggtttggagtctgcaccatggctcggaccccactcctcttcctcaccctcctcctccactgcacagggtctctctcccagcctgtgctgactcaatcgccctctgcctctgcctccctgggaggctcggtcaaggtcacctgtactctgagcagtggacacagcagctacgccatcgcttggcatcagcagaggccagacacgggccctcgttacttgatgacagtcaacaatgatggcagtcacagcgaagggggacggatccctgatcgtcttctcagtctccagtctcgtgggcctggacgccgtcctacctcaactactccgtccggcctccgagtctgaggntgagctagactattactgtacaggtccgtgggcctacgtggactacgttcgacgggttccgttaccggggaaccgggtaccgtacggttccgaccggttccggtccggtacgaccggacccgaacggaccccaacccgtacgttccgtacctaccgttccgttaccccg

SEQ ID NO: 54272 - DNA, 693 bp, Homo sapiens
  misc_feature: GYAE6OF02HPDIM.29.78.H01.1.454.CMB.1.raw
  modified_base (225)..(225): a, c, t, g, unknown or other
  misc_feature (225)..(225): n is a, c, g, or t
tcagatagagtactcacgaccggtgctcgatttagtgtgagtagtttggggtttgggggtccgagccatggtcgcagaacctccccagagctcctcctcctcctaccacctgcacagggtcctctctcccagcctgtgctggactcaactcgtcccttcgtggcctctgcctccctggggaggctccggtcaacggtcacctgtactctggagcagtggacgacngcagactacgccagtcgcttggcatcagcagacggcctagacgacggcctcgttactgatgacagtcaacgaagtgatggcacgtcacgaggcgaagggggacggtatccgtggatcgcttcacagtctcgagctactagggcctgacgcgactaccgtacgaacgtaacgtccgtcccggacctaccgaggtccgtagggaacggtacgtcggaacggtctaggtaaccttacgttacctcggtaccaaggtacccggtgggggcctacggtacgggcctaagttccggaagggttcccggttaccgggaacccgggggtaaccctaacggggttacccggtaacccgggtttacgggttaccgggttaccgtaaccgggtaaccccgaacggggtacccccgtaaacccccggtggtacccggttaacccgtaacccgttttcccgttacggttttacccccccgg

SEQ ID NO: 54273 - DNA, 568 bp, Homo sapiens
  misc_feature: GYAE6OF02IRNHO.29.78.H01.1.454.CMB.1.raw
  modified_base (332)..(332): a, c, t, g, unknown or other
  misc_feature (332)..(332): n is a, c, g, or t
  modified_base (455)..(455): a, c, t, g, unknown or other
  misc_feature (455)..(455): n is a, c, g, or t
tcagatagagtactcacgaccggtgctcgatttagtgtgagtagtttggggtttggggagagctctggggagtctgcaccatggctcggaccccactcctcttcctcaccctcctcctccactgcacagggtctctctcccagcctgtgctgactcaatcgccctctgcctctgcctccctgggaggctcggtcaaggtcacctgtactctgagcagtggacacagcagctacgccatcgcttggcatcagcagacggccagacgacgggccctcgttacttgatgacagtcaacaatgatggcagtcacgagcgaagggggacgatcccgngactcgcttctcagtctacgagctcgtcgggcctggacgcgtcctacctcaactactccgtccggcctcacgtctggaggatggagtctagacttattacgtgtacacggtaccgtgggaccncgtggctagttcgacgggttccgttaccggggaaccgggtaaccgaacgggtcccgtacccggttcggtaccggtaccaccgggacccccgaacgggtacccccaacccgtcg

SEQ ID NO: 54274 - DNA, 587 bp, Homo sapiens
  misc_feature: GYAE6OF02JBKA2.29.78.H01.1.454.CMB.1.raw
  modified_base (585)..(585): a, c, t, g, unknown or other
  misc_feature (585)..(585): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgacaaatggagagcctgagactcgacgacacggccgtctattattgtagttaaaggcgagctaggaatacggggaccgggcccgacgttcgaccacgtgggggaccagggggacgcgtcggtcaccgtctccgtcacgccctccaccgaacggcccactcggtccttccccgtcggccaccctcctaccaacgacgccaccgtcgtcggggccacgacgcgacgccgtcggcctcgccgtcggtacaacggtactaccttcacgtactactacgtcgtcgaggccggtcgtggacgacggcgactagacgncg

SEQ ID NO: 54275 - DNA, 626 bp, Homo sapiens
  misc_feature: GYAE6OF02IEWTV.29.78.H01.1.454.CMB.1.raw
  modified_base (394)..(394): a, c, t, g, unknown or other
  misc_feature (394)..(394): n is a, c, g, or t
  modified_base (412)..(412): a, c, t, g, unknown or other
  misc_feature (412)..(412): n is a, c, g, or t
  modified_base (623)..(623): a, c, t, g, unknown or other
  misc_feature (623)..(623): n is a, c, g, or t
tcagatagagtactcacgaccggtgctcgatttagtgtgagtagtttgggtttgggggcggccgtgggtacggccgggggggtcgctgagactctcctgtgcggcctctggattaagttttaggagtcactgccatgaactgggtccgccaggctccagggaaggggctggagtgggtctcggctattagtggcagtggtggcgctatatattatgcagacgccctgaagggccggttcacatttccagagacaattcgaagaacacgctgtatctgacaaatggagagcctgagactacgacgacacggcctcttaattatgtagttaaaggcgagctggaaagtaccgggacccggggcccgagttcgaacctacgtcggggccgaggggcncgtggtccaccgtctccncacgccctaccaccgaacgggcccagtccggtccttcccccgtcggccacccgtcctaccgaacggacgccgaacccgtcgtacggggacctacgacgaccgacgcccgttagggcctcggtcccgtacggttaccgaacggtacttaccgttccgacgtacctcgtacgtcgtaggcggcggtcgacggtacgacggccgacgagtacgntcg

SEQ ID NO: 54276 - DNA, 585 bp, Homo sapiens
  misc_feature: GYAE6OF02G5UE8.29.78.H01.1.454.CMB.1.raw
  modified_base (585)..(585): a, c, t, g, unknown or other
  misc_feature (585)..(585): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacggggaccggggcccgacttgacccactgggggcccaggggaccgcgtggtcaccggtctcctcagccctccaccaacgggcccacgtcgtccttccccctggccaccctcctccaacgacgccacctcgtcggggcacgacgccacgcccgtgggccgtcgtccctcgggtcaacgggtacctaacgttccacgttacctcttactccgtagacggcgggctcggcgaacgggccgacagtacgn

SEQ ID NO: 54277 - DNA, 543 bp, Homo sapiens
  misc_feature: GYAE6OF02HU293.29.78.H01.1.454.CMB.1.raw
  modified_base (395)..(395): a, c, t, g, unknown or other
  misc_feature (395)..(395): n is a, c, g, or t
  modified_base (542)..(543): a, c, t, g, unknown or other
  misc_feature (542)..(543): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaaatggagagcctgagactcgacgacacggccgtctattattgtgttaaagcgagctggaatacgggaccggggcccgattgaccactggggccaggggacgctggtcaccgtctccncagccctccaccgaaggcccatcggtcttccccctggccaccctcctccaacgacgccacctcgtcggggcacagcagcccgtggctgcctggtcaaggactacttccagtactctatctgagcgggctggcaaggccgacagtagnn

SEQ ID NO: 54278 - DNA, 485 bp, Homo sapiens
  misc_feature: GYAE6OF02GHVL7.29.78.H01.1.454.CMB.1.raw
  modified_base (340)..(340): a, c, t, g, unknown or other
  misc_feature (340)..(340): n is a, c, g, or t
  modified_base (418)..(418): a, c, t, g, unknown or other
  misc_feature (418)..(418): n is a, c, g, or t
  modified_base (437)..(437): a, c, t, g, unknown or other
  misc_feature (437)..(437): n is a, c, g, or t
  modified_base (476)..(476): a, c, t, g, unknown or other
  misc_feature (476)..(476): n is a, c, g, or t
  modified_base (483)..(485): a, c, t, g, unknown or other
  misc_feature (483)..(485): n is a, c, g, or t
tcagatagagtactcacgaccggtgctcgatttagtgtgagtagtttgggtttggtggtctctctcccagcctgtgctgactcaatcgccctctgcctctgcctccctgggaggctcggtcaaggtcacctgtactctgagcagtggacacagcagctacgccatcgcttggcatcagcagaggccagacacgggccctcgttacttgatgacagtcaacaatgatggcagtcacagcgaagggggacggatccctgatcgcttctcagtctccagctctgggcctgagcgctacctcacaatctccggcctccagtctgaggatgagctgactattacngtcagacctgggcacgtgctattcaggtcttcgggaccgggacaaggtcaccgtcgtcgcagcccaaggcccaacccnctcgtcactctcgttcccnccctctcacgtactctatctgagccgggctcggcaggcncatacgnnn

SEQ ID NO: 54279 - DNA, 650 bp, Homo sapiens
  misc_feature: GYAE6OF02H6ZZQ.29.78.H01.1.454.CMB.1.raw
  modified_base (266)..(266): a, c, t, g, unknown or other
  misc_feature (266)..(266): n is a, c, g, or t
tcagatagagtactcacgaccggtgctcgatttagtgtgagtagtttgggtttggtggtctctctccagcctgtgctgactcaatcgccctctgcctctcgccctccctgggaggctcggtcaaggtcacctgtactctgagcagtggacacagcagctacgcatcgctggcatcagcagacggccagacacgggcctcgttactgatgacagtcaaacatgatggcagtcacaggcgaagggggacggtatcctgactcgcttcncagtcctcagtctcgtcgggctgacgcgacctacctcaactaatccgtcccggccttcgagttccgaggtagactggaacggcttgacttagttaaccgtgtaccgaacggaccgttggggggacctacggtcggtacgtacgttcgaacgggttccggttaccggggaacccgggggtaaccgtaaacgggtccgacccgggttaccggttccggacgacccggtacccgaacggaccccgaacccctaccggtcgtacctaccgtccgttacccgttccccgacccgttccgtacctaccggttaccacccttacgttccgaacggttaccgggccggtccgttacgggacgtaccgggcggtaccgtaggtacgctacgcg

SEQ ID NO: 54280 - DNA, 622 bp, Homo sapiens
  misc_feature: GYAE6OF02H7JED.29.78.H01.1.454.CMB.1.raw
  modified_base (618)..(618): a, c, t, g, unknown or other
  misc_feature (618)..(618): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtagttaaaggcgagctaggaatacgggaccggggccgacgttcgaccgacgtcgggggaccagggggacgcgtggtcaccgtctcctcgacgccctcaccgaacgggcccacgtccggtccttcccccgtcggccaccctccctaccaagacgccacctcgtcggggccacgacgcacgcccgtgggcctcggccgtcgggtaccgaacggtaccttaacgttcccgagttacccttacttacgtccgttaggacgggccgggtcgtacgggaccgaacgggccggtacgagttacggntacg

SEQ ID NO: 54281 - DNA, 539 bp, Homo sapiens
  misc_feature: GYAE6OF02IA7IJ.29.78.H01.1.454.CMB.1.raw
  modified_base (318)..(318): a, c, t, g, unknown or other
  misc_feature (318)..(318): n is a, c, g, or t
  modified_base (502)..(502): a, c, t, g, unknown or other
  misc_feature (502)..(502): n is a, c, g, or t
  modified_base (506)..(506): a, c, t, g, unknown or other
  misc_feature (506)..(506): n is a, c, g, or t
  modified_base (537)..(537): a, c, t, g, unknown or other
  misc_feature (537)..(537): n is a, c, g, or t
  modified_base (539)..(539): a, c, t, g, unknown or other
  misc_feature (539)..(539): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgccaggctccagggaagggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattatgtnttaaagcagctggaatacgggaccgggccacttgaccactggggccaggggacgctggtcaccgtctcctcagcctccaaccaagggccatcggtcttcccctggcaccctctccaagacgcacctcgtcggggcacagcagcccgtggctcgcctggtcaaggacctacgttccagttacctntacncttgacgcgggctggcaacggcgaccatagngn

SEQ ID NO: 54282 - DNA, 583 bp, Homo sapiens
  misc_feature: GYAE6OF02ITPGQ.29.78.H01.1.454.CMB.1.raw
  modified_base (248)..(248): a, c, t, g, unknown or other
  misc_feature (248)..(248): n is a, c, g, or t
  modified_base (439)..(439): a, c, t, g, unknown or other
  misc_feature (439)..(439): n is a, c, g, or t
  modified_base (453)..(453): a, c, t, g, unknown or other
  misc_feature (453)..(453): n is a, c, g, or t
tcagatagagtactcacgaccggtgctcgatttagtgtgagtagtttgggtttggggggaagaggaagactgacggtccacccctgggatcttcaggtgttttcatttggtgatcaggacggaacagagagaactcaccatggagtttgggctgagctggctttttcttgtggctattttaaaaggtgtccagtgtgacgtgcagttggtggagtctgggggcgcctgggtacgggccgggggggtcnctgagactctcctgtgcggcctctggattaagtttaggagtcatgccatgaactgggtccgcaggctccgagggaaggggctggagtgggtctcggctattagtggcagtggtggcgctatatatatgcagacgccctgaacgggccgttcacatttccgagagacaattacgaaagaacacgctgtactntagcaaagtggagngacctgagacgtcgacgacgacggcgtctattagttgtagttaaaggcgagcgtaggaacgtaacggggacccgggtcccgacgttcgaaccgtacgtcggggccgagggggaccgtacggtcggtaccg

SEQ ID NO: 54283 - DNA, 704 bp, Homo sapiens
  misc_feature: GYAE6OF02IGPJ8.29.78.H01.1.454.CMB.1.raw
  modified_base (217)..(217): a, c, t, g, unknown or other
  misc_feature (217)..(217): n is a, c, g, or t
  modified_base (240)..(240): a, c, t, g, unknown or other
  misc_feature (240)..(240): n is a, c, g, or t
tcagatagagtactcacgaccggtgctcgatttagtgtgagtagtttgggtttggggtctgagagaggagtccacccctgggatcttcaggtgttttcatttggtgatcaggacggaacagagagaactcaccatggagtttgggctgagcgtgtgtttctaggtggctaatttaaaaggtgtcagtgtgacgtgcagttggtggagtctgggggcncctgggtacggccgggggggtcnctgagactctcctgtgcggcctctggattaagtttaggagtcatgccatgaactgggtccgccaggctccgaggggaacggggctgggagtgggtctcgggcttagttaggtggcaggttggtggcgctatatattatgacagacgtcctaggaacggggtcccgttacaccgtatttacccgaagtacgaacctaaagtttaccggaaaacgaaaccgaaccggtccgttaggttaacttaccgttgtaacccgtaaaaagttggggaagaacggtacccgttgggaacggtaacctaccgggaaccgaacccgaccgggtaccccgttagtttaatttaagtttggttaaggtttaaaacgggccgtaagtccgtaagggaacggttaccgggggacccgggtacccgtaacgttcgaaccgtacggtcgggggacccgtaggggacctcggtggtaccccg

SEQ ID NO: 54284 - DNA, 628 bp, Homo sapiens
  misc_feature: GYAE6OF02I0AG0.29.78.H01.1.454.CMB.1.raw
tcagatagagtactcacgaccggtgctcgatttagtgtgagtagtttgggtttggggtctgagagaggagtccacccctgggatcttcaggtgttttcatttggtgatcaggacggaacagagagaactcaccatggagtttgggctgagctggctttttcttgtggctattttaaaaggtgtccagtgtgacgtgcagttggtggagtcgtgggggcgccgtgggtacggccgggggggtcgctgagactctcctgtgcggcctctggattaagttttaggagtcatgccatgaactgggtcccgccaggctccgagggaaggggctgggagtgggtctcggctagttagtggcagtggtggcgctatatattatgcagaccgccctggaacgggtccgttcacctatttcccagacgacaattcgaaagaaccacgctgtatctagacaaagtgggaagacgcctaggacgaccgtccgaaccggaccaccgggtcctcttaatttagtttaggtacggttaaaagggcgtaagtcgttagggaacgtaccgggggaacccggggtcccgtaacgttcgaacccgtacggtcgggggacccgagggggaccgtccggtggtacccg

SEQ ID NO: 54285 - DNA, 545 bp, Homo sapiens
  misc_feature: GYAE6OF02FUYWS.29.78.H01.1.454.CMB.1.raw
  modified_base (283)..(283): a, c, t, g, unknown or other
  misc_feature (283)..(283): n is a, c, g, or t
  modified_base (544)..(545): a, c, t, g, unknown or other
  misc_feature (544)..(545): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccgttcaccatttccagagacaattcgaagaacacgctgtatctgcaaatgganagcctgagactcgacgacacggccgtctatattgtgttaaaggcgagctggaatacgggaccggggcccgacttgaccactgggggccagggggacgcgtggtcaccggtctcctcagccctccaccaagggcccatcggtctccccctggccaccctcctcccaacgacgcacctctgggggccacgagcagccctgggctcgcctggtcaaggactacttccagttactctatctgcgcgggctggcagggcgcatagnn

SEQ ID NO: 54286 - DNA, 574 bp, Homo sapiens
  misc_feature: GYAE6OF02HVA1X.29.78.H01.1.454.CMB.1.raw
  modified_base (382)..(382): a, c, t, g, unknown or other
  misc_feature (382)..(382): n is a, c, g, or t
  modified_base (438)..(438): a, c, t, g, unknown or other
  misc_feature (438)..(438): n is a, c, g, or t
  modified_base (572)..(572): a, c, t, g, unknown or other
  misc_feature (572)..(572): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaaatggagagcctgagactcgacgacacggccgtctattattgtgttaaaggcgagctggaataccgggaccggggcccacttggaccacgtggggccaggggacnctggtcaccgtctcctcagcctcaccgaaggcccatcggtccttccccctcggccnccctccctccaacgacgaccacctcgtcgggggccacgacgccacgcccgtgggcctcgccgtcggtacaacggtacctacgttccacgttacctctactctcggacgcgggctggacgaacggccgacagtgncg

SEQ ID NO: 54287 - DNA, 544 bp, Homo sapiens
  misc_feature: GYAE6OF02GCSIK.29.78.H01.1.454.CMB.1.raw
  modified_base (544)..(544): a, c, t, g, unknown or other
  misc_feature (544)..(544): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactggttccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaataccggggaccggggccgacttgaccacgtggggccagggggacgcgtggtcaccgtctcctcagcctccaccaagggcccatcggtcttccccctcggccaccctcctccaacgacgcacctctggggcacgagcacgcccgtgggctgccgtggtcaaggctacttccagtactctatctgacgcgggctggcaggcgcatagn

SEQ ID NO: 54288 - DNA, 660 bp, Homo sapiens
  misc_feature: GYAE6OF02ITTQO.29.78.H01.1.454.CMB.1.raw
  modified_base (307)..(307): a, c, t, g, unknown or other
  misc_feature (307)..(307): n is a, c, g, or t
  modified_base (347)..(347): a, c, t, g, unknown or other
  misc_feature (347)..(347): n is a, c, g, or t
  modified_base (410)..(410): a, c, t, g, unknown or other
  misc_feature (410)..(410): n is a, c, g, or t
tcagatagagtactcacgaccggtgctcgatttagtgtgagtagtttggggtttggggagagctctggggagtctgcaccatggctcggaccccactcctcttcctcaccctcctcctccactgcacagggtctctctcccagcctgtgctgactcaatcgccctctcgcctctcgcctcccgtggggacggctcggtacaaggtccaccgtgtacctctgagcaggtggacacagcagctacgccatcgctggcatcagcagacggccaggaccgacgggccctcgttacttgatgacagtacaanatgatggacagtacacgaggcggaagggggcggatcccgngacgtcgtctctacgacgttcctcagtctaccgtggggccctaggacgtccgtaccttacccnctaaccgtaacgttcccgtacccggtcccttaccgacggttccgtaggacggtactacgggtacgccgttacggtaaccttacgttacgtacgggtacaccgggtaccggttacggggcctaacgtcgggaaccttagttaccggtacgttccggtttaacccggggaaccggggaacctacggggtccctaccgggttccggtacggtcccgaaacggtaccccgaaccggtccccgtaacccctacgg

SEQ ID NO: 54289 - DNA, 604 bp, Homo sapiens
  misc_feature: GYAE6OF02H3YNW.29.78.H01.1.454.CMB.1.raw
tcagatagagtactcacgaccggtgctcgatttagtgtgagtagtttgggtttgggggcgcctggggtacggccgggggggtcgctgagactctcctgtgcggcctctggattaagtttaggacgtcatgccatggaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctacttattgtgttaaaggcgagctggaatacgggaccgggccacgttgaccacgtggggccaggggacgcgtggtcaccgtctcctcacggcctccgaaccaagggccctactccggtccttcccccgtcgggcctaccctccctccaacgacgccaacccgttcgtcgggggcctacgacgccaacgccccgtgggcctcgcccgttggtaccaacgggtacctaccgttccaacgttaccttctacgtcgtcgacggcgggtcgtggcgtaagggccgacgatagatcg

SEQ ID NO: 54290 - DNA, 642 bp, Homo sapiens
  misc_feature: GYAE6OF02GUTYJ.29.78.H01.1.454.CMB.1.raw
tcagatagagtactcacgaccggtgctcgatttagtgtgagtagtttgggtttggtggtctctctcccagcctgtgctgactcaatcgccctctgcctctgcctccctgggaggctcggtcaaggtcacctgtactctgagcagtggacacagcagctacgccatcgcttggcatcagcagaggccagacacgggccctcgttacttgatgacagtcaacaatgatggcagtcacagcgaaggggggacggatcccgtgatcgcttctcacgtctccagctcgtgggcctggacgccgctacctcacactcctccggcctcagtcagaggatggacggctcgacttattacgtgtacgagtccgtggggacctacgtcggactacgtttcgacgggttccgttaccgggggaaccggggacctaacgggttccgtaaccgggttccggtaccgggtaccgtaacccggaccccgtaaacgggaccccaaaccccgtacgttccggtaccctaccgttcccttcccgggtttcccccacccgtttccctaccgtacgttaccctaccgttacgtccggttcgggaccggtccggggtacgtaccgggaccgaacggggtccgtacgtacggtaacggctagcg

SEQ ID NO: 54291 - DNA, 686 bp, Homo sapiens
  misc_feature: GYAE6OF02H87MB.29.78.H01.1.454.CMB.1.raw
  modified_base (683)..(683): a, c, t, g, unknown or other
  misc_feature (683)..(683): n is a, c, g, or t
  modified_base (685)..(686): a, c, t, g, unknown or other
  misc_feature (685)..(686): n is a, c, g, or t
tcagatagagtactcacgaccggtgctcgatttagtgtgagtagtttgggtttggtggtctctctcccagcctgtgctgactcaatcgccctctgcctctgcctccctgggaggctcggtcaaggtcacctgtactctgagcagtggacacagcagctacgccatcgcttggcatcagcgagacggccagacgaccgggccttacgttacttgatcgactagtacaaacaatgatacggacacgtacaacgaggaacgggaacggggggacggtactccgtagactccgtacttctactacgtcctcgacgtcgtcggtcgggcctggacgccgtacctaccctacaactaacgtcccgtcccggtcctaccgtacggtacgtacgggtaaggtcgtacggtacggtacttacgtaactttacgttaacgtcgtaccgacggtaccgggtcggggacctacggtcggtacttacgttcggtacgggttccggttaccggggaacccgggtaacgtaacgggtccgtaccgggttaccggttaccggacgacccgtaccgaaccggaccccaaccgttcgtaccgtacctaccgttcgttacccgtcccctacccttactaccgttactacctacgttacgtcgacggacggtccggtcgtacggacggacgcgactagtacgntnn

SEQ ID NO: 54292 - DNA, 854 bp, Homo sapiens
  misc_feature: GYAE6OF02HUSDM.29.78.H01.1.454.CMB.1.raw
  modified_base (111)..(111): a, c, t, g, unknown or other
  misc_feature (111)..(111): n is a, c, g, or t
tcagatagagtactcacgaccggtgctcgatttagtgtgagtagtttgggtttgggtccgagccatggtgcagactccccagagctctcctcctcctccactgcacaggtntctctcctccacgcctgtgctagacctacaacgtcccgcccctcgtccgtcccttcgtccgtccccttcccggtggggacggtccgttcggtacgtaacggtccctaccgttacgtacctcgtgacgacgtaggtcggaacacagacgacgtaccgtaccgcctagtccgtcgttcggactactacgagaccgaaggaccggaccgaacgaaccggacccgggtcccctttaccgtttacgttagacgttacggaaccgtaacgtaaccaaaactaaagttagtacggttgggacctacgtaccgaacgaacgggaacggggaaaccggggggtaacggtaccctttacccgaggtaaccgtccgttccctttacctaccgtaacggtttccctaccgacgtccgttccggtcgggtcccgtagaccggtcccgtacccttaccctaccaacctaacgtttcccgcccggtccccttacgacgttcgtaaggtaacgtgtgggaacgtcttaaccggtaacttaaccgttttagtcgtaccgaaccgggttacccggttggggaccctacggaccgttacgttaaccgttcggttaccgggttacccgggtaacccgggaacccgggtaaccttacgggttccccgttacgggttcccggttaccgacccgaccggtaaaccccgaccccggtacccctaacccggttaagtcccttacccgtaccgttccctttacccccgg

SEQ ID NO: 54293 - DNA, 550 bp, Homo sapiens
  misc_feature: GYAE6OF02GJBB6.29.78.H01.1.454.CMB.1.raw
  modified_base (549)..(549): a, c, t, g, unknown or other
  misc_feature (549)..(549): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattatgtgttaaaggcgagctggaatacgggaccgggcccgacttgaccactggggccaggggacgctggtcaccgtctcctcagcctccaccaaggcccatcgtcttccccctcggccaccctcctccaacgacgccacctcgtcgggggccacgacgcgacgcccgtagggctcgcctcggtcaaggactacttccagtactctatctgagccgggctcggcgaggcgacatagnc

SEQ ID NO: 54294 - DNA, 550 bp, Homo sapiens
  misc_feature: GYAE6OF02GUKY5.29.78.H01.1.454.CMB.1.raw
  modified_base (529)..(529): a, c, t, g, unknown or other
  misc_feature (529)..(529): n is a, c, g, or t
  modified_base (549)..(550): a, c, t, g, unknown or other
  misc_feature (549)..(550): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccggggcccgacttgaccactgggggccaggggacgcgtggtcaccggtctcctcacgccctccaccgaacgggcccatccggtccttccccctggccaccctcctccaacgacgccacctcgtcggggcacagcacgccctgggctcgccgtggtcaacggactactccagtactctatctgngcggctggcaggcgcatagnn

SEQ ID NO: 54295 - DNA, 575 bp, Homo sapiens
  misc_feature: GYAE6OF02G45XQ.29.78.H01.1.454.CMB.1.raw
  modified_base (573)..(574): a, c, t, g, unknown or other
  misc_feature (573)..(574): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccgttcaccatttccagagacaattcgaagaacacgctgtatctgcaaaatggagagcctgagactcgacgacacggccgtctattatgtgttaaaggcgagctggaatacgggaccgggcccgattgaccacgtggggccaggggacgctggcaccgtctcctcagccctcaccgaacggcccatccggtccttcccccgtcggccaccctcctccaacgacgaccacctcgtcggggccacgacgcgacgcccgtcggccgtcgcccgtcggtacgaacggaccttaaccgttccacgttactcttactctcgacgcggtctggacacgggccgacgatagnng

SEQ ID NO: 54296 - DNA, 579 bp, Homo sapiens
  misc_feature: GYAE6OF02HMZJE.29.78.H01.1.454.CMB.1.raw
  modified_base (577)..(578): a, c, t, g, unknown or other
  misc_feature (577)..(578): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaaatggagagcctgagactcgacgacacggccgtctattattgtgttaaaggcgagctaggaatacggggaccgggcccgattcgaccacgtggggccaggggacgcgtggcaccgtctcctcacgcctccaccgaacgggcccacgtcggtccttccccctcggccaccctcctccaacgacgccaccctcgtcggggcacgacgcacgcccgtcgggccgtcgcccgtcggtacaacggaccttacgtccagtacctcctagtctgacggcgggcgtcggacgacggcgacgactagnng

SEQ ID NO: 54297 - DNA, 634 bp, Homo sapiens
  misc_feature: GYAE6OF02GKSYL.29.78.H01.1.454.CMB.1.raw
  modified_base (440)..(440): a, c, t, g, unknown or other
  misc_feature (440)..(440): n is a, c, g, or t
  modified_base (454)..(454): a, c, t, g, unknown or other
  misc_feature (454)..(454): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtagttaaaggcgagctggaatacgggaccgggcccgacttgaccacgtggggccagggggacgcgtggtccaccgtctcctcacgcctccaccgaggcccatccggtcttcccccgtgccnccctcctccagacnccacctcgtcggggccacgacgcacgcccgtcgggcctcggcccgttcgggtaccgaaacggtaccttaacccgttcccgtaacggttaccttaccgttaacgttccttacgggtaaccgggtccggggtacccgttacggggaccaacgggggcccgtaccgtaacggttacggactcg

SEQ ID NO: 54298 - DNA, 612 bp, Homo sapiens
  misc_feature: GYAE6OF02GX094.29.78.H01.1.454.CMB.1.raw
  modified_base (172)..(180): a, c, t, g, unknown or other
  misc_feature (172)..(180): n is a, c, g, or t
  modified_base (184)..(184): a, c, t, g, unknown or other
  misc_feature (184)..(184): n is a, c, g, or t
  modified_base (186)..(188): a, c, t, g, unknown or other
  misc_feature (186)..(188): n is a, c, g, or t
  modified_base (191)..(191): a, c, t, g, unknown or other
  misc_feature (191)..(191): n is a, c, g, or t
  modified_base (193)..(193): a, c, t, g, unknown or other
  misc_feature (193)..(193): n is a, c, g, or t
  modified_base (201)..(203): a, c, t, g, unknown or other
  misc_feature (201)..(203): n is a, c, g, or t
  modified_base (205)..(207): a, c, t, g, unknown or other
  misc_feature (205)..(207): n is a, c, g, or t
  modified_base (209)..(209): a, c, t, g, unknown or other
  misc_feature (209)..(209): n is a, c, g, or t
  modified_base (211)..(211): a, c, t, g, unknown or other
  misc_feature (211)..(211): n is a, c, g, or t
  modified_base (215)..(216): a, c, t, g, unknown or other
  misc_feature (215)..(216): n is a, c, g, or t
  modified_base (218)..(218): a, c, t, g, unknown or other
  misc_feature (218)..(218): n is a, c, g, or t
  modified_base (228)..(228): a, c, t, g, unknown or other
  misc_feature (228)..(228): n is a, c, g, or t
  modified_base (243)..(243): a, c, t, g, unknown or other
  misc_feature (243)..(243): n is a, c, g, or t
tcagatagagtactcacgaccggtgctcgatttagtgtgagtagtttgggtttggggtctgagagaggagtccacccctgggatcttcaggtgttttcatttggtgatcaggacggaacagagagaactcaccatggagtttgggctgagcggctgttcaggcgcattaagnnnnnnnnngtgngnnnggncngagcgggnnnannncngncgcnngntagttgatcntgcatgactgggccncagctcgaggaggggctggagtggtcgtcggtgtagtagtggcgtggtggtcggcgtactatattattagtacgacgacgaccgccgtacggacgggtaccggttaccgtacctacgttaccgaacgacgaacgtaacgttacgaaacgaaacgaacgtacttacttacgtacgtacgacgtaagtaggtacgtacgacgtacgtacgtacgtacgtaccgtaccgaccggtccgttacgttagtttagttaggttaggttaacggtacggtacgtacggtacggtaacgggtaaccgggtacccgggtacccggtacggttaccgtaccgtacggtcgggaccggacgggaccggtcggtcggtaccg

SEQ ID NO: 54299 - DNA, 561 bp, Homo sapiens
  misc_feature: GYAE6OF02FKROF.29.78.H01.1.454.CMB.1.raw
  modified_base (380)..(380): a, c, t, g, unknown or other
  misc_feature (380)..(380): n is a, c, g, or t
  modified_base (559)..(559): a, c, t, g, unknown or other
  misc_feature (559)..(559): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccgttcaccatttccagagacaattcgaagaacacgctgtatctgcaaatggagagcctgagactcgacgacacggccgtctattattgtagttaaaggcgagctaggaatacggggaccgggcccgattgaccactggggccagggggacncgtggtcaccgtctcctcagcctccaccaacgggcccatcggtccttcccccgtggccaccctcctaccaagacgacaccctcgtcgggggaccacgacgccacgcccgtagggctcgccgtggtcaaggactacgtccagtactctactctgagtcggctggcacggcgacgagtagncg

SEQ ID NO: 54300 - DNA, 508 bp, Homo sapiens
  misc_feature: GYAE6OF02IZGTY.29.78.H01.1.454.CMB.1.raw
  modified_base (265)..(265): a, c, t, g, unknown or other
  misc_feature (265)..(265): n is a, c, g, or t
  modified_base (458)..(458): a, c, t, g, unknown or other
  misc_feature (458)..(458): n is a, c, g, or t
  modified_base (506)..(508): a, c, t, g, unknown or other
  misc_feature (506)..(508): n is a, c, g, or t
tcagatagagtactcacgaccggtgctcgatttagtgtgagtagtttgggtttggtggtctctctcccagcctgtgctgactcaatcgccctctgcctctgcctccctgggaggctcggtcaaggtcacctgtactctgagcagtggacacagcagctacgccatcgcttggcatcagcagaggccagacacgggccctcgttacttgatgacagtcaacaatgatggcagtcacagcaagggggacggatccctgatcgcttcncagtctccagctctgggcctgagcgctacctcacaatctccggcctccagtctgaggatgaggctgactattactgtcagacctggggcacgtggctagttcgaggttcttcgggaccggggtaccaaggtccaccggtcgtcggtcacgcccaaggcccaacccactcgtccactctcgttcccaccctccncacgtacctctactcgtgacggccgggctcggcaacggcgacagtagnnn

SEQ ID NO: 54301 - DNA, 551 bp, Homo sapiens
  misc_feature: GYAE6OF02FU0HM.29.78.H01.1.454.CMB.1.raw
  modified_base (463)..(463): a, c, t, g, unknown or other
  misc_feature (463)..(463): n is a, c, g, or t
  modified_base (550)..(550): a, c, t, g, unknown or other
  misc_feature (550)..(550): n is a, c, g, or t
tcagatagagtactcacgaccggtgctcgatttagtgtgagtagtttgggtttgggggcggcctgggtacggccgggggggtcgctgagactcgtcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctagacgactcgacgacacggccgtctattattgtgttaaaggcgagctgggaatacggggaccgggccgacttgaccactggggccaggggacgcgtggtcaccggtctcctcacgcctccacagggcccagtcggtctcccctggccaccctcctccaagacgccacctcgnggggccacacgcacgccctagggctgccgtggtcgaacggctactccacgtactctatctgacgcggtctcggcacggcgcatacgnc

SEQ ID NO: 54302 - DNA, 623 bp, Homo sapiens
  misc_feature: GYAE6OF02ILDWD.29.78.H01.1.454.CMB.1.raw
  modified_base (621)..(621): a, c, t, g, unknown or other
  misc_feature (621)..(621): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcacccatttccagagacaattcgaagaacacgctgtatctgcaaatggagagcctgagactcgacgacacggccgtctattattgtgttaaaggcgagctggaatacggggaccgggccgacttgaccacgtggggccaggggacgcgtggtcaccgtctccctcacgccctccaccaacgggcccacgtccggtccttccccccgtcggcccaccctccctcccaacgacgccaacctccgtcggggccacgacgccacgcccgtgggcctgcccgtggtaccgaaggaccttaaccgttcctaacgttacctccgttacgttccgttaggacgggtcccgggggccgttacggggacccaaacggggtccggactacgtacggncg

SEQ ID NO: 54303 - DNA, 638 bp, Homo sapiens
  misc_feature: GYAE6OF02JR2XK.29.78.H01.1.454.CMB.1.raw
  modified_base (323)..(323): a, c, t, g, unknown or other
  misc_feature (323)..(323): n is a, c, g, or t
  modified_base (384)..(384): a, c, t, g, unknown or other
  misc_feature (384)..(384): n is a, c, g, or t
  modified_base (601)..(601): a, c, t, g, unknown or other
  misc_feature (601)..(601): n is a, c, g, or t
tcagatagagtactcacgaccggtgctcgatttagtgtgagtagtttgggtttgggtccgagccatggtgcagactcccagagctctcctcctcctccactgcacagggtctctctcccagcctgtgctgactcaatcgcctctcgcctctcgcctcccgtgggacgctcggtcaaggtccacctgtactcgtgacgcagtcggacacgagtcacgctacgccatcgcttggacactcagcagacggcctagacaccgggcctgttacttgactgactagtacaacgaatggatcggcagtcacgagacggaacgggggacgntccgagactcgcttcacgtacgtctacagtcgtcgtacggacctggacgtcgaccttaccncgaacctagtcccgcccgtcccgtacctaggtcctacggaaggtcttccggaaggtcctacgtaacgtttacttacgtgggactacggtccggtaggggacctagtccgggtacttaaggtcccgttaggggtcccttaccggggaccgggttactaagggtcccgtaccgtttgggtcccggaacctacgggcccccaaaggtccccctaaccggnttacccgggaaccttcccggtccttacccggtacccc

SEQ ID NO: 54304 - DNA, 576 bp, Homo sapiens
  misc_feature: GYAE6OF02HQ56Z.29.78.H01.1.454.CMB.1.raw
  modified_base (575)..(575): a, c, t, g, unknown or other
  misc_feature (575)..(575): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacggggaccggggccgacttcgaccacgtggggccaggggacgctggtcaccgtctcctcacgcctccaccgacgggcccactccggtccttcccccgtcggccaccctccctccaacgacgcaccctcgtcggggcacgagccgacgcccgtgggcctcgccgtggtccgaacggacctaccgttccacgtactctacgtctgacggcgggcgtggcgaacgggcgacgatacgnc

SEQ ID NO: 54305 - DNA, 528 bp, Homo sapiens
  misc_feature: GYAE6OF02IQ18K.29.78.H01.1.454.CMB.1.raw
  modified_base (462)..(462): a, c, t, g, unknown or other
  misc_feature (462)..(462): n is a, c, g, or t
  modified_base (469)..(469): a, c, t, g, unknown or other
  misc_feature (469)..(469): n is a, c, g, or t
  modified_base (525)..(527): a, c, t, g, unknown or other
  misc_feature (525)..(527): n is a, c, g, or t
tcagatagagtactcacgaccggtgctcgatttagtgtgagtagtttgggtttggtggtctctctcccagcctgtgctgactcaatcgccctctgcctctgcctccctgggaggctcggtcaaggtcacctgtactctgagcagtggacacagcagctacgccgtcgcttggcatcagcagaggccagacacgggccctcgttacttgatgacagtcaaacaatgatggcagtcacagcgaaaggggggacggatcccgtgatcgcttctcagtcctccagctcgtggggcctggacgcgcctacctcaacaactccgtccggcctccagtctgaggatggacggctagacttatactgtcacgacgtgggcacgtgctattcgagtcgtcgggaccgggacaaggtccacggtcgtacgtcacgccaacggcccaaccgctcgtctacctccgtcgtcccnccttccnctaacgtactctactcgtggcggtccgggctacggacgaacggtcacgtagtagcnnnc

SEQ ID NO: 54306 - DNA, 630 bp, Homo sapiens
  misc_feature: GYAE6OF02H2DBT.29.78.H01.1.454.CMB.1.raw
  modified_base (323)..(323): a, c, t, g, unknown or other
  misc_feature (323)..(323): n is a, c, g, or t
  modified_base (362)..(362): a, c, t, g, unknown or other
  misc_feature (362)..(362): n is a, c, g, or t
tcagatagagtactcacgaccggtgctcgatttagtgtgagtagtttgggtttggggtccgagccatggtgcagactccccagagctctcctcctcctccactgcacagggtctctctcctagcctgtgctgactcaatcgccctctgcctctgccctcccgtgggaggctcggtcaaggtcacctgtactctgagcagtggacacagcagctacgccatcgcttggcatcagcagaggccagacaccgggcctcgttactgatgacagtcaaacaatgatggcagtcacagcgaaagggggcggatccctgactcgctttcncagtctccagctcgtgggcctggacgccgaccttacccncaactaactccgtacccggtccctccgtagtcgtagaggatggacggtctgaacttattactgtacacgaccgtggggcctacgtcggctaagttccgtaacgggttccggttaccgggaacccgggggtaaccgtaacgggtacccgtacccgggttccgggttacccgggtaccgaaccggtaccccgaaaccgggacccccgaaacccccgtacccggttaccggttacccgtaacccgttcccgttacccgtttaacccccccg

SEQ ID NO: 54307 - DNA, 646 bp, Homo sapiens
  misc_feature: GYAE6OF02IY6GK.29.78.H01.1.454.CMB.1.raw
  modified_base (241)..(241): a, c, t, g, unknown or other
  misc_feature (241)..(241): n is a, c, g, or t
  modified_base (351)..(351): a, c, t, g, unknown or other
  misc_feature (351)..(351): n is a, c, g, or t
  modified_base (363)..(363): a, c, t, g, unknown or other
  misc_feature (363)..(363): n is a, c, g, or t
tcagatagagtactcacgaccggtgctcgatttagtgtgagtagtttgggtttggggtctgagagaggagtccacccctgggatcttcaggtgttttcatttggtgatcaggacggaacagagagaactcaccatggagtttgggctgagcgtggcttttctgtggctattttaaaaggtgtccagtgtgacgtgcagttggtggagtctgggggcgcctggggtacggccgggggggtcncgtgagactctcctgtgcggcctcgtggattaagtttaggagtcatgccatgaactggtccgcaggctccgagggaaggggctggagtgggtcgtcggctagttggtgcnggtggtggccgntagtattatatgcagacgcctgaacgggccgttcaccagtttccagagacaattcgaaagaacacgctgtactctagacaaagtggagaacgcctagtacgacgttaccggaacgacgaccgggaccgttacgttaactttagttaggttaaggtttaaaacgggcgtaacggtcgtagggtaaacggtacccgggggtaacccgggggcccgtaaccggtttaccggaacccgtacggttcgggggacccgacggggggaaccgtcggttacggtaccccgg

SEQ ID NO: 54308 - DNA, 797 bp, Homo sapiens
  misc_feature: GYAE6OF02G5YLS.29.78.H01.1.454.CMB.1.raw
  modified_base (283)..(283): a, c, t, g, unknown or other
  misc_feature (283)..(283): n is a, c, g, or t
tcagatagagtactcacgaccggtgctcgatttagtgtgagtagtttgggtttggtggtctctctcccagcctgtgctgactcaatcgccctctgcctctgccctccctgggaggctcggtcaaggtcacctgtactctgagcagtggacacagcagctacgccatcgcttggcatcagcagaggccagacgaccgggcccttcgttacttgatgacagtacaaacaatgagtggcagtccacgaggacggaaggggggacggactcccgtgactccgcttcncacgttcctccgagtcctcggtcgggccctggacgccgtaccttaacccgtaccaaccgtaaccttcccgtcccccggtacccttaccgtacggttaccgtacggtaagggtacgttaggacgggttaccttacggtaaacctttacgtttaacccgtcggttaccgaacggggtacccgggtttacggggggacctaaccgggttcggtaccgttaacggttttaccggtaccgggttaccgggttaacccggggggaacccggggtaacccgtaacggggttacccgtacccgggttccggttaccgggttaccgaacccgggtaccccgaaaccgggtaaccccctaaaccccgtaccgttaccggtacccttacccgttaccccgtttaccccgttaccccctaaccccgtttcccgtaaccgtacgtttcccgttacttacggtccggtacgggaccggtccgggtccgtacgggaccgtaaccgggcctacggtacgtacggcagtcg

SEQ ID NO: 54309 - DNA, 651 bp, Homo sapiens
  misc_feature: GYAE6OF02IJH64.29.78.H01.1.454.CMB.1.raw
tcagatagagtactcacgaccggtgctcgatttagtgtgagtagtttgggttgggggaaggaggaagactgacggtccacccctcgggagtcttcaggtgttttctatttggttggatcaggacgggaacagagagaactcaccatggagtttgggtctgagctggctttttctttgtggctattttaaaaggtagtccagtgtgacgtgcagttggtggagtctgggggcgcctgggtacggccgggggggtcgctgagactctcctgtgcggcctctggattaagtttaggagtcatgccatgaactgggtccgcaggctccagggaaggggctgggaggtggggtctcggctagttagtggcagtggtggcgctatatattatgcagacgccctggaagggcccggttcaccatttccagagacaatttacgaaagaaacacgcttagtatctgacaaatgggagagccgtgaagactacgacgacgaccgggccgttacttaatttatttaggtagtttaaaacgggccgtaggaccgttagggtaacggtaaccgggggtaaccccgggggcccgttaaccgttcggaacccgtaaccgtcgggggggacccgtaacggggggaaccgtccggttacggtacccgg

SEQ ID NO: 54310 - DNA, 582 bp, Homo sapiens
  misc_feature: GYAE6OF02H6YZJ.29.78.H01.1.454.CMB.1.raw
  modified_base (581)..(582): a, c, t, g, unknown or other
  misc_feature (581)..(582): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccattttccagagacaattcgaagaacacgctgtatctgcaaaatggagagcctgagactcgacgacacggccgtctattattgtgttaaaggcgagctggaatacgggaccggggccgacttgacccaacgtcgggggccagggggaccgcgtcggtcaccgtctcctcacggccctccgacccgaacgggcccacgtccggtcctttcccccgtcggccctccctccctccaacgacgcctacccgtcgtcgggggcacgagccacgccctgggcctcgccgtggtcaaggactaccttcacgtactctatctgacgcggtctggcaaggccgtacgatagnn

SEQ ID NO: 54311 - DNA, 607 bp, Homo sapiens
  misc_feature: GYAE6OF02HKABA.29.78.H01.1.454.CMB.1.raw
  modified_base (605)..(605): a, c, t, g, unknown or other
  misc_feature (605)..(605): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgacaaatggagagcctgagactcgacgacacggccgtctattattgtagttaaaggcgagctaggaatacggggaccgggccgacgttgaccacgtgggggcccaggggaccgcgtggtcaccggtctccctcacgccctccaaccgaacgggcccacgtcggtccttcccccgtcggccaccctccctaccaacgacgccaccgtcgtcggggccacgacgcgacgcccgtcgggctcgccgtcggtacgaaacggacttaccttaccgtacgttaccttccttacgtcgtacggacggccgggtcgtaggacgaacgggccgcgatagncg

SEQ ID NO: 54312 - DNA, 582 bp, Homo sapiens
  misc_feature: GYAE6OF02IGH0W.29.78.H01.1.454.CMB.1.raw
  modified_base (330)..(330): a, c, t, g, unknown or other
  misc_feature (330)..(330): n is a, c, g, or t
  modified_base (580)..(580): a, c, t, g, unknown or other
  misc_feature (580)..(580): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtagttaaaggnagctggaaatacgggaccggggcccgacgttcgaccacgtggggccaggggacgctggtcaccgtctcctcagccctccaccgaacgggcccatccggtccttcccccgtcggccaccctccctccaacgacgccacctccgtggggccacgacgcgacgcccgtgggcctcggcctcggtaccaaacggactaccttaccagtacctctacttcgtgacggccggcgtggcgaacggccgacgaactgncg

SEQ ID NO: 54313 - DNA, 590 bp, Homo sapiens
  misc_feature: GYAE6OF02HBEQR.29.78.H01.1.454.CMB.1.raw
  modified_base (589)..(589): a, c, t, g, unknown or other
  misc_feature (589)..(589): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacggggaccggggcccgacttgaccacgtggggccagggggacgcgtggtcaccgtctcctcacgcctccaccgaacgggcccacgtccggtccttccccctcggcccaccctccctaccaacgacgccacctcgtcggggcacgacgcgacgcccgtgggcctcgccgtcggtccaacggtactaaccgttccgagtaccttactacgtctggacggtccgggtcgtcggacgacggccgacgacgtagnc

SEQ ID NO: 54314 - DNA, 632 bp, Homo sapiens
  misc_feature: GYAE6OF02H133R.29.78.H01.1.454.CMB.1.raw
  modified_base (630)..(630): a, c, t, g, unknown or other
  misc_feature (630)..(630): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgacaaaatggagagcctgagactcgacgacacggccgtctattattgtgttaaaggcgagctggaagtacggggaccggggcccacgttcgaccacgtcgggggccagggggacgcgtcggtcaccgtctcctcacgtccctaccaaccgaacgggcccagtccggtccctttcccccgtcggccctaccctccctacccaagacgaccacccgttcggtcgggggccaacgacgccgacgccccgtggggcctcggccgttcgggtaccgaacggtaccttaccgttacctaccgttacttcctacgttccgtcggacggtccgggcgttcggacgaacgggccgacgagtacgncg

SEQ ID NO: 54315 - DNA, 584 bp, Homo sapiens
  misc_feature: GYAE6OF02G9NN2.29.78.H01.1.454.CMB.1.raw
  modified_base (423)..(423): a, c, t, g, unknown or other
  misc_feature (423)..(423): n is a, c, g, or t
tcagatagagtactcacgaccggtgctcgatttagtgtgagtagtttgggtttggggtccgagccatggtgcagactccccagagctctcctcctcctccactgcacagggtctctctcccagcctgtgctgactcaatcgccctctgcctctgcctccctgggaggctcggtcaaggtcacctgtactctgagcagtggacacagcagctacgccatcgcttggcatcagcagaggccagacacgggccctgttactgatgacagtcaacaatgatggcagtcacagacggaagggggacggatcccgtgactcgcttcgcagtcctccagtcctcgtcgggcctggacgccgtcctacccgtcaactaactccgtcccggcctccgagtcctagaggatggaggctggtaacttattacgngtacacggtaccgtggggcctacgtggactagttcgacggttcgttaccgggaacccggggtaccaaggttccgacccggtcggtaccggtccgaccggaccccgaacggaccccaacccccgtcgtaccgttaccctaccgttccgtaccgttacccccc

SEQ ID NO: 54316 - DNA, 498 bp, Homo sapiens
  misc_feature: GYAE6OF02FM05V.29.78.H01.1.454.CMB.1.raw
  modified_base (487)..(487): a, c, t, g, unknown or other
  misc_feature (487)..(487): n is a, c, g, or t
tcagatagagtactcacgaccggtgctcgatttagtgtgagtagtttgggtttggggtccgagccatggtgcagactccccagagctctcctcctcctccactgcacagggtctctctcccagcctgtgctgactcaatcgccctctgcctctgcctccctgggaggctcggtcaaggtcacctgtactctgagcagtggacacagcagctacgccatcgcttggcatcagcagaggccagacacgggccctcgttacttgatgacagtcaacaatgatggcagtcacagcaagggggacggatccctgatcgcttctcagtctccagctctgggcctgagcgctacctcacaatcctccggcctccagtctgaggatgaggctgactattactgtcagtaccgtggggcacgtggaccattcgaggttcttacgggaccgggaccaggtcaccggtcgtcggcagcccaagcccaacccgctgccnctctcgtcccc

SEQ ID NO: 54317 - DNA, 556 bp, Homo sapiens
  misc_feature: GYAE6OF02HCRLH.29.78.H01.1.454.CMB.1.raw
  modified_base (555)..(556): a, c, t, g, unknown or other
  misc_feature (555)..(556): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccgggccgacttgaccactggggccaggggacgctggtcaccgtctcctcacgcctccaccaagggcccatcggtcttccccctggccaccctcctccaacgacgccaccctcgtcgggggccacgacgccacgccccgtgggcctcgcctgggtccaacggacctacgttccagtacctctatctgacgcggctggcacggcgcatagnn

SEQ ID NO: 54318 - DNA, 630 bp, Homo sapiens
  misc_feature: GYAE6OF02GKT4Q.29.78.H01.1.454.CMB.1.raw
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccggggcccgacttgaccactggggccaggggacgctggtcaccgtctcctcacgcctccaccgaacgggcccactccggtccttcccccgtcggccacccctccctcccaacgacgccgacctccgtcgggggccaccgacgccgacgcccgtacggggcctcggcccgttcggtaccgaaacggtaccttaaccgtttacccgacgttaccttccttaacgttccgttacggacggtccgggccgttcgggaccgaacgggccgtaccgaacgttacgagtcg

SEQ ID NO: 54319 - DNA, 609 bp, Homo sapiens
  misc_feature: GYAE6OF02IWQK7.29.78.H01.1.454.CMB.1.raw
  modified_base (407)..(407): a, c, t, g, unknown or other
  misc_feature (407)..(407): n is a, c, g, or t
  modified_base (443)..(443): a, c, t, g, unknown or other
  misc_feature (443)..(443): n is a, c, g, or t
tcagatagagtactcacgaccggtgctcgatttagtgtgagtagtttgggtttggggcggcctgggtacggccgggggagtcgctgagactctcctgtgcggcctcctggattaagttttaggagtcatgccatgaactggtccgccaggctccagggaagggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtagttaaaggcgagcgtaggaagtacggggaccggggcccgacgttgacccacgtggggaccaggggacgcgtggtcaccgtctcctcncgcctccaccgaagggccccagtccgtcctccccgngccaccctccaccaacgcgcctacccgtcggtcggggaccacagccgacgcccgtgggcctcggccgttcggtacgaaacggtaccttaccgttaccgacgttaccttccgtaattccgtggtaacgggccgggtcgtacgggacgtaacggccgtacgtagtcga

SEQ ID NO: 54320 - DNA, 633 bp, Homo sapiens
  misc_feature: GYAE6OF02IY0AD.29.78.H01.1.454.CMB.1.raw
  modified_base (200)..(200): a, c, t, g, unknown or other
  misc_feature (200)..(200): n is a, c, g, or t
  modified_base (421)..(421): a, c, t, g, unknown or other
  misc_feature (421)..(421): n is a, c, g, or t
tcagatagagtactcacgaccggtgctcgatttagtgtgagtagtttgggtttggggtccgagccatggtgcagactccccagagctctcctcctcctccactgcacagggtctctctcccagcctgtgctgactcaatccgccctctgcctctcgccctcccgtggggaggctcggtcaaggtccacctgtactctgancagtggacacagcagctacgccatcgcttggcatcagcagaggccagacaccgggcctcgttacttgatgaacagtacaacaatgagtggacagtcacgaggcggaagggggacggatccgtgactcgtcttcacagttcctccgagtccgttcggtcgggccctaggacgtcccgtccttaaccctacaaccgtaacgtcccgttacccggccttaccgngttccgaggaggtacgtggaacggtctggtaactttacgttacgcgtacgacggtaccggtgggactacgtggctagttcgacggttccgtacgggaccgggtactacgggtcctaccggttcggtccggtaccgaaccggtaccccgaaacggccccctaacccgtacgttaccgtacccgtaacccgtttccgtacccgttaaccccccg

SEQ ID NO: 54321 - DNA, 578 bp, Homo sapiens
  misc_feature: GYAE6OF02GUE7H.29.78.H01.1.454.CMB.1.raw
  modified_base (576)..(576): a, c, t, g, unknown or other
  misc_feature (576)..(576): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccggggccgacttgaccacgtggggccaggggacgctggtcaccgtctcctcacgcctccaccaacgggcccacgtcggtccttccccctcggccaccctccctccaacgacgccacctcgtcgggggccacacgcgacgcccgtcgggcctcgccgtcggtaccgaacggacctaccttccacgtactctacgtctgacggcggcgtggacgaacgggcgacgagtacgncg

SEQ ID NO: 54322 - DNA, 572 bp, Homo sapiens
  misc_feature: GYAE6OF02JRWFT.29.78.H01.1.454.CMB.1.raw
  modified_base (283)..(283): a, c, t, g, unknown or other
  misc_feature (283)..(283): n is a, c, g, or t
  modified_base (374)..(374): a, c, t, g, unknown or other
  misc_feature (374)..(374): n is a, c, g, or t
  modified_base (570)..(570): a, c, t, g, unknown or other
  misc_feature (570)..(570): n is a, c, g, or t
tcagatagagtactcacgaccggtgctcgatttagtgtgagtagtttgggtttggggcgcctgggtacggccggggggtcggctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatgganagcctgagactcgaacgacacggccgtctattatgtgttaaaggcagctggaatacgggaccggccgattgaccactggggccaggggacnctggtcaccgtctcctcagcctccacgaacgggcccatccggtcttcccccgtggcccaccctccctccaacgacgccacctcgtcggggccacgacgccacgcccgtgggcctcggcctcgggtacaacgggaccttacgtccacggtactacgtatccgtgacggtcggtcgtggccaagggccacgacgtagncg

SEQ ID NO: 54323 - DNA, 579 bp, Homo sapiens
  misc_feature: GYAE6OF02I80EK.29.78.H01.1.454.CMB.1.raw
  modified_base (438)..(438): a, c, t, g, unknown or other
  misc_feature (438)..(438): n is a, c, g, or t
  modified_base (576)..(576): a, c, t, g, unknown or other
  misc_feature (576)..(576): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggcccgtctattattgtgtttaaaaggcgagctaggaatacgggaccggggcccgacttgaccacgtggggccaggggacgctaggtcaccgtctcctcagccctccaccaacggcccatccggtcttcccccnggccaccctcctccaacgacgccacctccgtcggggaccacacgccacgcccgtcggctcgcccgtggtacgacggactaccttccgactacctctacgtctagcggccggcgtggaccgaacggccgacgagtacgngcg

SEQ ID NO: 54324 - DNA, 775 bp, Homo sapiens
  misc_feature: GYAE6OF02HX859.29.78.H01.1.454.CMB.1.raw
tcagatagagtactcacgaccggtgctcgatttagtgtgagtagtttgggtttggtggtctctctcccagcctgtgctgactcaatcgccctctgcctctgcctccctgggaggctcggtcaaggtcacctgtactctgagcagtggacacagcagctacgccatcgcttggcatcagcagaggccagacacgggccctcgttacttgatgacagtacaaacaatgatggcagtcacagcgaagggggacggatccctgactcgcttctcagtcctccgagccttcgtcggggcctggacgccgtcctaaccctcaactaacttccgtcccggcccttccaggttcctaggaacggtattgggaacggtcttaggtaaccttacgttttaaccgtcggttaccgaacgggtacccggttcggggggaccctaacggttcgggtaccttaacggttttcccggtaacggggtttccccggtttacccggggggaaccccggggggtaaacctaaaccgggggttcccctaaccccggggttccgggtttaccgggtacccggaaccgggtaacccccgtaaaccggggacccccctaaacccccggtaccgttccggttaccctacccgtttcccgttcccggtttaacccccaacccccgtttccctaccgtaaccgtttacccttccgtttaacgttcccggtacgggaaccgggtcccggggtaccgttacggggaccgaaccggggtcccgaacgtaacggtacggctcgcg

SEQ ID NO: 54325 - DNA, 592 bp, Homo sapiens
  misc_feature: GYAE6OF02GE7QJ.29.78.H01.1.454.CMB.1.raw
  modified_base (590)..(590): a, c, t, g, unknown or other
  misc_feature (590)..(590): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccgggcccgacttgaccacgtggggccaggggacgctggtcaccgtctcctcagccctccaccgaagggcccagtccggtccttccccccgtcggccaccccttccctccaacgacgccacctcgtcgggggcaccgacgccgacgcccgtgggcctcggcccgtcggtccaacggtaccttaccgttccgacgtacctctacgtctgacggcgggtctcgggacgaacgggccgacgacgtagncg

SEQ ID NO: 54326 - DNA, 602 bp, Homo sapiens
  misc_feature: GYAE6OF02IR1QJ.29.78.H01.1.454.CMB.1.raw
  modified_base (600)..(600): a, c, t, g, unknown or other
  misc_feature (600)..(600): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaagtacgggaccggggccgacgttgaccacgtggggccaggggacgcgtggtcaccgtctcctcacgcctcccaaccaacgggcccatccggtccttcccccgtggccctaccctccctaccgaacgtacgccacctccgtcggggcaccgacgccgacgcccgtgggctcgcccgttggtaccgaaacggtacttaccttcccgagttacctcttacgtcctggacggtccgggtcgtcgggacgaacgggccgacaagtagngc

SEQ ID NO: 54327 - DNA, 570 bp, Homo sapiens
  misc_feature: GYAE6OF02H2H8E.29.78.H01.1.454.CMB.1.raw
  modified_base (569)..(569): a, c, t, g, unknown or other
  misc_feature (569)..(569): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccgggcccgacttgaccactcggggccaggggacgctggtcaccgtctcctcagcctccacccgaacggcccactccggtccttcccccgtcggccaccctcctcccaacgacgcctaccgtcgtcgggggcacgacgcgacgcccgtcgggctcgccgtcgtacgaacggactaccgttccagtaccgtctatctgacggcggcgtcggacgacggcgcatgnc

SEQ ID NO: 54328 - DNA, 585 bp, Homo sapiens
  misc_feature: GYAE6OF02F3BNX.29.78.H01.1.454.CMB.1.raw
  modified_base (380)..(380): a, c, t, g, unknown or other
  misc_feature (380)..(380): n is a, c, g, or t
  modified_base (582)..(582): a, c, t, g, unknown or other
  misc_feature (582)..(582): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatataaattatgcagacgccctgaagggccggttcaccatttccagagacaattcgaagaacacgctgtatctgcaaatggagagcctgagactcgacgacacggccgtctattattgtgttaaaggcgagctggaatacgggaccgggccgacttgaccactggggccaggggacncgtggtcaccgtctcctcacgcctccacaacgggcccagtcggtccttcccccgtcggccaccctccctccaacgacgccaccctcgtcgggggccacgacgcgacgcccgtagggcctcgcccgtcggtcgaacggtacctaccgttccagttactctacgtcgtgacggcgggacgtggacgaacgggcgacgactacgnacg

SEQ ID NO: 54329 - DNA, 580 bp, Homo sapiens
  misc_feature: GYAE6OF02G48XX.29.78.H01.1.454.CMB.1.raw
  modified_base (384)..(384): a, c, t, g, unknown or other
  misc_feature (384)..(384): n is a, c, g, or t
  modified_base (402)..(402): a, c, t, g, unknown or other
  misc_feature (402)..(402): n is a, c, g, or t
  modified_base (457)..(457): a, c, t, g, unknown or other
  misc_feature (457)..(457): n is a, c, g, or t
  modified_base (462)..(462): a, c, t, g, unknown or other
  misc_feature (462)..(462): n is a, c, g, or t
  modified_base (577)..(577): a, c, t, g, unknown or other
  misc_feature (577)..(577): n is a, c, g, or t
tcagatagagtactcacgaccggtgctcgatttagtgtgagtagtttgggtttgggggtcggccgtgggtacgggccgggggggtcggcgtgagactctcctgtgcggcctctggattaagttttaggagtcatgccatgaactgggtccgccaggctccagggaaggggctggagtgggtctcggctattagtggcagtggtggcgctatatattatgcagacgccctgaagggccgttcaccatttccagagacaattcgaagaacacgctgtatctgcaaatggaagagcctgagactcgagacacggcctctattattgtgttaaaggcagctggaatacggggaccggggccacgttgaccactggggccagggggacncgtggtcaccggtctccncagccctccaacgacggcccatcggtcctcccctggccaccctccctaccaagcncaccncgtcggggcacagcacgcccgtgggctcgcctcggtacaacggtactacgttccaagtacctcttaactctacggacgccgggtcgtgggaccgtaacgggcgtaccgagttagntcg

SEQ ID NO: 54330 - DNA, 652 bp, Homo sapiens
  misc_feature: GYAE6OF02GYZUY.29.78.H01.1.454.CMB.1.raw
  modified_base (269)..(269): a, c, t, g, unknown or other
  misc_feature (269)..(269): n is a, c, g, or t
  modified_base (556)..(556): a, c, t, g, unknown or other
  misc_feature (556)..(556): n is a, c, g, or t
  modified_base (645)..(645): a, c, t, g, unknown or other
  misc_feature (645)..(645): n is a, c, g, or t
tcagatagagtactcacgaccggtgctcgatttagtgtgagtagtttgggtttggtgggtctctctccagcctgtgctgactcaatcgccctctgcctctgcctccctgggagctcggtcaaggtcacctgtactctgagcaggtggacacagtcagctacgcctatcgcttggcatcagcagagccagacacgggccctgttacttggactgacgagtcaacgatgactggcagtcacgagcaagggggcgatcccgtgatcgcttcncagtctccagctcgtggcctggacgcgctacctcgaactaattccgtacccggcctaccgagttccgtaggaacggtatcggagtctaggaactttacgttacgtgtaccggtacgtaccgtgggggacctcgtacggcctaagttcgacgggttcccgttaccgggaaccggggtaaccaacggggttcccaacccgggttcgtaccgggtcaacggtccccgtaaacgggccccaaaccccgtcgttacgtacccgtaaccttccggttacccggtttacccccnccgttacccgtacctaacgggttaccctcgttaacgtcggttaacggacggtccggggtactacgggacgtacggggcctacaggttancgtgtag

SEQ ID NO: 54331 - DNA, 620 bp, Homo sapiens
  misc_feature: GYAE6OF02H5W38.29.78.H01.1.454.CMB.1.raw
  modified_base (335)..(335): a, c, t, g, unknown or other
  misc_feature (335)..(335): n is a, c, g, or t
tcagatagagtactcacgaccggtgctcgatttagtgtgagtagtttgggtttggggtccgagccatggtgcagactccccagagctctcctcctcctccactgcacagggtctctctcccagcctgtgctgactcaatcgccctctgcctctgccctccctgggaggctcggtcaaggtcacctgtactctgagcagtggacacagcagctacgccatcgcttggcatcagcaggacggccagacacgtcgccccttcgttacttgatgacagtacaaacaatgatggcagtcacgaggcggaaaggggggacggactccctgactcgctttcncagtctccagctcgtggcctgacgcgtcctacctcacctatcccgtcccggcctccgagtcgtaggacggtatcgggacggtccttaggtaactttacgttaacgtcgtacgacggtaccggttggggacctacggtcgacctacgtttccggaacggttccgttaccggggaacccgggtacccaagggttcccgtaccggttcggtacccggttaccaaccgggtaccccgaaccggtaccccaaccccgtacgttcgttaccctaccgttccgttaccccgg

SEQ ID NO: 54332 - DNA, 639 bp, Homo sapiens
  misc_feature: GYAE6OF02GQD5T.29.78.H01.1.454.CMB.1.raw
  modified_base (636)..(636): a, c, t, g, unknown or other
  misc_feature (636)..(636): n is a, c, g, or t
tcagatagagtactcacgaccggtgctcgatttagtgtgagtagtttgggtttgggggcgacctgggtacggccgggggggtcgctgacgactctcctgtgcggcctctggattaagttttaggagtcatgccatgtaactgggtccgccaggctccagggaaggggctggagtgggtctcggctattagtggcagtggtggcgctatatattatgcaggacgccctgaagggccggttcaccatttccagagacaattcgaagaacacgctgtatctgcaaatggagagcctgagactcgacgacacgggccgtcgtattattgtagttaaaggcgagctggaatacggggaccggggcccacttgacccacgtggggaccagggggaccgcgtgggtcaccggtctccctcacgccctcccaaccgaacgggcccactccgggtcctttcccccgtcggccaccccttccctaccaacgacgccacctcgtcgggggcacgacgccacggcccgtggggccctcgccgttggttaccgaacggtaccttaaccgttacccgagttacctacgttacgttcgttacggtacggccgggtacgttcgggacgaacggggtccgacgtacgtacggntcg

SEQ ID NO: 54333 - DNA, 585 bp, Homo sapiens
  misc_feature: GYAE6OF02FZFJQ.29.78.H01.1.454.CMB.1.raw
  modified_base (584)..(584): a, c, t, g, unknown or other
  misc_feature (584)..(584): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccggggcccgacttgaccacgtgggggccagggggacgctggtcaccgtctcctcagccctccaccaagggcccatcggtccttcccccgtcggccaccctcctacccaacgacgccaccctccgtcgggggccacgacgccgacgcccgtgggctcgcccgtggtaccgaaggtacctacttaccgacgttacctctactcgtgacggcggcgtcggcgaacgggccgacgagtacgnc

SEQ ID NO: 54334 - DNA, 568 bp, Homo sapiens
  misc_feature: GYAE6OF02GJRP9.29.78.H01.1.454.CMB.1.raw
  modified_base (437)..(437): a, c, t, g, unknown or other
  misc_feature (437)..(437): n is a, c, g, or t
  modified_base (454)..(454): a, c, t, g, unknown or other
  misc_feature (454)..(454): n is a, c, g, or t
tcagatagagtactcacgaccggtgctcgatttagtgtgagtagtttgggtttggggtctgagagaggagtccacccctgggatcttcaggtgttttcatttggtgatcaggacggaacagagagaactcaccatggagtttgggctgagctggctttttcttgtggctattttaaaaggtgtccagtgtgacgtgcagttggtggagtctgggggcgcctggggtacggccgggggggtcgcgtgagactctcctgtgcggcctctggattaagttttaggagtcatgccatgaactgggtccgccaggctccaggggaaggggctggagtgggtctcgggctagttagtggcagtggtggcgctatatattatgcagacgcctgaagggccgttcacctatttccagagacaattcgaagaacacgctgtatctnacaaatgagagcctganactcgacgacgacggccgtctattagttgtagttaaaggcgagctggaagtaccggggaccgggcccgacgttcggaccacggtcggggacccgagggggacgcgtggtacccg

SEQ ID NO: 54335 - DNA, 616 bp, Homo sapiens
  misc_feature: GYAE6OF02HFJJ8.29.78.H01.1.454.CMB.1.raw
tcagatagagtactcacgaccggtgctcgatttagtgtgagtagtttgggtttggggtccgagccatggtgcagactccccagagctctcctcctcctccactgcacagggtctctctcccagcctgtgctgactcaatcgccctctgcctctgcctccctgggaggctcggtcaaggtcacctgtactctgagcagtggacacagcagctacgccatcgcttggcatcagcagacggccagacacggccctcgttactgatgacagtacaacaatgatggcagtcacgagacggaagggggacgactccgtagatcgcttcgacagtcctcacgtcctcgcgggcctggacgccgacctacctcgaactaacttccgtccggtccctaccgtacgtctacggaggtagtaggacggtctaggtaacttatttacgtcgtacgacggtaccggtcggggctacggtcggtacttaacgttccggtacgggttccggttaccggggaacccgggtaccgtaaggttcccgaccggttccggtccgggtaccaccggtaccccgaacgggaccccaacccgtacgtaccggttacctacgttccgtcccgttcccccg

SEQ ID NO: 54336 - DNA, 658 bp, Homo sapiens
  misc_feature: GYAE6OF02HB99M.29.78.H01.1.454.CMB.1.raw
  modified_base (392)..(392): a, c, t, g, unknown or other
  misc_feature (392)..(392): n is a, c, g, or t
  modified_base (655)..(655): a, c, t, g, unknown or other
  misc_feature (655)..(655): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgacaaatggagagcctgagactcgacgacacggccgtctattattgtagttaaaggcgagctaggaagtaccgggaccggggacccgtacgttcgaccacgtcgggggccaggggacncgtggtccaccgtctccgcacgccctcccaaccgaacgggcccctagtcccggttcccttcccccgtcggccctacccctccctacccgaaacggtcgacccgtaaccgtcggtcggggaccacgtacgccacgcccgtcgggctcggccgttgggtaccgaaagggtacccttaccgttacccacggtttaccctacgttacgttacgtcgggtaacggtccgggtaccgttacgggaccgaacgggccgacctaagtacgngac

SEQ ID NO: 54337 - DNA, 580 bp, Homo sapiens
  misc_feature: GYAE6OF02IMWZB.29.78.H01.1.454.CMB.1.raw
  modified_base (579)..(580): a, c, t, g, unknown or other
  misc_feature (579)..(580): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctatttattgtagttaaaggcgagctggaatacgggaccggggcccgattcgaccacgtggggccaggggacgcgtggtcaccgtctcctcacgccctccaccaacggggccccaagtccgggtccttccccccgtcggcctacccctccctacccaacgacgccacctccgcgggggccacacgccacgcccgtgggctcgcctcggtcaacggacctaccttccagtacctctagtctgacgcgggcgtaggcacggccgagactgnn

SEQ ID NO: 54338 - DNA, 638 bp, Homo sapiens
  misc_feature: GYAE6OF02H13FX.29.78.H01.1.454.CMB.1.raw
  modified_base (385)..(385): a, c, t, g, unknown or other
  misc_feature (385)..(385): n is a, c, g, or t
  modified_base (399)..(399): a, c, t, g, unknown or other
  misc_feature (399)..(399): n is a, c, g, or t
  modified_base (636)..(636): a, c, t, g, unknown or other
  misc_feature (636)..(636): n is a, c, g, or t
tcagatagagtactcacgaccggtgctcgatttagtgtgagtagtttgggtttgggggcgcctgggtacggccgggggggtcgctgagactctcctgtgcggcctctggattaagtttaggagtcatgccatgaactgggtccgccaggctccagggaaggggctggagtgggtctcggctattagtggcagtggtggcgctatatattatgcagacgccctgaagggccggttcaccatttccagagacaattcgaagaacactctgtatctgacaaatggagagcctgagactcgacgacacggccgtatattattgtagttaaagcgagctggaagtacgggaccgggcccgtacgttcgacgacgtggggccagggggacncgtggtcaccgtcncctcacgccctccaccgaacgggccctacgtccggttcccttcccccgtcggccctacccctccttacccgaacgtacgaccaacccgtcggtacgggggcctaacgacgccgacgcccggtcgggccgtccggcccgtcggtaccgtaaacgggtaaccttaccgttaccgacgttacctccgttacgtcgtagggtacggccgggtcgcggtacgacgggtccgacctagtacgnag

SEQ ID NO: 54339 - DNA, 597 bp, Homo sapiens
  misc_feature: GYAE6OF02HZJ2A.29.78.H01.1.454.CMB.1.raw
  modified_base (597)..(597): a, c, t, g, unknown or other
  misc_feature (597)..(597): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaaatggagagcctgagactcgacgacacggccgtctattattgtgttaaagcgagctggaatacgggaccgggcccgacttgaccacgtggggccagggggacgctggtcaccgtctcctcacgccctccaaccgaacggcccacgtcggtccttcccccgtcggccaccctccctccaacgacgccacctcgtcggggccacgacgccacgcccgtgggctcgccgtcggtccgaacggactaccttaccgacgttacctacttacgtctacggacggccgggtcgtcgggaccgaacgggaccgacgacgttaggacn

SEQ ID NO: 54340 - DNA, 541 bp, Homo sapiens
  misc_feature: GYAE6OF02IPZN3.29.78.H01.1.454.CMB.1.raw
  modified_base (539)..(539): a, c, t, g, unknown or other
  misc_feature (539)..(539): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaaagaacaacgctgtatctgcaaaatggagagcctgagactcgacgacacggccgtctattattgtgttaaaaggcgagctggaatacgggaccggggccgacttgaccactggggccaggggacgcgtggtcaccgtctcctcagcctccaccaagggcccatcgtctcccctggcaccctctccaagacgcacctcgcggggcacagcagccctgggctgcctggtacaaggctaactccaagtctctatctagacgcggctggacgaaggcgacatagncg

SEQ ID NO: 54341 - DNA, 554 bp, Homo sapiens
  misc_feature: GYAE6OF02HB105.29.78.H01.1.454.CMB.1.raw
  modified_base (453)..(453): a, c, t, g, unknown or other
  misc_feature (453)..(453): n is a, c, g, or t
  modified_base (545)..(545): a, c, t, g, unknown or other
  misc_feature (545)..(545): n is a, c, g, or t
  modified_base (552)..(552): a, c, t, g, unknown or other
  misc_feature (552)..(552): n is a, c, g, or t
  modified_base (554)..(554): a, c, t, g, unknown or other
  misc_feature (554)..(554): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaaatggagagcctgagactcgacgacacggccgtctattattgtgttaaaggcgagctggaatacgggaccggggcccgacttgaccactggggccagggaccctggtcacgtctcctcacgcctccaccaacgggcccatcggtccttccccctggccgccctgcctccagggcnccaccctccgagacgccacacggccggcccgtgggctcgcctggtccaaggcctacttccagtactctagtctgacggcggctggcacggcncgatagntn

SEQ ID NO: 54342 - DNA, 545 bp, Homo sapiens
  misc_feature: GYAE6OF02I4NPF.29.78.H01.1.454.CMB.1.raw
  modified_base (545)..(545): a, c, t, g, unknown or other
  misc_feature (545)..(545): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccgggcccgacttgaccactggggccaggggacgctggtcaccgtctcctcacgcctccacaacgggcccatccggtcttccccctggccaccctcctccaacgacgcacctcgtcgggggccacacgcacgcccgtgggctgccgtggtcaacggactacttccagtactctatctgagcggcgtggcaggcgcatagn

SEQ ID NO: 54343 - DNA, 588 bp, Homo sapiens
  misc_feature: GYAE6OF02HUJMK.29.78.H01.1.454.CMB.1.raw
  modified_base (282)..(282): a, c, t, g, unknown or other
  misc_feature (282)..(282): n is a, c, g, or t
tcagatagagtactcacgaccggtgctcgatttagtgtgagtagtttgggtttggggtccgagccatggtgcagactccccagagctctcctcctcctccactgcacagggtctctctcccagcctgtgctgactcaatcgccctctgcctctgcctccgtgggagctcggtcaaggtcacctgtactctgagcagtgacacagcagctacgccatcgcttggcatcagcagaggccagacgacggcctgttactgatgacagtcaacatgatggcagtcanagacgaagggggcgatccctgactcgtcttctcgacgtcctcagtctcgtcggacctgacgcacctacctcacaacttccgtcccggccttacgacgttctggacggtagtcggaggtctagtaacttacttacgtgtacgacgtaccggtgggacctacgtcggacttacgttcgtacggttccggtacgggaacccggggtaccaacgggtccgtaaccgggtcggtccggtaccaacccgggacccgaaccggtaccccaacccgtcgtccgtaccgtaccgttaccgttcccgttacccccg

SEQ ID NO: 54344 - DNA, 632 bp, Homo sapiens
  misc_feature: GYAE6OF02GEXMF.29.78.H01.1.454.CMB.1.raw
  modified_base (631)..(631): a, c, t, g, unknown or other
  misc_feature (631)..(631): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgacaaatggagagcctgagactcgacgacgacggccgtctattattgtagttaaaggcgagcgtaggaacgtacggggaccgggcccgacgttcgaccgacgtcggggccgaggggaccgcgtggtcaccgtctcctcgacgtccctccgaaccgaacgggcccacgtccggtcccttcccccgtcggccctaccctccctacccgaacgacgaccacccgtccggtcggggaccacgacgaccaccgcccgtacgggccgtcggccgttcgggtacgaacggtaccttaaccgttccgacgttaccttactacgtcgtgacggccggtcgtcggtacgacgggccgacgatagacng

SEQ ID NO: 54345 - DNA, 624 bp, Homo sapiens
  misc_feature: GYAE6OF02HOD5J.29.78.H01.1.454.CMB.1.raw
tcagatagagtactcacgaccggtgctcgatttagtgtgagtagtttgggtttggggtccgagccatggtgcagactccccagagctctcctcctcctccactgcacagggtctctctcccagcctgtgctgactcaatcgccctctgcctctgcctccgtgggaggctcggtcaaggtcacctgtactctgagcagtggacacagcagctacgccatcgcttgcatcagcagaggccagacacggcctcgttacttgatgacagtcaaacaatgatggcagtcacaggacggaagggggacggatcccgtagactcgtcttctcacgttctcgagtctcgtcgggccttaggacgccgtacctacctacgactaacgttccgtcccggccctaccgaggtctaggaggtagtgggacggtctacggtactttagttactcgtacaacggaccggttggggcctacggtcggactaacgttcggacgggttccggttaccggggaacccggggaccgtaacggtcccgtaaccgggtccggtaccggtacgtaaccggaccccgtaaccggacccctaacccgccgttaccggtaccctacctttcccgtacccgtttaccccc

SEQ ID NO: 54346 - DNA, 639 bp, Homo sapiens
  misc_feature: GYAE6OF02GQFAA.29.78.H01.1.454.CMB.1.raw
  modified_base (635)..(635): a, c, t, g, unknown or other
  misc_feature (635)..(635): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccggggcccgacttgaccacgtggggccagggggacgcgtggtcaccggtctccctcacgcctcccaccgaacgggcccatcggtcttccccctcggccaccctccctccaacgacgccaccctcgtcggggccacgacgccacgccccgtcgggccgtcggcccgttcgggtaccaaacgggtaaccttaaccgtttcccgtaacggttaccttccgttaacgttccgttacggaaccgggtccggggccgttcgggaccgtaaacggggccggaccgtaacgttacggntacg

SEQ ID NO: 54347 - DNA, 561 bp, Homo sapiens
  misc_feature: GYAE6OF02FT4I6.29.78.H01.1.454.CMB.1.raw
  modified_base (559)..(559): a, c, t, g, unknown or other
  misc_feature (559)..(559): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacggggaccggggcccgacttgaccacgtggggccaggggacgctggtcaccgtctcctcacgcctccaccaacgggcccatccggtcttccccctggccaccctcctccaacgacgccaccgtcgtggggccacgacgcacgcctgggctcgcctggtcgaacggactacttccagtactctactctgacggccggtcgtcggacgaggcgcacgtagncg

SEQ ID NO: 54348 - DNA, 606 bp, Homo sapiens
  misc_feature: GYAE6OF02F8BTI.29.78.H01.1.454.CMB.1.raw
  modified_base (604)..(604): a, c, t, g, unknown or other
  misc_feature (604)..(604): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggtcggttcaccatttccagagacaattcgaagaacacgctgtatctgcaaatggagagcctgagactcgacgacacggccgtctattattgtagttaaggcgagctggaatacggggaccgggcccgacgttcgaccacgtcggggccgaggggacgcgtaggtccaccggtctccctcacgcctccaccgacggcccactccggtccttccccgtcggccacccgtccctccaacgcgccaccctcgtcggggccacgacgcacgcccgcgggcctcgccgtcggtacgaacggtaccttaccgttaccgtacgttacctctaacttcgtacggacggccgggtcggtacggtacgaacggccggcaacgtacgncg

SEQ ID NO: 54349 - DNA, 654 bp, Homo sapiens
  misc_feature: GYAE6OF02JMY58.29.78.H01.1.454.CMB.1.raw
  modified_base (322)..(322): a, c, t, g, unknown or other
  misc_feature (322)..(322): n is a, c, g, or t
  modified_base (476)..(476): a, c, t, g, unknown or other
  misc_feature (476)..(476): n is a, c, g, or t
tcagatagagtactcacgaccggtgctcgatttagtgtgagtagtttgggtttggggtccgagccatggtgcagactccccagagctctcctcctcctccactgcacagggtctctctcccagcctgtgctgactcaatccgccctctgcctctgcctcccgtgggaggctcggtcaaggtccacctgtactctgagcagtggacacagcagctacgccatcgcttggcatcagcagacggccagacacgggcctgttactgatgacagtcaacaatgatggcagtcacgagcgaagggggacggactcctgatcgcttacncgacgtctacgacgtcgtcgtcggggcctagggacgtcccgtacctacccgtacaaccgtaacgttcccgacccggtccctaccgtacggttaccgtaggaaacggggtattcgggaaaccgggtcttacggtaaaccttacgttttaacccgnggttacccaacggggttacccgtggggtaaccctacgtcgggtactaacgtttcgaacgggttcccgttaacgggggacccgggacctaaggtccgaccgggtcgtaccgggacaccgggaacccgaacggtccccaacccgtacggtcgtaaccctaccgttctacccggttccccg

SEQ ID NO: 54350 - DNA, 519 bp, Homo sapiens
  misc_feature: GYAE6OF02FR1AS.29.78.H01.1.454.CMB.1.raw
  modified_base (375)..(375): a, c, t, g, unknown or other
  misc_feature (375)..(375): n is a, c, g, or t
  modified_base (391)..(391): a, c, t, g, unknown or other
  misc_feature (391)..(391): n is a, c, g, or t
  modified_base (495)..(495): a, c, t, g, unknown or other
  misc_feature (495)..(495): n is a, c, g, or t
  modified_base (503)..(503): a, c, t, g, unknown or other
  misc_feature (503)..(503): n is a, c, g, or t
tcagatagagtactcacgaccggtgctcgatttagtgtgagtagtttgggtttggggtccgagccatggtgcagactccccagagctctcctcctcctccactgcacagggtctctctcccagcctgtgctgactcaatcgccctctgcctctgcctccctgggaggctcggtcaaggtcacctgtactctgagcagtggacacagcagctacgccatcgcttggcatcagcagaggccagacacgggccctcgttacttgatgacagtcaacaatgatggcagtcacagcgaaggggggacggatcccgtgatcgcttctcagtctccagcctctgggcctgagcgctacctcacactcctccggcctcagtcngagatggagctgactnttactgtcagtaccgtgggcacgtgctattcgagggtccttaccgggaccggggtaccaaggtccaccggtcggtccggtcgacgacccgaaggcccaacccgntacgtccncttccgtcgttccccc

SEQ ID NO: 54351 - DNA, 606 bp, Homo sapiens
  misc_feature: GYAE6OF02H79KA.29.78.H01.1.454.CMB.1.raw
  modified_base (605)..(606): a, c, t, g, unknown or other
  misc_feature (605)..(606): n is a, c, g, or t
tcagatagagtactcacgaccggtgctcgatttagtgtgagtagtttgggtttgggggcgcctgggtacggccgggggggtcgctgagactctcctgtgcggcctctggattaagtttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggcccgtctattattgtgttaaaggcgagctggaatacggggaccgggccgacttgaccacgtgggggccaggggacgcgtggtcaccgtcctcctcagccctccaccgaacggccactccggtccttcccccgtcggcctacccctccctcccaagacgaccacctccgtcggggccacgagccacgcccgtgggcctcgccgtcggttaccgaaacggtacctaaccgtttccgacgttacctccttacttcgtacggacggccgggtccgtaggcgaacgggccgtccgaagttacggnn

SEQ ID NO: 54352 - DNA, 599 bp, Homo sapiens
  misc_feature: GYAE6OF02IJ29Q.29.78.H01.1.454.CMB.1.raw
  modified_base (380)..(380): a, c, t, g, unknown or other
  misc_feature (380)..(380): n is a, c, g, or t
  modified_base (597)..(597): a, c, t, g, unknown or other
  misc_feature (597)..(597): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacagctgtatctgcaaatggagagcctgagactcgacgacacggccgtctattattgtgttaaaggcgagctggaaatacgggaccgggcccacttgaccacgtcggggccaggggacnctggtcaccgtctcctcacgccctcaccaagggcccacgtcggtccttcccctggccaccctcctccaacgacgccacccgtctcggggccacgacgcacgcccgtgggcctcgccgtcggttacgaacggaacctaccgttccaacggttaccttaccgttacgtccgttacggaacggtccgggcgttcgggcgtaacgggcgacgtactacggncg

SEQ ID NO: 54353 - DNA, 621 bp, Homo sapiens
  misc_feature: GYAE6OF02INOPD.29.78.H01.1.454.CMB.1.raw
  modified_base (619)..(619): a, c, t, g, unknown or other
  misc_feature (619)..(619): n is a, c, g, or t
tcagatagagtactcacgaccggtgctcgatttagtgtgagtagtttgggtttgggggtcggccgtgggtacggccgggggggtcggcgtgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcacatttccagagacaattcgaagaacacgctgtatctgcaaatggagagcctgagactcgacgacacggccgtctacttattgtagttaaaggcgagcgtaggaatacgggaccgggcccgtacttgaccacgtggggaccaggggacgctggtcaccgtctcctcacgcctccaccgaaggcccagtcggtccttcccccgtcggccacccgtcctacccaagtcgcctaacctcgtcggggacctacgcgccacgcccggtagggcctcgcccgtcgggtaccaaacgggtacctaccttaccgacgttaccttacctaacgttccgtacggacggtccgggtccgtacgggacgaacgggccgacgtatacggancg

SEQ ID NO: 54354 - DNA, 585 bp, Homo sapiens
  misc_feature: GYAE6OF02FMTUE.29.78.H01.1.454.CMB.1.raw
  modified_base (543)..(543): a, c, t, g, unknown or other
  misc_feature (543)..(543): n is a, c, g, or t
tcagatagagtactcacgaccggtgctcgatttagtgtgagtagtttgggtttgggggcggcctgggtacggccgggggggtcgctcgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtagttaaaggcgagctggaatacggggaccgggcccgacttgaccacgtgggggcccagggggacgctggtcaccggtctccctcacgccctccaccaacgggcccatccggtccttccccccgtcggcccaccctccctccaacgacgccacctccgtcgggggccaccgacgccacgcccgtgggctcgcccgtggtcaaggactacgttcccagttacnctactctagacggccgggctcggcgaacggcgacgagtgatc

SEQ ID NO: 54355 - DNA, 768 bp, Homo sapiens
  misc_feature: GYAE6OF02FNJQG.29.78.H01.1.454.CMB.1.raw
  modified_base (271)..(271): a, c, t, g, unknown or other
  misc_feature (271)..(271): n is a, c, g, or t
tcagatagagtactcacgaccggtgctcgatttagtgtgagtagtttgggtttgggtgggtctctctcccacgcctgtgctgactcaatcgccctctgcctctgcctccctgggaggctcggtcgaaggtcacctgtactctgagcagtggacacagcagctacgccatcgcttggcatcagcagaggccagacacgggcctgttacttgatgacagtcaacaatgatggcagtcacaggccaagggggcggatcccgtgactcggcttcncacgtctaccgagccttcgtcgggcctggacgcgtcttacctcaacgtaattccgttacccggccttaccgaaggttcctagggtacggtaagttcgggaacggtcgttacggtaacgttaagttttaccgaggttaccgaacggttaaccccggtaggggggaccctaaccgggttcggtacgttaacgtttaccggacggggtttcccgtttaccgggggaaccccgggggtaccgttaaaacggggtcccgttaaacccgggtttcccggttacggggttacccgtaacggtacccccgtaaagggtaccccctaaaacccccggttaggttacccgttaccgtaacccttttaccgtacccggtttttaccccccgaaccccgtttccgttaccgaacgtttacccgttaccgtaaccgttaccgtacgggaacggtccccggggtaacttaccggaccgtaacgggtaccgtaccggtatacggtcagtacg

SEQ ID NO: 54356 - DNA, 638 bp, Homo sapiens
  misc_feature: GYAE6OF02G14K5.29.78.H01.1.454.CMB.1.raw
  modified_base (636)..(637): a, c, t, g, unknown or other
  misc_feature (636)..(637): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggcctctattattgtagttaaggcgagcgtggaagtaccggggaccggggcccgacgttgaccacgtggggccgaggggcgctggccaccgtcctcccgcgcgtcccacccaaccggaccggcctacggtcccgttcccccgttccccgcgacccctacccctcccgaaccgaacggccgacccttacccggtcggggtaccgggaccacgccgaccgacccggtccggtacggtccgtcggtaccgtacggaacgtaaccgtaccttacctaccgtagttcctgtacgtcggtagacgggtcgcgtacggacggtacggctaacgtgacgnng

SEQ ID NO: 54357 - DNA, 579 bp, Homo sapiens
  misc_feature: GYAE6OF02HJ62I.29.78.H01.1.454.CMB.1.raw
  modified_base (578)..(579): a, c, t, g, unknown or other
  misc_feature (578)..(579): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccggggccacgttgaccacgtggggccaggggacgctggtcaccggtctcctcacgccctccaccgaagggcccacgtccggtccttcccccgtcggccctaccctccctccaacgacgccacctcgtcggggccacgacgccacgcccgtgggcctcgccctggtacaacgggaccttaccgttccagtaccttctacttctcgacggcgggctggacgacggccgcatagnn

SEQ ID NO: 54358 - DNA, 638 bp, Homo sapiens
  misc_feature: GYAE6OF02IBS2C.29.78.H01.1.454.CMB.1.raw
  modified_base (291)..(291): a, c, t, g, unknown or other
  misc_feature (291)..(291): n is a, c, g, or t
  modified_base (381)..(381): a, c, t, g, unknown or other
  misc_feature (381)..(381): n is a, c, g, or t
  modified_base (635)..(635): a, c, t, g, unknown or other
  misc_feature (635)..(635): n is a, c, g, or t
  modified_base (637)..(637): a, c, t, g, unknown or other
  misc_feature (637)..(637): n is a, c, g, or t
tcagatagagtactcacgaccggtgctcgatttagtgtgagtagtttgggtttgggggcgcctgggtacggccggggggtcgctgagactctcctgtgcggcctcgtggagttaagtttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagctganactcgacgacacggccgtctattattgtgttaaaggcgagctggaatacgggaccgggcccgacttgaccacgtcggggccgaggggacncgtggtcaccgtcgtcctcacgccctccaacccgaacgggccccacgtccggtccctttccccccgtcgggccctaccctccctacccaacgacgccaccctcgtcggggccacgcgccacgcccgtcgggctcgcccgttcgggtaccaaacggtaccttaaccgtttcccgaacgttaccgttccttaacgttccgttacggaggtcccgggtaccgtcggaccggaaacgggcccgttacgaacgttaggngng

SEQ ID NO: 54359 - DNA, 545 bp, Homo sapiens
  misc_feature: GYAE6OF02FQA93.29.78.H01.1.454.CMB.1.raw
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccggggcccgacttgaccactggggccaggggacgctggtcaccgtctcctcagccctccaccaacgggcccatcggtcttccccctggcaccctccctccaacgacgccacctcgtgggggccacgagcagccctgggctgcctggtcaacggactacttccagtactctatctgaggcgggctggcacggcgcatagc

SEQ ID NO: 54360 - DNA, 561 bp, Homo sapiens
  misc_feature: GYAE6OF02IS73X.29.78.H01.1.454.CMB.1.raw
  modified_base (396)..(396): a, c, t, g, unknown or other
  misc_feature (396)..(396): n is a, c, g, or t
  modified_base (559)..(560): a, c, t, g, unknown or other
  misc_feature (559)..(560): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccggggcccgacttgaccacgtggggccagggggacgcgtggtcaccgtcncctcacgcctcaccgaaggcccactcggtcttccccctcggccaccctcctaccaagacgccacctcgtcggggcacacgcacgcccgtagggcctgccgtggactaaggactacttccactactactactctgacggcggcgtggcgaacggccgacatagnng

SEQ ID NO: 54361 - DNA, 550 bp, Homo sapiens
  misc_feature: GYAE6OF02GJ3P4.29.78.H01.1.454.CMB.1.raw
  modified_base (546)..(546): a, c, t, g, unknown or other
  misc_feature (546)..(546): n is a, c, g, or t
tcagatagagtactcacgaccggtgctcgatttagtgtgagtagtttgggtttggtggtctctctcccagcctgtgctgactcaatccgccctctgcctctgcctccctgggaggctcggtcaaggtcacctgtactctgagcagtggacacagcagctacgccatcgcttggcatcagcagaggccagacacgggccctcgttacttgatgacagtcaacatgatggcagtcacagcgaaagggggacggatcccgtgatccgcttctcagtctccagtctcgtgggccctgaggcgcctaccctgacaatcctccggcctccagtctgaggatgaggctgactatactgtcagacctggggcacgtggctagttcgaggttcgttacgggaccgggtactaacggtccaccggttcgtccggtcacgacccgaacggcccaacccgacgtcgtccgtaccttccgtcgttaccccacccttcctacgtacgtacctctactcgtcggacgtcggacctggaccgaacggtccgactactacgcncgtc

SEQ ID NO: 54362 - DNA, 622 bp, Homo sapiens
  misc_feature: GYAE6OF02JZDHW.29.78.H01.1.454.CMB.1.raw
  modified_base (328)..(328): a, c, t, g, unknown or other
  misc_feature (328)..(328): n is a, c, g, or t
  modified_base (382)..(382): a, c, t, g, unknown or other
  misc_feature (382)..(382): n is a, c, g, or t
  modified_base (403)..(403): a, c, t, g, unknown or other
  misc_feature (403)..(403): n is a, c, g, or t
  modified_base (618)..(618): a, c, t, g, unknown or other
  misc_feature (618)..(618): n is a, c, g, or t
tcagatagagtactcacgaccggtgctcgatttagtgtgagtagtttgggtttgggggtcggccgtgggtacggccgggggggtcggcgtggagacgtctcctgtgcggcctctggattaagttttaggagtcatgccatgaactgggtccgccaggctccgagggaaggggctggaggtgggtcgtcggctagttagtggcagtggtggcgctatatattatgcagacgccctggaagggccggttcaccgatttccagagacaagttcgaaagaacacgctgtatctgacaaatggagagcctagagactcgacgacacggccgtntattattgtagttaaaggcgagctaggaagtacgggccgggcccgagtcgaccncgtggggacccgaggggaccncgtggtaccaccgtctccgtcgacgccctaccgaccgacggccacgtccgtcctccccgtcgccaccctcctaccgaacgcgccgacctcggtcggaccacgacgccgtacgcccgtacggcctacgtccgtcggtacgacggtacttaccgtacgtacgtacttacgtacgtctacgtcggacggtcgtacggacgtacggccgtacgatacgntacg

SEQ ID NO: 54363 - DNA, 573 bp, Homo sapiens
  misc_feature: GYAE6OF02JFSWM.29.78.H01.1.454.CMB.1.raw
  modified_base (549)..(549): a, c, t, g, unknown or other
  misc_feature (549)..(549): n is a, c, g, or t
  modified_base (573)..(573): a, c, t, g, unknown or other
  misc_feature (573)..(573): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgacaaatggagagcctgagactcgacgacacggccgtctattattgtagttaaaggcgagctggaatacgggggggggaccggcccgacttcgaccacgtggggccaggggacgcgtggtcaccgtctcctcacgccctccaccacgggcccatccggtccttcccccgtggcccaccctccctaccaacgacgccaccctcgtcggggccacgacgccacgcccgtgggctcgcctcggtacaacggtacctacttccacgtctcctatctcgngccgggctggcgaggccgcatagn

SEQ ID NO: 54364 - DNA, 562 bp, Homo sapiens
  misc_feature: GYAE6OF02I3PUU.29.78.H01.1.454.CMB.1.raw
  modified_base (397)..(397): a, c, t, g, unknown or other
  misc_feature (397)..(397): n is a, c, g, or t
  modified_base (436)..(436): a, c, t, g, unknown or other
  misc_feature (436)..(436): n is a, c, g, or t
  modified_base (553)..(553): a, c, t, g, unknown or other
  misc_feature (553)..(553): n is a, c, g, or t
  modified_base (560)..(560): a, c, t, g, unknown or other
  misc_feature (560)..(560): n is a, c, g, or t
  modified_base (562)..(562): a, c, t, g, unknown or other
  misc_feature (562)..(562): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtggttaaaggcgagctggaatacggggaccgggccgacttgaccacgtggggccaggggacgcgtggtcacgtctccncagcctccaccacggcccagtcgtccttcccctcggccnccctcctaccgaacgacgccacctcgtcggggcaccagcacgcccgtgggctcgcttcggtccaaggacctaccgttcagtactctactctagtacggcgggctggaccagggccanacgttangn

SEQ ID NO: 54365 - DNA, 693 bp, Homo sapiens
  misc_feature: GYAE6OF02F6KZC.29.78.H01.1.454.CMB.1.raw
  modified_base (691)..(691): a, c, t, g, unknown or other
  misc_feature (691)..(691): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgacaaatggagagcctgagactcgacgacacggcgtctattattgtagttaaaggcgagctaggaagtacggggaccggggcccgacgttcgacccacggtcgggggaccgagggggaccgcgtcgggtaccgacccgttctcccgtaccgaccggtacccttaccccgaaccgtaaccggggacccctaacgtcccgggttccctttccccccgtcgggccctaccccgtcccgtacccaacgaccgaccgtacccgtcggtcggggaccacgacgccgacgtcccgtcgggtccgtcggccgttacgggtaccgaacggtaccttaaccgttaccgtaacgttaccttaccgtaacgttccgtacggacgggtcccgggtacgtccgggaccgaacgggccgacgtacgtacggncg

SEQ ID NO: 54366 - DNA, 566 bp, Homo sapiens
  misc_feature: GYAE6OF02FUWPJ.29.78.H01.1.454.CMB.1.raw
  modified_base (565)..(566): a, c, t, g, unknown or other
  misc_feature (565)..(566): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacggggaccgggcccgacttgaccacgtgggggccagggggacgcgtggtcaccgtctcctcacgcctccaccaacgggcccactcggtccttccccctggccaccctccctcccaacgacgccaccgtcgtcgggggccacgacgcgacgcccgtgggctcgccgtggtacaacggactacttccagtactctactctgacggcggcgtggcgacggcgcagtgnn

SEQ ID NO: 54367 - DNA, 541 bp, Homo sapiens
  misc_feature: GYAE6OF02H7LMC.29.78.H01.1.454.CMB.1.raw
  modified_base (377)..(377): a, c, t, g, unknown or other
  misc_feature (377)..(377): n is a, c, g, or t
  modified_base (393)..(393): a, c, t, g, unknown or other
  misc_feature (393)..(393): n is a, c, g, or t
  modified_base (539)..(540): a, c, t, g, unknown or other
  misc_feature (539)..(540): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccgggccacttgaccactggggccaggggacnctggtcacgtctcctnagccctccaccaaggcccatcggtccttccccgtggccaccctcctccaacgacgccaacctcgtggggcacgagcacgccctggctgctggtcaaggactactccagtactctactctcgagcgggctggcgaaggcgacatagnng

SEQ ID NO: 54368 - DNA, 560 bp, Homo sapiens
  misc_feature: GYAE6OF02IW8GW.29.78.H01.1.454.CMB.1.raw
  modified_base (559)..(560): a, c, t, g, unknown or other
  misc_feature (559)..(560): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccgggcccgacttgaccacgtgggggccagggggaccgcgtggtcaccgtctcctcacgccctccaccaacgggcccacgtccggtccttcccccgtcggccaccctcctcccaacgacgcacctcgtcggggccacacgcacgccctgggctcgcctggtcaacggactactccagtactctactctgagcggctggacgacggcgcactagnn

SEQ ID NO: 54369 - DNA, 583 bp, Homo sapiens
  misc_feature: GYAE6OF02H4CHI.29.78.H01.1.454.CMB.1.raw
  modified_base (581)..(581): a, c, t, g, unknown or other
  misc_feature (581)..(581): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccgggcccgacttgaccacgtggggccaggggacgctggtcaccgtctcctcacgcctccaccgaaggcccactcggtccttccccctcggccaccctcctcccaacgacgccacctcgtcgggggccacgacgcacgccccgtgggcctcgccgtcggtaccaacggtaaccttaccttacctacgtactcctaagttcctacgtaggccgggtcgtggcgaacggcgcatacgncg

SEQ ID NO: 54370 - DNA, 559 bp, Homo sapiens
  misc_feature: GYAE6OF02HJ9M9.29.78.H01.1.454.CMB.1.raw
  modified_base (558)..(559): a, c, t, g, unknown or other
  misc_feature (558)..(559): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccggggcccgacgttgaccactggggccaggggacgctggtcaccgtctcctcagcctccaccaagggcccatcggtcttccccctggccaccctcctccaacgacgccaaccctcgtcgggggccacgacgccacgcccctagggcctcgccctgggtcaaacgggactaccgttccagtactctatctgacgcggctggcaggcgcatagnn

SEQ ID NO: 54371 - DNA, 729 bp, Homo sapiens
  misc_feature: GYAE6OF02IAY21.29.78.H01.1.454.CMB.1.raw
  modified_base (264)..(264): a, c, t, g, unknown or other
  misc_feature (264)..(264): n is a, c, g, or t
tcagatagagtactcacgaccggtgctcgatttagtgtgagtagtttgggtttggggtccgagccatggtgcagactccccagagctctcctcctcctccactgcacagggtctctctcccagcctgtgctgactcaatcgccctctgcctctgccctccctgggaggctcggtcaaggtcacctgtactctgagcagtggacacagcagctacgccatcgcttggcatcagcagagccagacacgggcctgttactgatgacngtacaacaatgatggacagtacacgaggacggaaaggggggacggactcccgtagactccgcttctacgacgttctcccgagtctcgtcggggcctgacgccgtccttacccgtacaaccgtaacgttcccgtacccgggtccccttacccgaaggttcccgttagggaacggggtacttaggggaacgggtcctttaggtaaaccctttagttttaccgtggttaccgaacgggtacccggttggggggaccttaaccgggtcgggaccttaacggtttcggtaacggggtttcccggttaccgggggaaacccgggggtaacccttaacggggtcccgtaacccgggttccggttacccggggtaccaccccgggtaccccccggaaaacgggtcccccctaaaacccccggttgttacccgggttacccctaaccgtttcccgttcccggtttacccccccg

SEQ ID NO: 54372 - DNA, 633 bp, Homo sapiens
  misc_feature: GYAE6OF02H1F0Q.29.78.H01.1.454.CMB.1.raw
  modified_base (425)..(425): a, c, t, g, unknown or other
  misc_feature (425)..(425): n is a, c, g, or t
  modified_base (631)..(631): a, c, t, g, unknown or other
  misc_feature (631)..(631): n is a, c, g, or t
tcagatagagtactcacgaccggtgctcgatttagtgtgagtagtttgggtttgggggcgcctgggtacggccgggggggtcgctgagactctcctgtgcggcctctgattaagtttaggagtcatgccatgaactgggtccgccaggctccagggaaggggctggagtgggtctcggctattagtggcagtggtggcgctatatattatgcagacgccctgaagggccggttcacctatttccagagacaattcgaagaacacgctgtatctgcaaagtggagagcctgagactcgacgacacggccgtatatttattgtagttaaaggcgagcgtaggaagtaccggggaccggggacccgtacttcgaaccctacggtcgggggaccgagggggaccgcgtcggtaccacccgtctcccgtnacgtccctccaacccgaacgggccccgacgttccggttccctttccccccgtggtaccccacccttccctacccgaacgacgaccacccgtcggtcgggggacacgacgaccgacgcccgtcgggcgtcgtccgtcgtcgaacgtactacctccgtacgtactctactcgtggacgcggtcgtacggacgacggcgacgtacgtgntc

SEQ ID NO: 54373 - DNA, 620 bp, Homo sapiens
  misc_feature: GYAE6OF02GGLQS.29.78.H01.1.454.CMB.1.raw
  modified_base (397)..(397): a, c, t, g, unknown or other
  misc_feature (397)..(397): n is a, c, g, or t
  modified_base (616)..(616): a, c, t, g, unknown or other
  misc_feature (616)..(616): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccggggcccgattgaccacgtggggccaggggacgctggcaccgtctcctcngccctccaccgagggcccacgtccgtccttccccctcggccaccctccctaccaacgacgccaccgtccgtcgggggccaacgacgaccgacgcccgtacgggtcctcggtcccgtcgggttaccgaaacggtacttaacgtttccgaacgttaccgtccttaactccgttagacgggtccgggtccgttacgggacgaacgggccgacgtacgtacgngtac

SEQ ID NO: 54374 - DNA, 584 bp, Homo sapiens
  misc_feature: GYAE6OF02F2JZU.29.78.H01.1.454.CMB.1.raw
tcagatagagtactcacgaccggtgctcgatttagtgtgagtagtttgggtttggggtctgagagaggagtccacccctgggatcttcaggtgttttcatttggtgatcaggacggaacagagagaactcaccatggagtttgggctgagctggctttttcttgtggctattttaaaaggtgtccagtgtgacgtgcagttggtggagtctgggggcgcctggggtacggccgggggggtcgctgagactctcctgtgcggcctctggattaagttttaggagtcatgccatgaactgggtccgccaggctccgagggaaggggctgggagtggggtctcgggctagttagtggcaggtggtggcgctatatattatgcagacgcctggaacgggccggttcacctatttccagacgacaattcgaaagaacacgctgtatctgcaaagtggagagcctgagactcgacgacgacggccgtctattattgtagttaaaggcgagcgtaggaacgtaccgggggacccggggcccgacgtttacgacccgacgtcgggggcccgagggggaccgcgtggtacccg

SEQ ID NO: 54375 - DNA, 594 bp, Homo sapiens
  misc_feature: GYAE6OF02JD5O8.29.78.H01.1.454.CMB.1.raw
  modified_base (592)..(593): a, c, t, g, unknown or other
  misc_feature (592)..(593): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaagtacggggaccggggcccgacttgacccacgtcggggccaggggacgcgtggtcaccgtctcctcacgcctccaccgaacggcccagtccggtccttcccccgtcggccaccctccctacccaacgacgccaccgtcgtcgggggccacgacgccacgcccgtcgggtctcgccgtcggtcgaacggtaccttaccgttccacgtactcgtactcgtgacggcgggtcgtgggcgaacgggccgacgacgtagnng

SEQ ID NO: 54376 - DNA, 709 bp, Homo sapiens
  misc_feature: GYAE6OF02GD5ZO.29.78.H01.1.454.CMB.1.raw
  modified_base (316)..(316): a, c, t, g, unknown or other
  misc_feature (316)..(316): n is a, c, g, or t
tcagatagagtactcacgaccggtgctcgatttagtgtgagtagtttgggtttggggtccgagccatggtgcagactccccagagctctcctcctcctccactgcacagggtctctctcccagcctgtgctgactcaatcgccctctgcctctgcctccctgggaggctcggtcaaggtcacctgtactctgagcagtggacacagcagctacgccatcgcttggcatcagcagaggccagacacggcctcgttacttgatgacagtacaacaatgatggcagtcacagcgaagggggcggatcctgatcgcttcncagtctcagctcgtcgggcctggacgtccgaccttaccctacaacaacgttcccgtacccgggtcccttaccgtaacggttccgttaggaaacgggtacgttacgggaacgggtcccttaggtaaacctttaattttaacggtgttacccaaacgggtacccgggttgggggaccctaacggttcgggtactaacgttttaccggtaacgggtttccgttaccggggaaacccgggggtaacccgtaaaggggttcccgtaacccgggttaccgggttacccggggttacaaaccggggtaacccccgtaaaaccggggaccccctaaaaccccccgtggttacccggttaacccacccggttttacccgttaccccggtttaccccccccgg

SEQ ID NO: 54377 - DNA, 542 bp, Homo sapiens
  misc_feature: GYAE6OF02IU6UW.29.78.H01.1.454.CMB.1.raw
  modified_base (235)..(235): a, c, t, g, unknown or other
  misc_feature (235)..(235): n is a, c, g, or t
  modified_base (288)..(288): a, c, t, g, unknown or other
  misc_feature (288)..(288): n is a, c, g, or t
  modified_base (442)..(442): a, c, t, g, unknown or other
  misc_feature (442)..(442): n is a, c, g, or t
  modified_base (540)..(540): a, c, t, g, unknown or other
  misc_feature (540)..(540): n is a, c, g, or t
tcagatagagtactcacgaccggtgctcgatttagtgtgagtagtttgggtttggtggtctctctcccagcctgtgctgactcaatcgccctctgcctctgcctccctgggaggctcggtcaaggtcacctgtactctgagcagtggacacagcagctacgccatcgcttggcatcagcagaggccagacacgggccctcgttacttgatgacagtcaacaatgatggcagtcanagcgaagggggacggatccctgatcgcttctcagtctcagctcgtgggcctgngcgctacctcacaatcctccggcctcgagtctgagatgagctgactattactgtcagtaccgtgggctacgtggctagtcgaggtccgttacggggaccgggtaaccaagggtccaccggttcgtcggtacacgccccgaaggaccccaacccncgttcgtcctaccttccgtcgttccccgcctcctcgacgttcctctagttccgtggacggtccggacgtcgggtacgaacggccgacctagtaggctnag

SEQ ID NO: 54378 - DNA, 621 bp, Homo sapiens
  misc_feature: GYAE6OF02I9D3D.29.78.H01.1.454.CMB.1.raw
  modified_base (617)..(617): a, c, t, g, unknown or other
  misc_feature (617)..(617): n is a, c, g, or t
tcagatagagtactcacgaccggtgctcgatttagtgtgagtagtttgggtttgggtggtctctctcccagcctgtgctgactcaatcgccctctgcctctgcctccctgggagctcggtcaaggtcacctgtactctgagcagtggacacagcagctacgccatcgcttggcatcagcagaggccagacacgggccctgttacttgatgacagtcaacaatgatggcagtcacagcgaagggggacggatcccgtgactcgcttctcagtctccgagtcctcgtcgggcctggacgccgtctaccctcaacaacttccgtcccggcctcccgagttccgtaggaaggtactgggacgtcttaggaactttattaccgtgtaccgaacggtaccgtggggacctacgtggactagttcgtagggttccgttaccgggaccgggtactaacgggtcctaccggttcgtacggtaccacgtaccccgaacggtccccaaacccgtcgttaccgtcccgtaacttccggttccgttaccccgtcccttaccgtacgtaaccgttaccttcctagttccgtggtaccggcgggtacgtacgacgtacggcgataagtcggnctac

SEQ ID NO: 54379 - DNA, 613 bp, Homo sapiens
  misc_feature: GYAE6OF02HATRD.29.78.H01.1.454.CMB.1.raw
  modified_base (611)..(611): a, c, t, g, unknown or other
  misc_feature (611)..(611): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacggggaccgggcccgacttgaccacgtggggccaggggacgctggtcaccgtctcctcacgcctccaccgacgggcccacgtccggtccttccccctcggcccaccctccctcccaacgacgccacctccgtcgggggccaccgacgccacgccccgtcgggccgtcggcccgtcggtccgaaacgggaccttaaccgttccctacgttaccttaccttacgttcctaggacggtccgggcgtcgggacgacgggaccgaccgacgtaggncg

SEQ ID NO: 54380 - DNA, 645 bp, Homo sapiens
  misc_feature: GYAE6OF02IFBSO.29.78.H01.1.454.CMB.1.raw
  modified_base (327)..(327): a, c, t, g, unknown or other
  misc_feature (327)..(327): n is a, c, g, or t
tcagatagagtactcacgaccggtgctcgatttagtgtgagtagtttgggtttggggtccgagccatggtgcagactccccagagctctcctcctcctccactgcacagggtctctctcccagcctgtgctgactcaatcgccctctgcctctgcctccctgggaggctcggtcaaggtcacctgtactctgagcagtggacacagcagctacgccatcgcttggcatcagcagaggccagaccacgggccctcgttactgatgacagtcaacatgatggacagtccacgagacggaagggggaccggatcccgtgactcgtcttcncacgtcctccagtcctcgtcgggcctggacgtccgtccttaccctacaacctaactcccgtcccggcccttccgagttcgtaggacgggtagtggacggtccttacgtaacctttacgtttacgtcggtaccacggtacccggttggggacctaccgtgggtacttacgtttccgaccgggtttccgttacccggggaacccggggtaacctaaccgggttccgtaacccggttcgggtccggtacccgtacggacccccgtaacgggacccccaacccgtcgttaccgaccctaccttcccgttaccttaccccccg

SEQ ID NO: 54381 - DNA, 616 bp, Homo sapiens
  misc_feature: GYAE6OF02G04H9.29.78.H01.1.454.CMB.1.raw
  modified_base (615)..(615): a, c, t, g, unknown or other
  misc_feature (615)..(615): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaagtacgggaccggggccgacttgaccacgtcggggccaggggacgcgtggtcaccgtctcctcagccctccaaccgaacggcccactcggtaccttcccccgtcggccacccgtcctacccaacggacgccaaccgttccgtcgggggccacgagccacgaccccgtgggcctcggcccttgggtaccgaaacgggaccttaaccgttcccaagtaccttacgttacttccgtgacggccgggtccgtagggaccgaacgggtccgactacgtaggcng

SEQ ID NO: 54382 - DNA, 599 bp, Homo sapiens
  misc_feature: GYAE6OF02JHQ9A.29.78.H01.1.454.CMB.1.raw
  modified_base (384)..(384): a, c, t, g, unknown or other
  misc_feature (384)..(384): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccggggcccgacttcgaccacgtggggccagggggacncgtggtcactgtctcctcacgcctccaccaacgggcccacgtcggtcctttcccccgtcggccacccctcctcccaacgcgccacctcgtcgggggcacgacgcacgcccgtgggcctcggcccgttggtaccgaaacggtacctacgttacccacgttacctcgtacttcctggacggccgggtacgtcgggaccaagggccgacgacgtagcg

SEQ ID NO: 54383 - DNA, 494 bp, Homo sapiens
  misc_feature: GYAE6OF02F36V2.29.78.H01.1.454.CMB.1.raw
  modified_base (475)..(475): a, c, t, g, unknown or other
  misc_feature (475)..(475): n is a, c, g, or t
tcagatagagtactcacgaccggtgctcgatttagtgtgagtagtttgggtttggggtccgagccatggtgcagactccccagagctctcctcctcctccactgcacagggtctctctcccagcctgtgctgactcaatcgccctctgcctctgcctccctgggaggctcggtcaaggtcacctgtactctgagcagtggacacagcagctacgccatcgcttggcatcagcagaggccagacacgggccctcgttacttgatgacagtcaacaatgatggcagtcacagcaagggggacggatccctgatcgcttctcagtctccagctctgggcctgagcgctacctcacaatctccggcctccagtctgaggatggaggctgactattactgtcagacctggggcactggcattcaggtcttcggaccgggaccaggtcaccgtcgtcggtcacggcccaaggcccaacccnctcgtcactctcgtccccg

SEQ ID NO: 54384 - DNA, 610 bp, Homo sapiens
  misc_feature: GYAE6OF02H61FZ.29.78.H01.1.454.CMB.1.raw
  modified_base (314)..(314): a, c, t, g, unknown or other
  misc_feature (314)..(314): n is a, c, g, or t
  modified_base (392)..(392): a, c, t, g, unknown or other
  misc_feature (392)..(392): n is a, c, g, or t
  modified_base (608)..(608): a, c, t, g, unknown or other
  misc_feature (608)..(608): n is a, c, g, or t
  modified_base (610)..(610): a, c, t, g, unknown or other
  misc_feature (610)..(610): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctggaagggccggttcaccatttccagagactaattcgaagaacacgctgtatctgacaaatggagagcctgagactcgacgacacggccgtntattattgtagttaaaggcagctaggaacgtacggggaccggggcccgacgttcgaccgacgtcggggccaggggacncgtggtcaccgtctcctcacgccctaccaaccgaacgggacccacgtccggttcccgtttcccccgtcgggtcccaccctccctacccgaagacgccaccctcgtcggggcacgacgacacgcccgtgggctcgccgtcggtacgaacggtacttaaccgttaccacgttactcttacgtcgtcgacggtcggcgtggacgacggccgacgatagntn

SEQ ID NO: 54385 - DNA, 580 bp, Homo sapiens
  misc_feature: GYAE6OF02GJ1RY.29.78.H01.1.454.CMB.1.raw
  modified_base (578)..(579): a, c, t, g, unknown or other
  misc_feature (578)..(579): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacggggaccgggcccgacttgaccacgtggggccaggggacgctggtcaccgtctcctcacgcctccacaacgggcccactcggtccttcccccgtggccaccctccctccaacgacgcacctcgtcggggcacgacgccacgcccgtgggctcgccgtcgggtccgaacggtacctaccttccgagtacctctactctggacggccgggtcgtcgggacgaacgggtccgcgagtagnng

SEQ ID NO: 54386 - DNA, 570 bp, Homo sapiens
  misc_feature: GYAE6OF02F0Q9Q.29.78.H01.1.454.CMB.1.raw
  modified_base (324)..(324): a, c, t, g, unknown or other
  misc_feature (324)..(324): n is a, c, g, or t
  modified_base (330)..(330): a, c, t, g, unknown or other
  misc_feature (330)..(330): n is a, c, g, or t
  modified_base (407)..(407): a, c, t, g, unknown or other
  misc_feature (407)..(407): n is a, c, g, or t
tcagatagagtactcacgaccggtgctcgatttagtgtgagtagtttgggtttggggtccgagccatggtgcagactccccagagctctcctcctcctccactgcacagggtctctctcccagcctgtgctgactcaatcgccctctgcctctgcctcccgtgggaggctcggtcaaggtcacctgtactctgagcagtggacacagcagctacgccatcgcttggcatcagcagaggccagacacgggcctgttacttgatgacagtcaacatgatggcagtcacgaggacgaaagggggacggactcccgtgactcgcttcncagtcncagctcgtggcctgacgcgcctacctcacactccgtccggcctcgagtctaggagtatggagctagaacttattacngtacgacgtaccgtgggacctacggtggacttagttcggacggttccgtaccggggaaccgggtacctaagggtcccgaaccggttcggtaccggtaccaccggtaccccgaacggtaccccgaaccctgttaccgtaccctacgttccgtcccgttaccccc

SEQ ID NO: 54387 - DNA, 554 bp, Homo sapiens
  misc_feature: GYAE6OF02HBJ9Q.29.78.H01.1.454.CMB.1.raw
  modified_base (382)..(382): a, c, t, g, unknown or other
  misc_feature (382)..(382): n is a, c, g, or t
  modified_base (532)..(532): a, c, t, g, unknown or other
  misc_feature (532)..(532): n is a, c, g, or t
  modified_base (553)..(554): a, c, t, g, unknown or other
  misc_feature (553)..(554): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccggggcccgacttgaccactgggggccagggggacncgtggtcaccggtctccctcacgccctccaccaacgggcccatccggtcttccccctggccaccctcctccaagacgcaccctcgtgggggccacgagcagcccgtgggcctcgcctgggtccaaggactactccagtactctatctagngcgggctggcaggcgcatagnn

SEQ ID NO: 54388 - DNA, 652 bp, Homo sapiens
  misc_feature: GYAE6OF02HFG9G.29.78.H01.1.454.CMB.1.raw
  modified_base (240)..(240): a, c, t, g, unknown or other
  misc_feature (240)..(240): n is a, c, g, or t
  modified_base (362)..(362): a, c, t, g, unknown or other
  misc_feature (362)..(362): n is a, c, g, or t
tcagatagagtactcacgaccggtgctcgatttagtgtgagtagtttgggtttggggggagagaggagtccacccctgggatcttcaggtgttttcatttggtgatcaggacggaacagagagaactcaccatggagtttgggctgagctggctttttcttgtggctattttaaaaggtgtccagtgtgacgtgcagttggtggagtctgggggcgcctggggtacggccgggggggtcnctgagactctcctgtgcggcctctggattaagtttaggagtcatgccatgaactgggtccgccaggctccgaggggaaggggctgggagtgggtctcggctattaggtgcaggtggtggcgntatatattatgcagccgcctggaacgggtccgttcacctatttccagacgactaattacgaagaacacgctgtactctagacaaagtggagacgccgtagacgtacgtaccggaacgaccgaccgggtcccgttacgttaactttagtttaggttaacggttaaaacgggcgtaacgtcgtagggaacgttaccggggggacccgggggtcccgtaaccgtttcggaacccgtacgggtacgggggaccgacggggggaccgtccggtcgggttaccgacccggttcccg

SEQ ID NO: 54389 - DNA, 525 bp, Homo sapiens
  misc_feature: GYAE6OF02F32UW.29.78.H01.1.454.CMB.1.raw
  modified_base (431)..(431): a, c, t, g, unknown or other
  misc_feature (431)..(431): n is a, c, g, or t
  modified_base (440)..(440): a, c, t, g, unknown or other
  misc_feature (440)..(440): n is a, c, g, or t
  modified_base (455)..(455): a, c, t, g, unknown or other
  misc_feature (455)..(455): n is a, c, g, or t
  modified_base (503)..(503): a, c, t, g, unknown or other
  misc_feature (503)..(503): n is a, c, g, or t
  modified_base (520)..(520): a, c, t, g, unknown or other
  misc_feature (520)..(520): n is a, c, g, or t
  modified_base (524)..(525): a, c, t, g, unknown or other
  misc_feature (524)..(525): n is a, c, g, or t
tcagatagagtactcacgaccggtgctcgatttagtgtgagtagtttgggtttggggggcgcctgggtacggccggggggtcgctgagactctcctgtgcggcctctggattaagttttaggagtcatgccgatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccggggcccgacttggaccactggggccagggggacgcgtggtcaccgtctcctcagcctccacaaggccatcgtctcccctgcncctcctcangcactctggggcacngcagccctgggctcgcctggtcaaggctacttccagtactctatctgnggcggctggcaggcgcntagnn

SEQ ID NO: 54390 - DNA, 642 bp, Homo sapiens
  misc_feature: GYAE6OF02HZ0MP.29.78.H01.1.454.CMB.1.raw
  modified_base (373)..(373): a, c, t, g, unknown or other
  misc_feature (373)..(373): n is a, c, g, or t
  modified_base (637)..(637): a, c, t, g, unknown or other
  misc_feature (637)..(637): n is a, c, g, or t
tcagatagagtactcacgaccggtgctcgatttagtgtgagtagtttgggtttggtggtctctctcccagcctgtgctgactcaatcgccctctgcctctgcctccctgggaggctcggtcaaggtcacctgtactctgagcagtggacacagcagctacgccatcgcttggcatcagcagaggccagacacgggccctcgttacttgatgacagtcaacaatgatggcagtcacagcgaagggggacggatccccgtagactcgcttctcagtcctccagctcgtggggcctgagccgactacctcaacaatcctccggccttccagtctgaggatgaggtctagactattactgtacacgaccgtgggacncgtggactagttcgaggttcgttccgggaaccggggtaccaacgggtccaacccggttcggtaccggtaccaacggaccccgaaaccggacccccaaaccccgtcgttacgtacctaacccgtttccgttacccgttccccccgccccctttacgtaccgtaaccggtttacccttccttaacgttccgtacgggaacccgggtccggggtaccttaccggggaacccgtaaacggggtcccgtaaccgtaaaggttacgacgngtacg

SEQ ID NO: 54391 - DNA, 709 bp, Homo sapiens
  misc_feature: GYAE6OF02H14E0.29.78.H01.1.454.CMB.1.raw
tcagatagagtactcacgaccggtgctcgatttagtgtgagtagtttgggtttggggggaagaggaagactgacggtccacccctgggatcttcaggtgttttcatttggtgatcaggacggaacagagagaactcaccatggagtttgggctgagctggctttttcttgtggctatttttaaaaggtgtccagtgtgacgtgcagttggtggagtcgtgggggcgccgtggggtaccgggccgggggggtcgctgagactctcctgtcgcggcctctggattaagtttaggatcatgccatgaactgggccgcaggctccgagggagggctgggaggtgggtctcggctagttaggtggcaggtggtggcgctatatattatgcaggaccgccgtggaacgggtccgttacacctattccgagacgactaattccgaaagaaccacgtacttgtatcctagactaaagttgggactacgcccttaggacgtaaccgtcggaacccgtaaccgacccgggtacccgttacgttaacgttttaagtttcggttaacgggtttaaaacgggccggttaaggtaccgtttaagggggaaaccggtttacccggggggaccccggggggtacccgttaaccgttaacggaccccggtaacggttccgggggggaacccgtaacgggggggaccctccgggttacgggtacccg

SEQ ID NO: 54392 - DNA, 653 bp, Homo sapiens
  misc_feature: GYAE6OF02JBT4I.29.78.H01.1.454.CMB.1.raw
tcagatagagtactcacgaccggtgctcgatttagtgtgagtagtttgggtttgggggtcggccgtgggtacggccggggggtcggcgtgagactctcctgtgcggcctctggattaagtttaggagtcatgccatgaactggtccgccaggctccagggaaggggctggagtgggtctcggctattagtggcagtggtggcgctatatattatgcagacgccctgaagggccggttcaccatttccagagacaattcgaaagacacgctgtatctgcaaaatggagagcctgagactcgaacgacacggcgtctatacttgtagttaaaggcgagctggaatacgggacccgggccacgttgaaccacgtgggccagggcgctggccacggtctccgtcacgtcctccgaacgtaacggcccacgtccggtaccttcccccgtacggcctaccctccctacccgaaccgacgtaccaacccttccgtacgggggtaccctaaccgtacgccgtaaccggccccgtagggcccgtcggaccgtacggttccgaacggtacctaaccgttccgaacgttaccgttacgtactaaccgttgtacggtaccgggccttagggcccgttaagggaccggacgtaaccgtagcctacg

SEQ ID NO: 54393 - DNA, 567 bp, Homo sapiens
  misc_feature: GYAE6OF02JDC5R.29.78.H01.1.454.CMB.1.raw
  modified_base (380)..(380): a, c, t, g, unknown or other
  misc_feature (380)..(380): n is a, c, g, or t
  modified_base (437)..(437): a, c, t, g, unknown or other
  misc_feature (437)..(437): n is a, c, g, or t
  modified_base (565)..(565): a, c, t, g, unknown or other
  misc_feature (565)..(565): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccgggcccgacttgaccactgggggccagggggacnctggtcaccgtctcctcagccctccaccgagggcccagtccgtcttcccccgtgccnccctcctccaagcgccaccgtcgtcggggcacgacgcacgcccgtagggcctcgccgtcggtcaaggacctaccttccacgttacctctacgtctagacggccgggtctggcgaggccgacgagtagncg

SEQ ID NO: 54394 - DNA, 571 bp, Homo sapiens
  misc_feature: GYAE6OF02GP1P1.29.78.H01.1.454.CMB.1.raw
  modified_base (320)..(320): a, c, t, g, unknown or other
  misc_feature (320)..(320): n is a, c, g, or t
  modified_base (327)..(327): a, c, t, g, unknown or other
  misc_feature (327)..(327): n is a, c, g, or t
  modified_base (379)..(379): a, c, t, g, unknown or other
  misc_feature (379)..(379): n is a, c, g, or t
  modified_base (385)..(385): a, c, t, g, unknown or other
  misc_feature (385)..(385): n is a, c, g, or t
tcagatagagtactcacgaccggtgctcgatttagtgtgagtagtttgggtttggggtccgagccatggtgcagactccccagagctctcctcctcctccactgcacagggtctctctcccagcctgtgctgactcaatcgccctctgcctctgcctccctgggaggctcggtcaaggtcacctgtactctgagcagtggacacagcagctacgccatcgcttggcatcagcagaggccagacacgggccctgttacttgatgacagtcaacaatgatggcagtcacgagacgaaggggggacgatccctgatcgcttcncgagtcncagctcgtgggcctgagccgctaccctcacactccgtccggcctccgagtcnggagtntggacggtctagtacttattcgtgtacgacgccggtgggccacgtggcttagttcgacgggttccgtacgggacccgggacgtaacggtccgacccggttccggtacggtaccaaccggtaccccgaaaccgggcccccaaaccccgtcgttaccgtaccctaccgtttccgtcccggttcccccc

SEQ ID NO: 54395 - DNA, 723 bp, Homo sapiens
  misc_feature: GYAE6OF02G9BDW.29.78.H01.1.454.CMB.1.raw
  modified_base (351)..(351): a, c, t, g, unknown or other
  misc_feature (351)..(351): n is a, c, g, or t
tcagatagagtactcacgaccggtgctcgatttagtgtgagtagtttgggtttggggtctgagagaggagtccacccctgggatcttcaggtgttttcatttggtgatcaggacggaacagagagaactcaccatggagtttgggctgagcgtggtcttttctagtggctaattttaaaaggtgtccagtgtgacgtgcagttggtggagtcgtgggggcgccgtggggtaccgggccgggggggtcgcgtgagactctcctgtgcggccctgtggtattaagttttaggagtcatgccatgaacgtggtcccgccgaggcctccggaggggaagggcgtggagtgggtcncggacttaattagtggcaggtggtggcgctattataattatgacgagacccgccgtaggaaggggtccgttacacctagtttccagagaactaaagttcgaaagtaaccacgacgttataacgtctacgtacaaagttagggagtacgacctaggaaggtccctacggaacgaccgacgggtacccttagtttaaagtttccgtttaaggttaacggttaaaacgggacgtaacgggtaccgttaaggggtaaaaccggttaaccccggggggacccggggtaacccgttaacccgttacgggaaacccccgacgggtttacccggggggacccgaaacggggggtaccgttaccgggtaccgtaaccccgg

SEQ ID NO: 54396 - DNA, 547 bp, Homo sapiens
  misc_feature: GYAE6OF02HE2OX.29.78.H01.1.454.CMB.1.raw
  modified_base (547)..(547): a, c, t, g, unknown or other
  misc_feature (547)..(547): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccaccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccgggcccgacttgaccacgtggggccagggggacgctggtcaccgtctcctcagcctccaccaaggcccatccggtccttccccctggccaccctccctccaacgacgccacctcgtggggcacgagcacgcccgtgggcctcgccgtggtcaacggactactccagtactctatctgacgcggcgtggcgaggcgcatagn

SEQ ID NO: 54397 - DNA, 901 bp, Homo sapiens
  misc_feature: GYAE6OF02JQUO8.29.78.H01.1.454.CMB.1.raw
tcagatagagtactcacgaccggtgctcgatttagtgtgagtagttgggtttggggtcgtgagagaggagtccaccctgggatcttcgaggtgttttctatttggtgtatcaggacggaacagagagaactcaccatggagtttgggctgagcgtggcttttctggtggctattttaaaggtgtccagtgtgacgtgcagttggtggagtctgggggcgccgtggggtacgggccgggggggtcgcgtaggaggtactcgtccgtggtcgccgggtcctcgtaggatttaaaggttttaggacgttctaagttcggaccctagttacggtaaaccgttcgggggtacccgccgacgggtaccttacccggaaggggggaaacggggggtccgtaggggtaaggggttcggggttaccggttccgggtaccgtttaaggtttacgggttcggggtaccgtaagggtttgggggttcggggacccggtacggtttaagttagttaagttttaacgtgggaaccgtaggtaaccgggccccgttaggggaaaccgggggtcccgttttaccgaaaccgtacgttttcccgaaggtaacgtaaccctaaacggtttcggaaaacgttaaaccgaccccgtaggttgtaaaccttacgtacgaacttaaaacggtggggaaacggtacgtcccgttaaggaaccgtaaaccggtttaccggaaccggtaaccgacccggggtacccgttaaacctttaatttaaccgggtttggttaaaaccgggttaaggaaccggtgacgtttaagggaaccgggttaacccgggggacccggtacccgtaccgttaacggaccgtaacgggtcggggaccccggacgggtaacggtccgttcgggtaaccccg

SEQ ID NO: 54398 - DNA, 436 bp, Homo sapiens
  misc_feature: GYAE6OF02IIJ9A.29.78.H01.1.454.CMB.1.raw
  modified_base (251)..(251): a, c, t, g, unknown or other
  misc_feature (251)..(251): n is a, c, g, or t
  modified_base (433)..(436): a, c, t, g, unknown or other
  misc_feature (433)..(436): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgcaggctccagggaaggggctggagtgggtctcggctattagtggcagtggtggcgctatatattatgcagaccgcctaggaacgggccgttcacctatttccaganaacaattcgaagaacacgctagtatctgacaaatggagagcctgagactcgacgacacggcccgtctattattgtagttaaaaggcgagctaggaaatacggggacccgggcccgtacttgacctaacggtggggaccgaaggggaccgcgtggtccaccgtctccctcacgccctacccgnnnn

SEQ ID NO: 54399 - DNA, 563 bp, Homo sapiens
  misc_feature: GYAE6OF02FK0ZT.29.78.H01.1.454.CMB.1.raw
tcagatagagtactcacgaccggtgctcgatttagtgtgagtagtttgggtttggggtctgagagaggagtccacccctgggatcttcaggtgttttcatttggtgatcaggacggaacagagagaactcaccatggagtttgggctgagctggctttttcttgtggctattttaaaaggtgtccagtgtgacgtgcagttggtggagtctgggggcgcctggggtacggccgggggggtcgctgagactctcctgtgcggcctctgggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacgacggccgtcgtatttattgtagttaaaggcgtagctggaagtacgggaccggggcccgacgttgaccgacgtggggcccgagggggaccgcgtggtaccg

SEQ ID NO: 54400 - DNA, 740 bp, Homo sapiens
  misc_feature: GYAE6OF02JJOZI.29.78.H01.1.454.CMB.1.raw
tcagatagagtactcacgaccggtgctcgatttagtgtgagtagtttgggtttggggtccgagccatggtgcagactccccagagctctcctcctcctccactgcacagggtctctctcccagcctgtgctgactcaatccgccctctgcctctgccctcccgtgggaggctcggtcaaggtcacctgtactctgagcagtggacacagcagctacgccatcgcttggcatcgagcagacggccagaccgacggccctagttacttgatgactacgtacaaacaagtggaagtggacctagtaccaacgaacggtaccgggaaaaggggggggaccggtaacttccccgtaggtacgttccggtacctttaccgtaccgaacggttccctaccgaacgttccgttaccggtcggggtcccttagggaaccgtcccggtaccctaacccttacaaacgtaaccgttccccggtacccggtacccttaccggtaacggttccgttagggaacgggtacgtcgggaaccggtctacggttaactttaacttacggttcgaacgacggtacccgggtgggaccctacggttacgggacttaccggttacggtaccggttccggtaacccggggaccgggtaactaccgggtacccttaccggggtcccggttcggaccaaccgggaccccggtaacggccccctaaaccgtcgtccgtacctaccgttccctacccgttacccc

SEQ ID NO: 54401 - DNA, 770 bp, Homo sapiens
  misc_feature: GYAE6OF02H7RGT.29.78.H01.1.454.CMB.1.raw
  modified_base (768)..(769): a, c, t, g, unknown or other
  misc_feature (768)..(769): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgcaggctccagggaagggctggagtgggtctcggctattagtggcagtggtggcgctatatattatgcagacgccctgaagggccgttcaccatttccagagacaattcgaagaacacgctgtatctgacaaagtggagacgcctaggacgactacgacgaaccgacggcccgttacttatttagttgtagttaaaggcgaagcgtagggaaacgtacccgggggacccggggtaccccgtacgttacgacccgtacggtacggggggacccgtaggggggaccgtaccggttacgggttacccacccggttccttccccgtacgaccggtacccccgttacccaacccggaaaccggggtccccgtaacggtttccccgggtttacccctttccccccggtacgggtcccctaacccccttccccgtaacccgaacgtaccgtaccgtacccgtttaccggcgggggtacccacgacggaccgacggtaccccgtcggggccttccggccgtacgggttaaccgaaacggaacctttaaccgtccgtaacgttaccgttactttacgtacggttaggccgggaccgggtccggtacggacggtaacggcgttaccgaagtacgnng

SEQ ID NO: 54402 - DNA, 618 bp, Homo sapiens
  misc_feature: GYAE6OF02GQCKF.29.78.H01.1.454.CMB.1.raw
  modified_base (615)..(615): a, c, t, g, unknown or other
  misc_feature (615)..(615): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattatgtgttaaaggcgagctggaagtacgggaccggggcccgacttgaccacgtcggggccgaggggacgcgtcggtcaccgtctccctcacgccctacccaaccgaacgggcccacgtccggtcccttcccccgtcggcccacccctccctcccaacgacgccaccctcgtcggggccacgacgccgacgcccgtcgggccgtcgcccgttcggtaccgaacggtacctaccttaccgacgttaccttccttacgtcgtacgacggtccgggtcgtcggacgaacgggccgacgagtacgntcg

SEQ ID NO: 54403 - DNA, 620 bp, Homo sapiens
  misc_feature: GYAE6OF02JYG73.29.78.H01.1.454.CMB.1.raw
  modified_base (618)..(618): a, c, t, g, unknown or other
  misc_feature (618)..(618): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtagttaaaggcgagctaggaatacgggaccgggcccgacttcgaccacgtcggggccaggggacgcgtcggtcaccgtctccctcacgccctccaccgaacgggacccacgtccgtccgttcccccgtcggccaccctcctccacgacgccaccgtcgtcggggcacgacgccgacgcccgtcgggtccgtcgtccgtcggtaccgaacggtaccgttaaccttacccgtacgtacgttaccgttacgtccgtacggacggtccgggtcgtacggacgaacggccggacgtacgtagtncg

SEQ ID NO: 54404 - DNA, 607 bp, Homo sapiens
  misc_feature: GYAE6OF02JWTHP.29.78.H01.1.454.CMB.1.raw
  modified_base (286)..(286): a, c, t, g, unknown or other
  misc_feature (286)..(286): n is a, c, g, or t
tcagatagagtactcacgaccggtgctcgatttagtgtgagtagtttgggtttgggggcgcctgggtacggccggggggtcggctgagactctcctgtgcggcctctggattaagttttaggagtcatgccatgaactgggtccgccaggctccagggaaggggctggagtgggtcgtcggctattagtggcagtggtggcgctatatattatgcagacgccctgaagggccgttcaccatttccagagacaattcgaagaacacgctgtatctgcaaagtgaganctgagactcgacgacacggcctctattatgtagttaaggcgagctaggaatacgggaccgggtaccgagttcgaccgacgtggggacccgaaggggaccgcgtaggtccgaccgttcctccgtaccacgtccctaccgaaccgacgggcccacgtccggtcccttccccgtcggcccacccgtccctaccaacgtacgcctacctcggtcggggaccacgcgaccgacgccgtcggctcgccgtcgtacgaacgtactacctcgtacgtactacttactcttacgcggtacggcgtcggacgacggcgacgtactagactg

SEQ ID NO: 54405 - DNA, 531 bp, Homo sapiens
  misc_feature: GYAE6OF02G5CPI.29.78.H01.1.454.CMB.1.raw
  modified_base (378)..(378): a, c, t, g, unknown or other
  misc_feature (378)..(378): n is a, c, g, or t
  modified_base (505)..(505): a, c, t, g, unknown or other
  misc_feature (505)..(505): n is a, c, g, or t
  modified_base (522)..(522): a, c, t, g, unknown or other
  misc_feature (522)..(522): n is a, c, g, or t
  modified_base (530)..(531): a, c, t, g, unknown or other
  misc_feature (530)..(531): n is a, c, g, or t
tcagatagagtactcacgaccggtgctcgatttagtgtgagtagtttgggtttgggggcgcctgggtacggccgggggggtcgctgagactctcctgtgcggcctctggattaagtttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaaatggagagcctgagactcgacgacacggccgtctattattgtgttaaaggcgagctggaatacgggaccgggcccgattgaccactggggccaggggacnctggcaccgtctcctcagcctccaccaagggcccatcgtctcccctgcacctcctcaagagcacctcgtggggcacacgcagcccgtgggcctgcctggtcaaggctaccttcagtacctctagtcngagcggctggcaacggngcatacgnn

SEQ ID NO: 54406 - DNA, 653 bp, Homo sapiens
  misc_feature: GYAE6OF02I9R2M.29.78.H01.1.454.CMB.1.raw
  modified_base (183)..(183): a, c, t, g, unknown or other
  misc_feature (183)..(183): n is a, c, g, or t
  modified_base (219)..(219): a, c, t, g, unknown or other
  misc_feature (219)..(219): n is a, c, g, or t
  modified_base (357)..(357): a, c, t, g, unknown or other
  misc_feature (357)..(357): n is a, c, g, or t
  modified_base (454)..(454): a, c, t, g, unknown or other
  misc_feature (454)..(454): n is a, c, g, or t
  modified_base (591)..(591): a, c, t, g, unknown or other
  misc_feature (591)..(591): n is a, c, g, or t
tcagatagagtactcacgaccggtgctcgatttagtgtgagtagtttgggtttggggtctgagagaggagtccacccctgggatcttcaggtgttttcatttggtgatcaggacggaacagagagaactcaccatggagtttgggctgagcggtcgtcgtttctaggtggctaatttaaaggntcagtgtgagtgcagttggtggagtcgtgggggccnccgtagggtaccgggccggggggtcactggcgactcgtcctggtcgccggtaccctgtaggtaatttaaggttttaggattacagtgaccagtcgaacgtcgggtcccgaccgtaggtctaccggaggggtaacgggngttaggaggttcgggtctcgggtcttaaggttggaggcgtaggtgggtggcctaatagtattattagcgcaacgccgccgtagggaacggtcccgtnaccgtattaccgagacgtacaagttacgaaagacctaacggcttagtacctgacgaataaggttggacgacggtacctagacgacctaggacaccgtacgtccgttattacgttacgtagtacggttaagcgtacgngtaggacggtaccgggaccgtcgtagtcgaccggtaggtcggaccgagggcctggtactccg

SEQ ID NO: 54407 - DNA, 588 bp, Homo sapiens
  misc_feature: GYAE6OF02GBNZR.29.78.H01.1.454.CMB.1.raw
  modified_base (586)..(586): a, c, t, g, unknown or other
  misc_feature (586)..(586): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgtaaaggcgagctggaatacggggaccggggccacgttgaccacgtggggccaggggacgctggtcaccgtctcctcacgccctccaaccgacgggcccacgtccggtccttcccccgtcggcctaccctccctaccaacgacgccaccgtccgtcggggccacgacgcacgcccgtgggcctcgccgtggtaccaaggtacttaccgttccaacgttcctactacgttctgacggtccggcgtcggacgacggccgacgactaggncg

SEQ ID NO: 54408 - DNA, 609 bp, Homo sapiens
  misc_feature: GYAE6OF02GWYU4.29.78.H01.1.454.CMB.1.raw
  modified_base (450)..(450): a, c, t, g, unknown or other
  misc_feature (450)..(450): n is a, c, g, or t
tcagatagagtactcacgaccggtgctcgatttagtgtgagtagtttgggtttggggtctgagagaggagtccacccctgggatcttcaggtgttttcatttggtgatcaggacggaacagagagaactcaccatggagtttgggctgagctggctttttcttgtggctattttaaaaggtgtccagtgtgacgtgcagttggtggagtctgggggcgcctgggtacggccgggggggtcgctgagactctcctgtgcggcctctggattaagtttaggagtcatgccatgaactgggtccgccaggctccgagggaaggggctggagtgggtctcggctagttaggtggcaggtggtggcgctatatattatgcagacgccctggaacgggccgttcacctatttccagagacaattcgaagaacacgctgtatctagacaaagtgganagccgtagagaccgtcggaaccgacgaccggccgtactactttacgttggtacgttaaacgggcgaggtcgtagggaacgtaaccgggggacccgggtacccgtacgttacggaacccgtacggtcggggcccgaagggggaccgccgttaggtacccg

SEQ ID NO: 54409 - DNA, 590 bp, Homo sapiens
  misc_feature: GYAE6OF02JPFO1.29.78.H01.1.454.CMB.1.raw
  modified_base (387)..(387): a, c, t, g, unknown or other
  misc_feature (387)..(387): n is a, c, g, or t
  modified_base (543)..(543): a, c, t, g, unknown or other
  misc_feature (543)..(543): n is a, c, g, or t
  modified_base (588)..(588): a, c, t, g, unknown or other
  misc_feature (588)..(588): n is a, c, g, or t
  modified_base (590)..(590): a, c, t, g, unknown or other
  misc_feature (590)..(590): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtaatctgcaaatggagagcctgagactcgacgacacggccgtactattattgtagttaaaggccgagctaggaatacggggaccgggccgacgttcgaccacgtggggccaggggacncgtggtcaccggtctccctcgacgccctccacgaacgggcccagtccggtccttcccccgtggccctacccgtccctccaacgacgtccaacctcgtacggggcacgacgcacgccctcggctcgccgtgtacaacggctacgttccgataccgtntacgtctagacggtccggcgtacggcgtaacggccgacgagtagngn

SEQ ID NO: 54410 - DNA, 580 bp, Homo sapiens
  misc_feature: GYAE6OF02F9BOI.29.78.H01.1.454.CMB.1.raw
  modified_base (579)..(579): a, c, t, g, unknown or other
  misc_feature (579)..(579): n is a, c, g, or t
tcagatagagtactcacgaccggtgctcgatttagtgtgagtagtttgggtttgggggcgcctgggtacggccgggggggtcgctgagactctcctgtgcggcctctggattaagtttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccggggcccgattgacccacgtggggccgaggggacgcgtgggtctaccgtctccgtcacgccctccaaccgaacggcccacgtccggtccttcccccgtcggccacccctcctaccaacgacgcctaacctcgtcggggccaacacgccacgcccgtgggctcgccgtggtacaacggtacctacgttccagtactctacgtctggacggtcggcgtggacacggccacgatgnc

SEQ ID NO: 54411 - DNA, 592 bp, Homo sapiens
  misc_feature: GYAE6OF02F2062.29.78.H01.1.454.CMB.1.raw
  modified_base (242)..(242): a, c, t, g, unknown or other
  misc_feature (242)..(242): n is a, c, g, or t
  modified_base (511)..(511): a, c, t, g, unknown or other
  misc_feature (511)..(511): n is a, c, g, or t
tcagatagagtactcacgaccggtgctcgatttagtgtgagtagtttgggtttggggtctgagagaggagtccacccctgggatcttcaggtgttttcatttggtgatcaggacggaacagagagaactcaccatggagtttgggctgagcgtgcgttttctaggtggctattttaaaaggtgtccagtgtgacgtgcagttggtggagtctgggggcgcctggggtacggccgggggggtnctgagactctcctgtgcggcctctggatttaagttttggagtcatgccatgaactgggtccgcaggctccgagggaaggggctggagtgggtctcggctattagtggcaggtggtggcgctagtatattatgcagaccgcctaggaacgggtcccggttcacctacgtttcccaagagaacaacttacgaaagaacacgctagtatctgacaaagtggagagcctgacgactacgacgacgacgccgtctagttattcgtagttaacgngagtcgtaggtaagtaccggggaccgggacccggtacgttcgaccgtacgtcggggaccgaggggacgtcgtcggtacccg

SEQ ID NO: 54412 - DNA, 596 bp, Homo sapiens
  misc_feature: GYAE6OF02JQA03.29.78.H01.1.454.CMB.1.raw
  modified_base (241)..(241): a, c, t, g, unknown or other
  misc_feature (241)..(241): n is a, c, g, or t
  modified_base (450)..(450): a, c, t, g, unknown or other
  misc_feature (450)..(450): n is a, c, g, or t
  modified_base (514)..(514): a, c, t, g, unknown or other
  misc_feature (514)..(514): n is a, c, g, or t
  modified_base (567)..(567): a, c, t, g, unknown or other
  misc_feature (567)..(567): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcacctntttccagagacaattcgaagaacacgctgtatctgacaaagtggagacgcctgagactcgacgacacggccgtctattatgtagttaaaggcgagctaggaacgtacgggaccgggccgtactgaccacgtggggccaggggacgcgtggtcgaccgtctcctcacgcctacccacgaaccgggcccacgtccggtacctttcccccgnggacccacccgtaccctaccaacgacgcctacccgtcgtacgggccacgacgcacgccgtggcncgccgtgacgacgactacctctagtaccttctaacgtccacggtacggccggngtcggacgtaacgggccacgataggctcg

SEQ ID NO: 54413 - DNA, 589 bp, Homo sapiens
  misc_feature: GYAE6OF02I4XQ8.29.78.H01.1.454.CMB.1.raw
  modified_base (588)..(588): a, c, t, g, unknown or other
  misc_feature (588)..(588): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccggggcccgacttgaccactgggggccaggggaccgcgtggtcaccggtctcctcacgcctccaccaaggcccatccggtcttccccctcggccaccctccctccaacgacgccaacctcgtcgggggccacgacgcacgcccgtcgggctcgccgtcggtccgaaacggaccttaaccgttccaacgttaccttcttactccgttaggacggccgggcgtcggcgaacggccgacagtagnc

SEQ ID NO: 54414 - DNA, 663 bp, Homo sapiens
  misc_feature: GYAE6OF02HALZV.29.78.H01.1.454.CMB.1.raw
tcagatagagtactcacgaccggtgctcgatttagtgtgagtagtttgggtttggggtccgagccatggtgcagactccccagagctctcctcctcctccactgcacagggtctctctcccagcctgtgctgactcaatccgccctctgcctctcgccctcccgtggggaggctcggtcaaggtccacctgtactctgagcagtggacacagcagctacgccatcgcttggcatcagcagacggccagacgaccgggccctacgttacttgatgacacgtacaaacaatgatggacagtacacgaggacgggaaacggggggaccggtactcccgtaggactcgtaccttctacgtacgtcctacgacgtccgtcggtcgggtcctagggacgtcccgtacctaccctacaaccgtaacgttcccgtccccggtcctaccgtacgttcgtagggacggtacgtcgggtacggcttacggttaacttacgttacgtcggtacctacgggtccggtggggacctaccggtggacttacgtcgtacgggttccggtacccgggaaccgggaccgtacggtccgtaccggtacggtccggaccgaccggaccccgaacggacccctaaccgtcgtaccgtcccttacgtcccttacccgtacccccg

SEQ ID NO: 54415 - DNA, 670 bp, Homo sapiens
  misc_feature: GYAE6OF02HZ2T4.29.78.H01.1.454.CMB.1.raw
  modified_base (244)..(244): a, c, t, g, unknown or other
  misc_feature (244)..(244): n is a, c, g, or t
tcagatagagtactcacgaccggtgctcgatttagtgtgagtagtttgggtttggggtctgagagaggagtccacccctgggatcttcaggtgttttcatttggtgatcaggacggaacagagagaactcaccatggagtttgggctgagctggctttttcttgtggctattttaaaaggtgtccagtgtgacgtgcagttggtggagtctggggggcgcctggggtacgggccgggggggtcnctgagactctcctgtgcggcctctggatttaagttttaggagtcatgccatgaactgggtccgccaggctccgaggggaagggctggagtggtctcggctattagtggcaggtggtggcgctatatattagtgcagaccgcccgtggaacgggtccgttcacctatttaccagacgacaattacgaaagaaccacgtctagtatctgacaaagtggagacgtcctagacgacgtacggtaaccgaaccgtaccgggtacccgttacttaagttttaacgtttgggtttaaacggttaaacggggtcgtaggtacgtaggggtaaccggtaaccggggggaccccgggggtcccgtaacgtttaccggaacccgtacgggtacgggggaccccggtaaggggggacctccggttagggtaaccccgg

SEQ ID NO: 54416 - DNA, 716 bp, Homo sapiens
  misc_feature: GYAE6OF02I131U.29.78.H01.1.454.CMB.1.raw
  modified_base (246)..(246): a, c, t, g, unknown or other
  misc_feature (246)..(246): n is a, c, g, or t
tcagatagagtactcacgaccggtgctcgatttagtgtgagtagtttgggtttggggtctgagagaggagtccacccctgggatcttcaggtgttttcatttggtgatcaggacggaacagagagaactcaccatggagtttgggctgagcgtggtcttttcttggtggctaagttttaaaaggtgtccagtgtgacgtgcagttggtggagtcgtggggcgccgtgggtacgggccggggggtcnctgagactctcctgtcgcggcctcgtggtatttaaggtttaggagtcatgccatgaacgtcgggtccgcaggcctccggaggggaacggggtctgggaggttgggtctcggtactagttaggtgggctaggtgggtggcgtactagtatattacgtcgactacggaccgtcccgtaggaacggggtccgttacaccgttactttccgaagtacgactaaacgttcggaaaacgaaaccgtacgtcttagtactcgtagacgtaaagtggacgtacgtaccgtgaaacgtaccgtacgggaacccgaccgtaaccgggtcccgttaatttacgtttaactttagggtacggttaaacgggccgagtacgtaacgggtaacggtaacccgggggtacccgggtaccccgtaagttaccggaccctacggggtaccgggggaccggtaacggggtccgtccggtggtaccccg

SEQ ID NO: 54417 - DNA, 688 bp, Homo sapiens
  misc_feature: GYAE6OF02GQNML.29.78.H01.1.454.CMB.1.raw
tcagatagagtactcacgaccggtgctcgatttagtgtgagtagtttgggtttggggtctgagagaggagtccacccctgggatcttcaggtgttttcatttggtgatcaggacggaacagagagaactcaccatggagtttgggctgagctggctttttcttgtggctattttaaaaggtgtccagtgtgacgtgcagttggtggagtcgtgggggcgcctggggtacgggccgggggggtcgctgagactctcctgtgcggcctctggattaagttttaggagtcatgccatgaactgggtccgccaggctccgaggggaaggggctggagtgggtctcggcttagttggtggcaggtgggtggcgctatatattatgacagccgccctaggaacgggtccgttacacctatttcccgaagacgactaagttacgaaagaacacgctagtactcagacaaagtggagacgcctagacgtaccgtacggaaccgaccgaccggggtcccgtttacttaagttttacgtttacggttaagggtttaaaacgggccggtaggtacgttaggggaaccggttaacccgggggggaaccccggggtaccccgtaacctttaaacccggaccgggttcggggggaccccggaaggggggtacccgtcggttaccggggtaccctaccccggg

SEQ ID NO: 54418 - DNA, 598 bp, Homo sapiens
  misc_feature: GYAE6OF02HRO5P.29.78.H01.1.454.CMB.1.raw
  modified_base (596)..(597): a, c, t, g, unknown or other
  misc_feature (596)..(597): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacggggaccgggcccgacttcgaccacgtggggccaggggacgctggtcaccgtctcccgtcacgccctccaaccgaacgggcccacgtccggtccttccccccgtggccaccctccctacccaacgacgccaccctccgtcgggggccaccgacgccgacgccccgtgggccgtcgccgtcggtcaacggacctaccttccagttacctacttactcgtaggacggcgggtcgtcggacgaacggccgacgatagnng

SEQ ID NO: 54419 - DNA, 756 bp, Homo sapiens
  misc_feature: GYAE6OF02HSFJV.29.78.H01.1.454.CMB.1.raw
  modified_base (752)..(752): a, c, t, g, unknown or other
  misc_feature (752)..(752): n is a, c, g, or t
  modified_base (755)..(755): a, c, t, g, unknown or other
  misc_feature (755)..(755): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacgacggccgtactattattgtagttaaaggcgagcgtaggaaagtaccggggaccggggaccccgtacgttcgaacccaacgtcgggggacccgaagggggaccgcggtacggtccgacccggttcctccctcgaacgccccttaccaacccgaaccggggcccctaacgttcccgggttcccctttacccccccgtcgggaccctaacccccgttcccgttaacccgaaacggaaccgcccgtaaccccgttcggttaccgggggggaccctacgaaccggcccggggtcccccgtcgggggtacccttccggccccggttcgggtacccggtaaaacgggtacccgttaacccgtttacccgtaacgggttacccttccgttaacgttccgttaacggaccgggtccgggtacgttcgggaccgaacgggtccgaccgtaaggtacggngcng

SEQ ID NO: 54420 - DNA, 588 bp, Homo sapiens
  misc_feature: GYAE6OF02ILPE9.29.78.H01.1.454.CMB.1.raw
  modified_base (586)..(586): a, c, t, g, unknown or other
  misc_feature (586)..(586): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaaatggagagcctgagactcgacgacacggccgtctattattgtagttaaaggcgagctggaagtacgggaccggggcccgacttcgaccacgtggggccgaggggacgctggtcaccgtctcctcacgccctccaccgaaggcccacgtccggtccttcccccgtcggccaccctcctaccaacgacgcacctcgcggggccacacgcgacgcccgtggcctcgccgtggtaccaacggtacctacgttcctacgtacctctacgtctaggacggccgggtcgtcggacgaacgggcgacgagtaggncg

SEQ ID NO: 54421 - DNA, 638 bp, Homo sapiens
  misc_feature: GYAE6OF02IZAW7.29.78.H01.1.454.CMB.1.raw
  modified_base (634)..(634): a, c, t, g, unknown or other
  misc_feature (634)..(634): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattacgaagaacacgctgtatctgcaaatggagagcctgagactcgacgacacggccgtctattattgtagttaaaggcgagctggaatacgggaccgggcccgatcgacacgtggggccaggggacgcgtggtcaccgtctcctcacgccctccaccaacgggcccaacgtccggtacccttccccccgtcggccctaccctccctcccaaacgacgaccacctccggtcgggggtaccacgacgaccaacggccccgtagggtccgtccgtcccgtcgggtaccaaacggtacccttaacttaccgtaacgttaccttacgttactcgttacgaacgggtccgggtacgtcgggtaccgacggaccgaccgtaagtacgntacg

SEQ ID NO: 54422 - DNA, 618 bp, Homo sapiens
  misc_feature: GYAE6OF02G2479.29.78.H01.1.454.CMB.1.raw
  modified_base (351)..(351): a, c, t, g, unknown or other
  misc_feature (351)..(351): n is a, c, g, or t
tcagatagagtactcacgaccggtgctcgatttagtgtgagtagtttgggtttggggtccgagccatggtgcagactccccagagctctcctcctcctccactgcacagggtctctctcccagcctgtgctgactcaatcgccctctcgcctctcgccctccctggggaggctcggtcaaggtcacctgtactctgagcaggtggacacagcagctacgcatcgcttggcatcagcaggacgccagacacgggcctcgttactgatgactagtacaacaagtgagtggcagtcaacgaggacggaagggggacggtactcccgtagactcgtcttcgtctacgtctaccgngtcctcggtcgggccgtaggaccgtcgtaccttaaccctcgaactacctccgtcccggtaccctccgtacgttcgtggaggtactgggaacggtcttagtaaccttaactttacgtacgtcgaacggtccggtacgggtcctacggtcgtactacgttcgacggttcccggtacgggaaccgggacctacggtccgtaccgggtcggtaccggcgaccgtacccgaaccgccccaaccgctacgtcctaccttccgtccgtaccccc

SEQ ID NO: 54423 - DNA, 589 bp, Homo sapiens
  misc_feature: GYAE6OF02F57FS.29.78.H01.1.454.CMB.1.raw
  modified_base (586)..(586): a, c, t, g, unknown or other
  misc_feature (586)..(586): n is a, c, g, or t
tcagatagagtactcacgaccggtgctcgatttagtgtgagtagtttgggtttggggcgcctgggtacggccggggggtcgctgagactctcctgtgcggcctctggattaagttttaggagtcagtgccatgaactgggtccgccaggctccagggaagggctggagtgggtctcggctattagtggcagtggtggccgctatatattatgcagacgccctgaagggccggttcaccatttccagagacaattcgaagaacacgctgtatctgcaaatggagagcctgagactcgacgacacggcccgtctattattgtgttaaaggcgagctggaaatacgggaccgggcccgacttggaccacgtggggccaggggacgcgtggtccacgtctcctcacgccctccaccgaacgggcccacgtccggtccttccccctggccaccctccctaccaacgacgcacccgtcgtcggggcacgacgccacgccccgtcggctcgtcgtcgtacgaacgtacttaccgtaccgtacgttctactacgtcgaggacggcggtcgtggacgtacggccgacacgtacgngcg

SEQ ID NO: 54424 - DNA, 633 bp, Homo sapiens
  misc_feature: GYAE6OF02JBHWE.29.78.H01.1.454.CMB.1.raw
  modified_base (333)..(333): a, c, t, g, unknown or other
  misc_feature (333)..(333): n is a, c, g, or t
  modified_base (631)..(631): a, c, t, g, unknown or other
  misc_feature (631)..(631): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtagttaaaggcganctggaagtacggggaccggggcccgacttcgaccacgtcggggccgaggggacgcgtggtcaccgtctcctcacgccctccaccgacggcccagtccggtccttcccccgtcggccctaccctccctaccaacgacgcctacccgtccgtcgggggccaccgacgccaccgtccccgtgggcctcgcccgttcgggtacgaaaccgggtaccttaccgttaccgtacgttacctccttacgtccgtcggacggccgggtccgttgggaccgtaacgggccggtacctaagtacggtancg

SEQ ID NO: 54425 - DNA, 577 bp, Homo sapiens
  misc_feature: GYAE6OF02GQTDZ.29.78.H01.1.454.CMB.1.raw
  modified_base (379)..(379): a, c, t, g, unknown or other
  misc_feature (379)..(379): n is a, c, g, or t
tcagatagagtactcacgaccggtgctcgatttagtgtgagtagtttgggtttggggtccgagccatggtgcagactccccagagctctcctcctcctccactgcacagggtctctctcccagcctgtgctgactcaatcgccctctgcctctgccctccctgggaggctcggtcaaggtcacctgtactctgagcagtggacacagcagctacgccatcgcttggcatcagcagaggccagacacgggcctgttactgatgacagtcaacaatgatggcagtcacaggcgaaggggggcggatccctagatcgcttctcagtctccagctcgtcgggcctggacgcgtcctacctcactatcctccggcctccagtcngaggtatggacggctagtacttattacgtgtaccgaggtaccgtggggacctacggtcgctattccgaagggttcccgttacgggaaccggggtaccaagggtccctaccgggttccggtcgggtccacggtaccccgaacggtacccctaaaccccggtgttcccggtacctacccgtttccgtccggttccccccg

SEQ ID NO: 54426 - DNA, 629 bp, Homo sapiens
  misc_feature: GYAE6OF02IIVWP.29.78.H01.1.454.CMB.1.raw
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtagttaaaggcgagctggaaactacggggaccggggcccgacgttcgaccacgtcggggccgaggggacgcgtggtcaccgtctcctcacgccctccaacccgaacgggccctacgtccggttccttcccccgtcgcccaccctccctacccaagacgcctaccctcgtcggggccacgacgcacgcccgtgggcctcgccgtcggtaccgaaacggtaccttaccgttccgtaacggtaccttcgttacgttcgtacggacgggtccgggtcgtacgggaccggaacgggccgacgtaacgtgtacgag

SEQ ID NO: 54427 - DNA, 733 bp, Homo sapiens
  misc_feature: GYAE6OF02H7R6D.29.78.H01.1.454.CMB.1.raw
  modified_base (729)..(729): a, c, t, g, unknown or other
  misc_feature (729)..(729): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgccaggctccagggaaggggctggagtgggtctcggctattagtggcagtggtgcgctatatattatgcagacgccctgaagggccggttcaccatttccagagacaattcgaagaacacgctgtatctgacaaagtggagagcctgagactcgacgacacggcctactattattgtagttaaaggcgtagcgtggaactaccgggaccggggtccctaacgttgaaccctacggtcgggggaccagggggaccgcgttggtccacccgttctcccacgacgccctaccaaccgaacgggtccccacgtcccggttcccttaccccccgtggacccctaccccgttccccgtacccgaaaccggacgcccgtaacccgttccggtcggggggacccaaccgtaacggcccggaaccggtaccccgttggggtcccgtcgtacccggttacgggttaccgaaacgggttaacccttacccgttaacccgtaacgtttacccttaccgtaacgtttccggtacgggtaccgggtccggggttaccggttacggggaccgtaaccggggccgtaccggtaacgttacgntacg

SEQ ID NO: 54428 - DNA, 565 bp, Homo sapiens
  misc_feature: GYAE6OF02IT0W0.29.78.H01.1.454.CMB.1.raw
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaagggctggagtgggtctcggctattagtggcagtggtggcgctatatattatgcagacgccctgaagggccggttcaccatttccagagacaattcgaagaacacgctgtatctgcaaatggagagcctagagactcgacgacacggccgtctattattgtagttaaaggcgagctggaatacgggaccgggcccgattcgaccacgtggggccaggggacgcgtcggtcaccgtctcctcacgcctccacaacgggcccatcggtccttccccctggccgccctgcctccaggacgccacctccgagcgcacacgcggccctgggctcgccgtgtcaaggcttacttcccgagttactcgttatcgtacggagccgggtctcggaccgaaggccgactacgtagc

SEQ ID NO: 54429 - DNA, 565 bp, Homo sapiens
  misc_feature: GYAE6OF02FG184.29.78.H01.1.454.CMB.1.raw
  modified_base (564)..(565): a, c, t, g, unknown or other
  misc_feature (564)..(565): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagacacgctgtatctgcaaatggagagcctgagactcgacgacacggccgtctattattgtgttaaaggcgagctggaatacgggaccgggcccgacttgaccacgtggggccaggggacgctggtcaccgtctcctcagccctccaccaagggcccatccggtccttccccctcggccaccctccctcccaacgacgccaccctccgtcgggggccacgagccacgccccgtgggcctcgccgtcggtccaaggacctaccttccagtactctatctgacgcgggctggcaagggccgcagtagnn

SEQ ID NO: 54430 - DNA, 641 bp, Homo sapiens
  misc_feature: GYAE6OF02H2YU0.29.78.H01.1.454.CMB.1.raw
  modified_base (382)..(382): a, c, t, g, unknown or other
  misc_feature (382)..(382): n is a, c, g, or t
tcagatagagtactcacgaccggtgctcgatttagtgtgagtagtttgggtttggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggcctctatttattgtagtttaaaggcgagctggaatacggggaccgggcccgattcgaccacgtggggccaggggacncgtggtcaccgtctcctcgacgcctccaccgaacgggcccagtccggtccttcccccgtcggccaccctcctaccgaagacgccacctcgtggggccacgagccacgcccgtgggcctcgcccgtcgggttaccaaacgggtaccttaaccgtttacccgaacggttacccttacgttacgttccgttacgggtaacggcccgggggttaccgttacggggaccgaaacggggtcccgtaccggtaagttacggagacg

SEQ ID NO: 54431 - DNA, 605 bp, Homo sapiens
  misc_feature: GYAE6OF02HHYG2.29.78.H01.1.454.CMB.1.raw
  modified_base (603)..(603): a, c, t, g, unknown or other
  misc_feature (603)..(603): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctagagactcgacgacacggccgtctattattgtagttaaaggcgagctaggaagtacgggaccggggccctagtcgaccacgtggggaccgaggggacgcgtggtcaccgtctcctcacgccctaccaccgaacggcccacgtccgtcccttccccgcggccaccctacctaccgaagacgcctacctcggtcggggcacgagaccacgccgtcgggactcgccgtcggtaccgaacggtaccttacgttaccgaacgttactacttactcgtacgtacggccgggcgtacggaccgaggaccgacgaagtacgancg

SEQ ID NO: 54432 - DNA, 593 bp, Homo sapiens
  misc_feature: GYAE6OF02GN7ZK.29.78.H01.1.454.CMB.1.raw
  modified_base (215)..(215): a, c, t, g, unknown or other
  misc_feature (215)..(215): n is a, c, g, or t
  modified_base (237)..(237): a, c, t, g, unknown or other
  misc_feature (237)..(237): n is a, c, g, or t
  modified_base (482)..(482): a, c, t, g, unknown or other
  misc_feature (482)..(482): n is a, c, g, or t
tcagatagagtactcacgaccggtgctcgatttagtgtgagtagtttgggtttggggggagagaggagtccacccctgggatcttcaggtgttttcatttggtgatcaggacggaacagagagaactcaccatggagtttgggctgagctggctttttctgtggctattttaaaaggtgtccagtgtgacgtgcagttggtggagtctgggggcncctgggtacggccggggggtcnctgagactctcctgtgcggcctctggattaagttttaggagtcatgccatgaactggtccgccaggctccgagggaaggggctggaggtgggtctcggctagttagtggcagtggtggcgctagtatattatgcagaccgcccgtgaacgggtccgttcacctatttccagagaacaattacgaaagaacacgctgtatctgactaaagtggaagagctagagtactacgacgacacggaccgtntaactttattgtagtaaagcgaagtcgtaggacgtaccgggtacccggggcccgtacgttacggaccgacgtcggggacccgaggggaccgtcgtacggtcgacccgtacc

SEQ ID NO: 54433 - DNA, 576 bp, Homo sapiens
  misc_feature: GYAE6OF02IEY3S.29.78.H01.1.454.CMB.1.raw
  modified_base (574)..(574): a, c, t, g, unknown or other
  misc_feature (574)..(574): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacggggaccgggcccgacttgaccacgtggggaccaggggacgctggtcaccgtctcctcagcctccaccagggcccactcggtcctcccctgccaccctcctaccaacgacgccaccgtcgtcgggggcacgagaccacgcccgtcgggcctcgccgtcgggtaccaaacggacctacttccgacgtaccttactacgtctgacggtcgggtctggcaacgggccgcgagtacgncg

SEQ ID NO: 54434 - DNA, 566 bp, Homo sapiens
  misc_feature: GYAE6OF02G3EBK.29.78.H01.1.454.CMB.1.raw
  modified_base (560)..(560): a, c, t, g, unknown or other
  misc_feature (560)..(560): n is a, c, g, or t
  modified_base (566)..(566): a, c, t, g, unknown or other
  misc_feature (566)..(566): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacggggaccgggcccgacttgaccacgtggggccagggggacgcgtggtcaccgtctccctcacgcctcccaaccgaacgggcccagtccggtccttccccccgtggccacccctccctacccaagacgccacctcgtgggggcacgagccagccctgggctcgccgtggtcaaggacttacttccacgtactctatcctgacgcggtctggcgaggcganactagn

SEQ ID NO: 54435 - DNA, 601 bp, Homo sapiens
  misc_feature: GYAE6OF02G9VOG.29.78.H01.1.454.CMB.1.raw
  modified_base (249)..(249): a, c, t, g, unknown or other
  misc_feature (249)..(249): n is a, c, g, or t
tcagatagagtactcacgaccggtgctcgatttagtgtgagtagtttgggtttggggggaagaggaagactgacggtccacccctgggatcttcaggtgttttcatttggtgatcaggacggaacagagagaactcaccatggagtttgggctgagcgtggcgttttctagtggctattttaaaaggtgtccagtgtgacgtgcagttggtggagtctgggggcgcctggggtacggccgggggggtcncgtgagactcttctgtgcggcctctggattaagttttaggagtcatgccatgaactgggtccgcaggctccaggggaaggggctggagtgggtctcgggctattaggtggcaggtggtggcgctatatattatgcagacgcctggaaggccggttcaccatttccagtagacaattcgaagaacacgctgtatctgacaaatggagagcctgacgactcgaacgacacgggccgtctatttacgttgtagtaaaggcgagcttagggaacgttaccgggggacccggggtcccgtaacgtttacggaaccctacggtcgggggacccaggggggacctcggttaggtcccgg

SEQ ID NO: 54436 - DNA, 566 bp, Homo sapiens
  misc_feature: GYAE6OF02F5H8A.29.78.H01.1.454.CMB.1.raw
  modified_base (561)..(561): a, c, t, g, unknown or other
  misc_feature (561)..(561): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccgggccgacttgaccactggggccagggggacgcgtggtcacccgtctcccgtcagccctccaccaacgggcccatccggtccttcccccctcggccacccctccctcccaacgacgccaccctccgtcgggggtccacgacgcacgccctgggcctgccctggtcgaacggacctacttccagtacctctactctgagcgggctggcaggccgnatagc

SEQ ID NO: 54437 - DNA, 608 bp, Homo sapiens
  misc_feature: GYAE6OF02J1DY9.29.78.H01.1.454.CMB.1.raw
  modified_base (315)..(315): a, c, t, g, unknown or other
  misc_feature (315)..(315): n is a, c, g, or t
  modified_base (326)..(326): a, c, t, g, unknown or other
  misc_feature (326)..(326): n is a, c, g, or t
  modified_base (364)..(364): a, c, t, g, unknown or other
  misc_feature (364)..(364): n is a, c, g, or t
  modified_base (386)..(386): a, c, t, g, unknown or other
  misc_feature (386)..(386): n is a, c, g, or t
  modified_base (400)..(400): a, c, t, g, unknown or other
  misc_feature (400)..(400): n is a, c, g, or t
tcagatagagtactcacgaccggtgctcgatttagtgtgagtagtttgggtttggggtccgagccatggtgcagactccccagagctctcctcctcctccactgcacagggtctctctcccagcctgtgctgactcaatccgccctctgcctctgccctcccgtgggaggctcggtcaaggtccacctgtactctgagcagtggacacagcagctacgccatcgcttggcatcagcagacggcagacgaccgggcctcgttactgatgacagtacaacatgatggcagcacgagacggaaggggacggactccgngactcgcttcncagtctacagtctcgtcgggcctaggacgcgtctaccnctaacactccgtcccgcctacnggtctggaacggtntcggacggtctacggtacttacgttacgtcgtacacggtccgtcgggactcgtggtacctattacggacgggtttcccgtacggggaaacccggggtactaccgggttccacccgggtttcgggccggttacccgacgggaaccccggaaccgtccccgtaaaccctcgggtccgtaccctacccgttcccggttacccgtcccccgg

SEQ ID NO: 54438 - DNA, 563 bp, Homo sapiens
  misc_feature: GYAE6OF02I9BAP.29.78.H01.1.454.CMB.1.raw
  modified_base (561)..(561): a, c, t, g, unknown or other
  misc_feature (561)..(561): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggcccgtctattattgtgttaaaggcgagctggaatacgggaccggggcccgacttgaccacgtggggccaggggacgcgtggtcaccgtctcctcagcctccaccaggcccatccggtcttcccccgtggccaccctcctccaacgacgcgaacctcgtcgggggccacacgcacgcccgtcgggctcgtcctcggtcgaacggacctacgtccagtacctctactctgacggtcggcgtggcacggcgcgatagncg

SEQ ID NO: 54439 - DNA, 608 bp, Homo sapiens
  misc_feature: GYAE6OF02ITLEY.29.78.H01.1.454.CMB.1.raw
  modified_base (365)..(365): a, c, t, g, unknown or other
  misc_feature (365)..(365): n is a, c, g, or t
  modified_base (381)..(381): a, c, t, g, unknown or other
  misc_feature (381)..(381): n is a, c, g, or t
  modified_base (398)..(398): a, c, t, g, unknown or other
  misc_feature (398)..(398): n is a, c, g, or t
  modified_base (603)..(603): a, c, t, g, unknown or other
  misc_feature (603)..(603): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttcccagagacaattcgaaagaacacgctgtatctgcaaatggagagcctgagactcgacgacacggccgtctattattgtgttaaaggcgagctggaagtacgggaccgggccgacttgaccncgtcgggcgaggggcnctggtcaccgtctcctnacgcctcaccgaggacccatcggtccttcccctggccacccgtcctacccacgagcccaacctcgtcggggacacgagcctaacgcccgtacgggcctacggtccgtcggtaccgaaggtaccttaccgttccaacgttcttacctactcgttacgaggtcccgggtaccgtgggtaccgaacggggtccgaccgtaacgtacgngtacg

SEQ ID NO: 54440 - DNA, 742 bp, Homo sapiens
  misc_feature: GYAE6OF02I3551.29.78.H01.1.454.CMB.1.raw
tcagatagagtactcacgaccggtgctcgatttagtgtgagtagtttgggtttggtggtctctctcccagcctgtgctgactcaatcgccctctgcctctgcctccctgggagctcggtcaaggtcacctgtactctgagcagtggacacagcagctacgccatcgcttggcatcagcagaggccagacacgggcctcgttacttgatgacagtcaacaatgatggcagtcacagcgaagggggcggatcccgtgatcgcttctcagtcctcccgagtcctcgtgggcctggacgtccgctactcactatccgtcccggcctccagtcgtaggaggtatcggacggtctacggtaacttaacgtttaccgtcggttacctacggtaccggtcgggggacctaccggtacggtactaacgtttaccgtaacggggttaacggttacccgggggaaccggggtaaacccgtaacggggttcctaacccgggttccgggttaccggtacgaacccgggtaaccccgaaacgggtacccccgtaaacccctacgttaccggttacccgttaaccgtttacccgttccccggtttaccccccgtacccccgtttacccgttacccggtaaccgttacccgttttacccttaaccggttccgtaaccggggttaccgggacccgggggttaaccgtacgggtacccgtaaacggggtcccgtaaccgttaacggacggttcgtactcg

SEQ ID NO: 54441 - DNA, 630 bp, Homo sapiens
  misc_feature: GYAE6OF02JGPC5.29.78.H01.1.454.CMB.1.raw
  modified_base (628)..(628): a, c, t, g, unknown or other
  misc_feature (628)..(628): n is a, c, g, or t
tcagatagagtactcacgaccggtgctcgatttagtgtgagtagtttgggtttgggggcgcctgggtacggccgggggggtcgctgagactctcctgtgcggcctctcggattaagttttaggagtcatgccatgaactgggtccgcgaggctccagggaaggggctggagtgggtctcggctattagtggcagtggtggcgctatatattatgcagacgccctggaagggccggttcaccatttccagaggacaattcgaagacacgctgtatctgcaaatggagagcctgagactcgacgacacggccgtctattatgtggttaaacggcgagcgtaggaagtacggggaccggggcccgacgttcggaccgacgtcgggggacccgagggggaccgcgtggtaccaccgttctcccgtcacgccctccgaaccgaacgggcccacgtccggtccttcccccgtcggaccctacccgtcctaccgaacggacgccgacccgtcggtcggggccacgacgcgacgcccgtacggcctcggccgtcggtacgaacggtacttaaccgttccgacgttacctctacgtcgtggacggccgggcgtcggacggacgggccgacgacgtgncg

SEQ ID NO: 54442 - DNA, 495 bp, Homo sapiens
  misc_feature: GYAE6OF02FW3BX.29.78.H01.1.454.CMB.1.raw
  modified_base (427)..(427): a, c, t, g, unknown or other
  misc_feature (427)..(427): n is a, c, g, or t
  modified_base (493)..(494): a, c, t, g, unknown or other
  misc_feature (493)..(494): n is a, c, g, or t
tcagatagagtactcacgaccggtgctcgatttagtgtgagtagtttgggtttggtggtctctctcccagcctgtgctgactcaatcgccctctgcctctgcctccctgggaggctcggtcaaggtcacctgtactctgagcagtggacacagcagctacgccatcgcttggcatcagcagaggccagacacgggccctcgttacttgatgacagtcaacaatgatggcagtcacagcaagggggacgggatccctgatcgcttctcagtctccagctctgggcctgagcgctacctcacaatctccggctccagtctgaggatgaggctgactattctgtcagacctggggcacgtggcagttcaggttcgttcggaccggggaccaaggtccaccggtcgtcgtcacgcccgaaggcccaacccntgtccactctcgttccccaccctctcacgtctctatctgacgcgggctggcaacggcgacagtagnnc

SEQ ID NO: 54443 - DNA, 172 bp, Homo sapiens
  misc_feature: GYAE6OF02FV10X.29.78.H01.1.454.CMB.1.raw
  modified_base (166)..(172): a, c, t, g, unknown or other
  misc_feature (166)..(172): n is a, c, g, or t
tcagatagagtactcacgaccggtgctcgatttagtgtgagtagtttgggtttggggtctccactcccgccttgacgggctgccatcagcccaaggccaacccactgtcactctgttcccgccctcctcagtactctagtctgagcgggctggcaaggcgcatagnnnnnnn

SEQ ID NO: 54444 - DNA, 636 bp, Homo sapiens
  misc_feature: GYAE6OF02I0CLW.29.78.H01.1.454.CMB.1.raw
  modified_base (389)..(389): a, c, t, g, unknown or other
  misc_feature (389)..(389): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtagttaaaggcgagctaggaacgtacggggaccggggcccgacgttcgaccacgtggggccagggggacncgtggtcaccgtctcctcacgccctccaaccgacgggcccacgtcggtccttcccccgtcggccacccctccctccaacgacgccacctcgtcggggccacgacgcgacgcccgtcgggccgtcggcccgttcgggtccgaaacgggtaccttaaccgttacccgtacgttaccttacctacttccgttcggaacgggtccgggtacgttcgggaccggtaacgggccgtaccgaacgttacgagcg

SEQ ID NO: 54445 - DNA, 685 bp, Homo sapiens
  misc_feature: GYAE6OF02GT30C.29.78.H01.1.454.CMB.1.raw
  modified_base (680)..(680): a, c, t, g, unknown or other
  misc_feature (680)..(680): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctggaagggccggttcaccatttccagagacaattcgaagaacacgctagtatctgacaaagtggaagacgcctagacgactcgacgacgaccggccgtactattattgtagttaaaggcgagcgtaggaacgtaccggggacccgggcccgtacgttcgacctacggtcggggaccgaaggggaccgcgtcggtacctaccggtcctcctcgacgccctaccaccgaacgggccctacgttccggttcccttcccccgtcggccctacccttccctacccaacggaccgcctacccgtccggtcggggaccacgacgccgacgtcccgtacgggcctcggtcccgtcggtaccgaaaccggtaccttaaccgttaccgtacgttaccctacgttacgtccggtaggaccgggtccgggtaccgtcgggaaccggaacggtccggtaacgtacgtacgngtacg

SEQ ID NO: 54446 - DNA, 601 bp, Homo sapiens
  misc_feature: GYAE6OF02G9NTV.29.78.H01.1.454.CMB.1.raw
  modified_base (599)..(599): a, c, t, g, unknown or other
  misc_feature (599)..(599): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggcccgtctattattgtgttaaaggcgagcttaggaatacgggaccggggcccgacttgaccacgtggggccaggggacgcgtggtcaccggtctcctcagcctccaccaacgggcccacgtccggtccttccccctcggccaccctccctcccaacgacgccacccgtcgtcgggggcctacgacgccaacggccccgtagggccgtcgcccgtcggtaccaacgggacttaaccgttccacgttacctcttactcgtcgaggcgggacgtcggacgtaacggcgccgtagtagncg

SEQ ID NO: 54447 - DNA, 675 bp, Homo sapiens
  misc_feature: GYAE6OF02HC2GG.29.78.H01.1.454.CMB.1.raw
  modified_base (387)..(387): a, c, t, g, unknown or other
  misc_feature (387)..(387): n is a, c, g, or t
  modified_base (671)..(671): a, c, t, g, unknown or other
  misc_feature (671)..(671): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgccaggctccagggaagggctggagtgggtctcggctattagtggcagtggtggcgctatatattatgcagacgccctgaagggccggttcacatttccagagacaattcgaagaacacgctgtatctgacaaatggagagcctgagactcgacgtacacggccgtactattacttgtagttaaaggcgagcgtggaaatacgggaccgggcccgtacttcgaaccacgtggggccaggggacncgtggtcaaccgtctcctacgacgtcccgtccacgaacgggccctagtccggttccttcccccgtggacctacccgtccgttaccaacggacgtaccgtaccctcggttacgggggcctaaccgtacgaccgtacggtaccccgtcggggtccttaccggcccgttacgggtacccgtaaacgggtaccttaaccgtttcccgtaacggttacccttacgtacgttccgttaggccggtaccgggtacgtcggggacctaacgggcctaccggtaagttacggnacgg

SEQ ID NO: 54448 - DNA, 692 bp, Homo sapiens
  misc_feature: GYAE6OF02FFJSN.29.78.H01.1.454.CMB.1.raw
  modified_base (686)..(686): a, c, t, g, unknown or other
  misc_feature (686)..(686): n is a, c, g, or t
tcagatagagtactcacgaccggtgctcgatttagtgtgagtagtttgggtttgggggcgcctgggtacggccggggggtcgctgagactctcctgtgcggcctctggattaagtttaggagtcatgccatgaactgggtccgccaggctccagggaagggctggagtgggtctcggctattagtggcagtggtggcgctatatattatgcagacgccctgaagggccggttcaccatttccagagacaattcgaagacacgctgtatctgcaaatggagagcctgagactcgacgacacggcgtctatattgtgttaaagcgagctggaatacgggaccgggcccgattcgaccacgtggggccaggggacgcgtggtcaccgtctcccgtcacggcctcccaccgtacggggccccaagtccggttacccttccccccgtcgggccctaccccgtccctacccgtaaacgacgtcccaaacccgttccggttacgggggggcccaacgtacggcccgaacggtacccccgtggggcccgtcggccgttaccgggtaaccgtaaacgggtaacccttacctttacccgtaaccgtttacccgtacctaacgttaccgttacggaaccggtaccgggggtcccgttagggaccgtaaacgggtcccggtaccgtaacggttaacgngtaacg

SEQ ID NO: 54449 - DNA, 547 bp, Homo sapiens
  misc_feature: GYAE6OF02HGH8J.29.78.H01.1.454.CMB.1.raw
  modified_base (525)..(525): a, c, t, g, unknown or other
  misc_feature (525)..(525): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtagttaaaggcgagctggaatacggggaccggggcccgacttggaccacgtggggccaggggacgcgtggtcaccgtctcctcagccctccaccgaaggcccagtcggtccttccccctggccaccctcctcccaacgacgccacctcgtcggggcacgacgcacgcccgtggctcgcctgcaaggactactccagtactctatcngagcggctgcgacgcgcatagc

SEQ ID NO: 54450 - DNA, 475 bp, Homo sapiens
  misc_feature: GYAE6OF02GK38K.29.78.H01.1.454.CMB.1.raw
  modified_base (210)..(210): a, c, t, g, unknown or other
  misc_feature (210)..(210): n is a, c, g, or t
  modified_base (290)..(290): a, c, t, g, unknown or other
  misc_feature (290)..(290): n is a, c, g, or t
  modified_base (376)..(376): a, c, t, g, unknown or other
  misc_feature (376)..(376): n is a, c, g, or t
  modified_base (400)..(400): a, c, t, g, unknown or other
  misc_feature (400)..(400): n is a, c, g, or t
  modified_base (448)..(449): a, c, t, g, unknown or other
  misc_feature (448)..(449): n is a, c, g, or t
  modified_base (451)..(475): a, c, t, g, unknown or other
  misc_feature (451)..(475): n is a, c, g, or t
tcagatagagtactcacgaccggtgctcgatttagtgtgagtagtttgggtttgggaggctcggtcaaggtcacctgtactctgagcagtggacacagcagctacgccatcgcttggcatcagcagaggccagacacgggccctgttacttgatgacagtcaacaatgatggcagtcacagcaaggggggacggatccctgatcgcttcncagtctccagcctcgtgggcctgagccgctacctcacaatcctccggcctccagtctgaggatgaggctgactattacgngtcagccgtggggcacgtgcagttcgaggtcctcggaccgggacaaggtccaccggtcgtcgtcacgacccgaaggcccaaccctntcgcactcctcgtccccacctccnctacgtcctctactctgacggcggtctcggacaacggcacgtagtagnngnnnnnnnnnnnnnnnnnnnnnnnnn

SEQ ID NO: 54451 - DNA, 591 bp, Homo sapiens
  misc_feature: GYAE6OF02GYC62.29.78.H01.1.454.CMB.1.raw
  modified_base (584)..(584): a, c, t, g, unknown or other
  misc_feature (584)..(584): n is a, c, g, or t
  modified_base (590)..(591): a, c, t, g, unknown or other
  misc_feature (590)..(591): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagctgagactcgacgacacggccgtctattattgtgttaaaggcgagctaggaatacgggaccgggcccgacttgaccacgtgggggccaagggggacgcgtggtcgaccgtctccctcagccctccaccgaacgggcccatccggtcttccccctcggccaccctcctaccaacgacgaccacctccgttcgggggccaccgagtccacgcccgtgggcctcgccgtggtccaacggacctaacttcccgagttacctactacgttcagacggtcgggcgtcgggacaacgggtcgacngtacgnn

SEQ ID NO: 54452 - DNA, 648 bp, Homo sapiens
  misc_feature: GYAE6OF02FKOBT.29.78.H01.1.454.CMB.1.raw
  modified_base (643)..(643): a, c, t, g, unknown or other
  misc_feature (643)..(643): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccggggcccgacttgaccacgtgggggccagggggaccgcgtggtcaccgtctcctcagcctccaccgaacggcccactcggtccttccccctcggccaccctcctccaacgacgccacctccgtcgggggccacgacgccgacgccccgtcggggacctcggtcccgtcgggttaccgaaacggtaaccgttaaccgtttacccgtaacggttacccgttaccttaacgttccgttacggtaacggtcccggggtccgttacggggaccggaacgggccggtaccgaacggttacgngtacg

SEQ ID NO: 54453 - DNA, 576 bp, Homo sapiens
  misc_feature: GYAE6OF02GYS5R.29.78.H01.1.454.CMB.1.raw
  modified_base (485)..(485): a, c, t, g, unknown or other
  misc_feature (485)..(485): n is a, c, g, or t
  modified_base (574)..(574): a, c, t, g, unknown or other
  misc_feature (574)..(574): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacggggaccggggcccgacttgacctacgtggggccagggggacgcgtggtcaccggtctcctcacgcctcccaccgaacgggcccacgtccggtccttcccccgtggcccaccctccctccaacgacgcacctcgtcggggcacncgcacgcccgtggctcgccgtcgtacaacggctaccttccagtacctctacgtctcggaggccggcgtggacgaggtccgacgactagncg

SEQ ID NO: 54454 - DNA, 579 bp, Homo sapiens
  misc_feature: GYAE6OF02IKJ3J.29.78.H01.1.454.CMB.1.raw
  modified_base (577)..(577): a, c, t, g, unknown or other
  misc_feature (577)..(577): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaaattcgaagaacacgctgtatctgcaaatggagagcctgagactcgacgacacggcccgtctattattgtgttaaaggcgagctggaatacgggaccgggcccgacttgaccactggggccaggggacgcgtggtcaccgtctcctcacgcctccaccgaggcccactccggtccttcccccgtcgccaccctcctcccaagacgcacctcgtcgggggcacgacgcgacgcccgtcgggcgtcgccgtcggtcgaacggacttaccttccgagttacctactactctacggacggcgggtctcggcgaacgggccgcgagtagncg

SEQ ID NO: 54455 - DNA, 595 bp, Homo sapiens
  misc_feature: GYAE6OF02IA9ZK.29.78.H01.1.454.CMB.1.raw
  modified_base (410)..(410): a, c, t, g, unknown or other
  misc_feature (410)..(410): n is a, c, g, or t
tcagatagagtactcacgaccggtgctcgatttagtgtgagtagtttgggtttggggggagagaggagtccacccctgggatcttcaggtgttttcatttggtgatcaggacggaacagagagaactcaccatggagtttgggctgagctggcttttttcttgtggcttaattttaaaaggtgtccagtgtgacgtgcagttggtggagtcgtggggggcgccgtggggtacgggccgggggggtcgctgagactctcctgtgcggcctctggattaagttttaggatcatgccatgaactggtccgccaggctcgaggggaagggctgggagtggggtctcggactagtttagtggcaggtggtggcgctatatattatgcagaccgcctggaacgggccgttcaaccnctttccagacgaactaattacgaaacgaaacacactagtatctagacaaagtggaagagcctagagactcgacgacacggccgtctattattgtagttaaggcgagcgtggacgtaccggggaccggggcccgtaccgttcgaaccgtacgtcgggccgagggggtccgcgtcggtccgccgtcc

SEQ ID NO: 54456 - DNA, 683 bp, Homo sapiens
  misc_feature: GYAE6OF02HZ9VF.29.78.H01.1.454.CMB.1.raw
  modified_base (680)..(680): a, c, t, g, unknown or other
  misc_feature (680)..(680): n is a, c, g, or t
tcagatagagtactcacgaccggtgctcgatttagtgtgagtagtttgggtttggtggtctctctcccagcctgtgctgactcaatcgccctctgcctctgcctccctgggaggctcggtcaaggtcacctgtactctgagcagtggacacagcagctacgccatcgtcttggcatcagcaggacggccagacgaccgggcccttcgtttacttgatgacagtacaaacaatgagtggcagtcacgaggacggaaggggggacggactcccgtagactcgtcttctcgtacgttcctccagtcctcggtcgggcctggacgccgtacctacctacaacctaacttcccgtcccggtcctccgacgtcgtggaaggtacgtggacgtcgttacgtaacttatttacgtgtaccgacggtaccgggtcgggacctacggtcggaccttacgtttaccggacgggtttccgtaacccgggggaacccggggtacctaaccggggttccgtacccggtccgggttaccgacccgaaccggtaccccgaacggaccccctaacccgtgtccgttacctacccgttccgttacccgtacccctacccgtccctaacgttaccgttaccttcctacgtccgtcgggaccgtcgggtccgtacggacgtacggccacgtaagtgcgtnacg

SEQ ID NO: 54457 - DNA, 750 bp, Homo sapiens
  misc_feature: GYAE6OF02IF8KK.29.78.H01.1.454.CMB.1.raw
tcagatagagtactcacgaccggtgctcgatttagtgtgagtagtttgggtttggggtctgagagaggagtccacccctgggatcttcaggtgttttcatttggtgatcaggacggaacagagagaactcaccatggagtttgggctgagctggcttttctgtggctatttaaaaggtgtccagtgtgacgtgcagttggtggagtcgtgggggcgccgtggggtacgggccgggggggtcgctgagactctcctggtgcggcctcgtggtattaagttttaggagtcatgccatgaacgtgggtccgcaggctccgaggggaggggctgggaggtggggtctcgggctagttaggtgggcaggtgggtcgggcgtactaattataatttagtgacagaccgtcccgtagggaacggggtcccggttacaacccgttactttaccgaaggaacgaactaaacgtttaccgaaacgaaaccgtaccgcttaggtaactccgtaggaacaaaagttggggaacgtacggtacccgttaggaaacgtaccgtacgggaaaccgaccggtaaccgggtcccgttaccgttaagttttagtttaggttaacggtttaaacgggcgtacggtacggtaagggtaaccgggtaacccggggggaaccccggggtcccgtaaccggttccggaaccccgtacggggtaccgggggaccccggtagggggggtaccctaccgggttcgggtaaccccgg

SEQ ID NO: 54458 - DNA, 588 bp, Homo sapiens
  misc_feature: GYAE6OF02FLYYV.29.78.H01.1.454.CMB.1.raw
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacggggaccggggcccgacttgaccacgtgggggccagggggacgcgtggtcaccggtctccctcacgccctccaccgaacgggcccactccggtccttccccctcggccacccctccctccaacgacgccacctcgtcggggccacgacgccacgcccgtgggcctcgcccgtcggtccgaaggaccttacttcccacgttactcctacgttctggacggcgggctgggcgaacgggccgcgatacgc

SEQ ID NO: 54459 - DNA, 624 bp, Homo sapiens
  misc_feature: GYAE6OF02GNRHF.29.78.H01.1.454.CMB.1.raw
  modified_base (379)..(379): a, c, t, g, unknown or other
  misc_feature (379)..(379): n is a, c, g, or t
  modified_base (615)..(615): a, c, t, g, unknown or other
  misc_feature (615)..(615): n is a, c, g, or t
tcagatagagtactcacgaccggtgctcgatttagtgtgagtagtttgggtttggggtctgagagaggagtccacccctgggatcttcaggtgttttcatttggtgatcaggacggaacagagagaactcaccatggagtttgggctgagctggctttttcttgtggctattttaaaaggtgtccagtgtgacgtgcagttggtggagtctgggggcgcctggggtacgggccgggggggtcgctgagactctcctgtgcggcctctggattaaggttttaggagtcatgccatgaactgggtccgcaggctccaggggaaggggctgggagtggggtctcgggctagttagtggctaggtgggtggcgctatatattntgcagacgccctggaacgggtcccggttcaccgtatttcccgaggtacgactaagtttcgaaagaaccacggctagtactctgacaaagttgggagacgcctgacgactcgacgacgaccggtccgttacttatttagttggttagttaaagggcgagtcgtagggaacgtaaccgggggacccgggtcccggtaacgttcggaacccacggtcggggacccggagggggctcggnggttacccg

SEQ ID NO: 54460 - DNA, 626 bp, Homo sapiens
  misc_feature: GYAE6OF02GN0JQ.29.78.H01.1.454.CMB.1.raw
  modified_base (623)..(623): a, c, t, g, unknown or other
  misc_feature (623)..(623): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacggggaccggggcccgacttgacccacgtggggccaggggacgctggtcaccgtctcctcagccctccaccaacgggcccagtcggtcttcccccgtggcccaccctccctccaacgacgccaccctcgtcgggggccacgacgccgacgtccccgtaggggcctcggcccgttgggtaccgaaacgggtaccgttacctttccgacgttaccttccgttacgttccgttacggaacggccggggtccgttcgggaccgtaacgggccggacgtaacgttagntcg

SEQ ID NO: 54461 - DNA, 720 bp, Homo sapiens
  misc_feature: GYAE6OF02GJZK8.29.78.H01.1.454.CMB.1.raw
  modified_base (297)..(297): a, c, t, g, unknown or other
  misc_feature (297)..(297): n is a, c, g, or t
  modified_base (716)..(716): a, c, t, g, unknown or other
  misc_feature (716)..(716): n is a, c, g, or t
tcagatagagtactcacgaccggtgctcgatttagtgtgagtagtttgggtttgggggcgcctgggtacggccgggggggtcgctggagactctcctgtgcggcctctggattaagttttaggagtcatgccatgaactgggtccgccaggctccgaggggaagggctggagtgggtctcggctattagtggcagtggtggcgctatatattatgcagacgccctaggaacgggccgttcacctatttccgagagactaagttcgaaagaacacgctgtatctgacaaagtggagcncctgacgactcgacgacacggcgtctattagtgtaggttaaacggcgagtcgtaggaacgtaccggggacccgggccctacgttcggaacccgtacggtcgggggacccgtaagggggacctccgtcgggtaccacccggttcctccctacgaccgcccttacccgaacgaaccgggtacccacgttcccggttacccttcccccgtggtacccctacccctccctaaccgaacggtacacccgtaacccgttcgggtccgggggaccctaaccgaccggaccgtacccggtacccggtcggggtacccgtcggtccgttacgggtaaccgaaacggttaaccttaccgttaccgtacgtaccttacgttactcgtacggacgggtccggtacgtcggacgacggaccgacgagtacgntacg

SEQ ID NO: 54462 - DNA, 587 bp, Homo sapiens
  misc_feature: GYAE6OF02JJUOP.29.78.H01.1.454.CMB.1.raw
  modified_base (312)..(312): a, c, t, g, unknown or other
  misc_feature (312)..(312): n is a, c, g, or t
  modified_base (401)..(401): a, c, t, g, unknown or other
  misc_feature (401)..(401): n is a, c, g, or t
  modified_base (504)..(504): a, c, t, g, unknown or other
  misc_feature (504)..(504): n is a, c, g, or t
  modified_base (584)..(584): a, c, t, g, unknown or other
  misc_feature (584)..(584): n is a, c, g, or t
tcagatagagtactcacgaccggtgctcgatttagtgtgagtagtttgggtttgggggcggcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagacgacaattcgaagaacacgctgtatctgcaaatggagagcctgagactcgacgacacggccgtntattattgtgttaaaggcgagctggaatacgggaccgggcccgattgaccacgtggggccaggggaccgcgtcggtcaccgttctcctnacgcctccgaccgtaacgggccctactccggtccttcccccgtggaccctacccgtcctaccgaacgacgccacccgtcgtcggggcaaccgagcgacgccgngggctcgcctggtacaaggtacctacgttcctacgtacctctacgtctggacggcgggctggcgtaggccgcgaagtcgntcg

SEQ ID NO: 54463 - DNA, 586 bp, Homo sapiens
  misc_feature: GYAE6OF02IX84Q.29.78.H01.1.454.CMB.1.raw
  modified_base (321)..(321): a, c, t, g, unknown or other
  misc_feature (321)..(321): n is a, c, g, or t
  modified_base (326)..(326): a, c, t, g, unknown or other
  misc_feature (326)..(326): n is a, c, g, or t
  modified_base (333)..(333): a, c, t, g, unknown or other
  misc_feature (333)..(333): n is a, c, g, or t
  modified_base (346)..(346): a, c, t, g, unknown or other
  misc_feature (346)..(346): n is a, c, g, or t
  modified_base (468)..(468): a, c, t, g, unknown or other
  misc_feature (468)..(468): n is a, c, g, or t
tcagatagagtactcacgaccggtgctcgatttagtgtgagtagtttgggtttggtggtctctctcccagcctgtgctgactcaatcgccctctgcctctgcctccctgggaggctcggtcaaggtcacctgtactctgagcagtggacacagcagctacgccatcgcttggcatcagcagaggccagacacgggccctcgttacttgatgacagtcaacaatgatggcagtcacagacgaagggggacggactcctgactcgcttctcagtctcagctcgtggcctgacgcgctacctcacaatcctccggcctcagtcngagangacgtcngtaactattacgngtccagtccgtgggctacgtggactagttcgacgggttccgttcggggaacccggggtacaacgggtcccgtacccggtcggtcggtaccgaacgaccccgtaaagggcccccaaaccccgngttaccgtcaccgtttccgttccgttaccccgtccctccctaccgtaacgttccctacttacgtccggtaggaccggtcgggacttccgggacgtaaacgggctacgtatacggctgc

SEQ ID NO: 54464 - DNA, 563 bp, Homo sapiens
  misc_feature: GYAE6OF02FUJT9.29.78.H01.1.454.CMB.1.raw
  modified_base (305)..(305): a, c, t, g, unknown or other
  misc_feature (305)..(305): n is a, c, g, or t
  modified_base (343)..(343): a, c, t, g, unknown or other
  misc_feature (343)..(343): n is a, c, g, or t
  modified_base (437)..(437): a, c, t, g, unknown or other
  misc_feature (437)..(437): n is a, c, g, or t
tcagatagagtactcacgaccggtgctcgatttagtgtgagtagtttggggtttggggagagctctggggagtctgcaccatggctcggaccccactcctcttcctcaccctcctcctccactgcacagggtctctctcccagcctgtgctgactcaatcgccctctgcctctgccctccctgggagctcggtcaaggtcacctgtactctgagcagtggacacagcagctacgccatcgcttggcatcagcagagccagacacgggccctgttactgatgacagtcaacaatgatggcagtcanagcgaaggggacggactccgtgactcgcttcgcagtcnccgagctcgtggcctgacgccgtacctacctcaactaactcctcccggtaccttaccgagtcctaggagtactggacggctagacttattacgngtacagtaccgtgggactacgtggactagttccgtacggttccgttaccgggaccggggtacctaagggtcccgtaccggttcgtaccgggtccaaccggtacccaacgggtcccccaacccgtcg

SEQ ID NO: 54465 - DNA, 688 bp, Homo sapiens
  misc_feature: GYAE6OF02GWQPV.29.78.H01.1.454.CMB.1.raw
  modified_base (683)..(683): a, c, t, g, unknown or other
  misc_feature (683)..(683): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaaatggagagcctgagacgtcgacgacaccggccgtctattattgtagttaaaggcgagctaggaacgtacggggacccggggcccgtacttcgaacccacgtcggggaccgagggggacgcgtggtaccaccgtcctcctcacgcctacccaaccgaacgggcccacgttccggtccccttcccccgtcggccctaccctccctacccaacgacgccctaaccgtccggtacggggaccaccgacgccgacgtccccgtaggggcctcgcccgtcgggtaccgtaaacgggtaccttaaccgttacccgtaacgtttacccgttacctttacgttacccgtagggtaaccgggtccggggtccggttagggaacccgttaacggggccggtaccgaacgttacggngtacg

SEQ ID NO: 54466 - DNA, 716 bp, Homo sapiens
  misc_feature: GYAE6OF02G45U7.29.78.H01.1.454.CMB.1.raw
  modified_base (151)..(151): a, c, t, g, unknown or other
  misc_feature (151)..(151): n is a, c, g, or t
  modified_base (330)..(330): a, c, t, g, unknown or other
  misc_feature (330)..(330): n is a, c, g, or t
  modified_base (711)..(711): a, c, t, g, unknown or other
  misc_feature (711)..(711): n is a, c, g, or t
tcagatagagtactcacgaccggtgctcgatttagtgtgagtagtttgggtttgggggtcggccgtgggtacggccgggggggtcggcgtggagacgtctcctgtgcggcctctggattaagtttaggagtcatgccatgaactgggtccnccgaggctccagggaagggctggagtgggtctcggctattaggtggcaggtggtggcgctatatattatgcagacgcctgaacgggccgttcacatttccagagacaattcgaagaacacgctgtatctgacaaatggaagtagccgtagagactacggacgaacgaccgggcccgttnttaacttagtttacgtaggttaaaagggcgaggtcttagggaacgttaacggggacccgggggcccgtaacgttcggacccgtaacgtcgggggaccgaagggggaccgcgttcgggtaccaccggtccttaccgtcgacgtccccgtacccgaaccgtaccgggacccagttcccggtcccttcccccgtcggtacccctaccctccccgtaccaacgtacgaccctaacccgtcggtacggggccaccgagccgaaccggtcccgtacgggaccttcgcccgtaggtaccgaaacgggtacttacccgttacaccgttacctacgttactcgtacgacggtaccggcggttcggaccgtaacggccgtacgaagtacgngtacg

SEQ ID NO: 54467 - DNA, 581 bp, Homo sapiens
  misc_feature: GYAE6OF02HXBHL.29.78.H01.1.454.CMB.1.raw
tcagatagagtactcacgaccggtgctcgatttagtgtgagtagtttgggtttggggggaagaggaagactgacggtccacccctgggatcttcaggtgttttcatttggtgatcaggacggaacagagagaactcaccatggagtttgggctgagctggctttttcttgtggctattttaaaaggtgtccagtgtgacgtgcagttggtggagtctgggggcgcctggggtacggccgggggggtcgctgagactctcctgtgcggcctctggattaagttttaggagtcatgccatgaactgggtccgccaggctccaggggaaggggctggaggtgggtctcggctagttagtggcagtggtggcgctatatattatgcagacgccctggagggccggttcacctatttccagagacaattacgaaagaacacgctgtatctgacaaagtggagacgcctgagactcgacgacgacgccgtctattattgtagttaagcgagcgtaggaacgtacggggacccgggacccgtacgttcgaccgtacggtacggggccgagggggccgcgtggtacccg

SEQ ID NO: 54468 - DNA, 644 bp, Homo sapiens
  misc_feature: GYAE6OF02IZM6B.29.78.H01.1.454.CMB.1.raw
  modified_base (239)..(239): a, c, t, g, unknown or other
  misc_feature (239)..(239): n is a, c, g, or t
  modified_base (302)..(302): a, c, t, g, unknown or other
  misc_feature (302)..(302): n is a, c, g, or t
  modified_base (327)..(327): a, c, t, g, unknown or other
  misc_feature (327)..(327): n is a, c, g, or t
  modified_base (360)..(360): a, c, t, g, unknown or other
  misc_feature (360)..(360): n is a, c, g, or t
  modified_base (365)..(365): a, c, t, g, unknown or other
  misc_feature (365)..(365): n is a, c, g, or t
  modified_base (373)..(373): a, c, t, g, unknown or other
  misc_feature (373)..(373): n is a, c, g, or t
  modified_base (376)..(376): a, c, t, g, unknown or other
  misc_feature (376)..(376): n is a, c, g, or t
  modified_base (440)..(440): a, c, t, g, unknown or other
  misc_feature (440)..(440): n is a, c, g, or t
  modified_base (460)..(460): a, c, t, g, unknown or other
  misc_feature (460)..(460): n is a, c, g, or t
tcagatagagtactcacgaccggtgctcgatttagtgtgagtagtttgggtttggggggagagaggagtccacccctgggatcttcaggtgttttcatttggtgatcaggacggaacagagagaactcaccatggagtttgggctgagcgtgtcgtttctaggtggctatttaaaaggtgtcagtgtgacgtgcagttggtggagtcgtgggggcgcctgggtacggccgggggggtcncgtgagactctcctgtgcggcctctggattaagttttaggagtcatcgcatagacgtcggccncgagtcacgaggggacggcgtaggnggtggtcgtcggattagtaggtcgagtggtggnggctntatatatntgnacgcgcgtaggacggtcgtaccacgttactaccgagacgtactacgtacgaaacgacgacgttntagtctcggtacaagtaagnggagtacgtctagacgtacgtaccgacgaaccggtaccggtacttacgtttaacttagttagtttaaacgggttaaacggcgacgtaggtaacgggtaacgtcccggggggacccgtccgttacgtaccgaaccgtcgggtacgggccggaacgggtcgtcgtaccggtacccgtaccgtcccg

SEQ ID NO: 54469 - DNA, 720 bp, Homo sapiens
  misc_feature: GYAE6OF02GKC3P.29.78.H01.1.454.CMB.1.raw
tcagatagagtactcacgaccggtgctcgatttagtgtgagtagtttgggtttggggtccgagccatggtgcagactccccagagctctcctcctcctccactgcacagggtctctctcccagcctgtgctgactcaatcgccctctgcctctgcctcccgtgggaggctcggtcaaggtcacctgtactctgagcagtggacacagcagctacgccatcgcttggcatcagcagacggccagaccgacgggccctcgttactgatgacagtacaacatgagtggcagtacacgaggacgggaacgggggacggactccgtagacgtcgtcttcgacgtacgtcctaccgacgtccgtacggtcgggtccgtaggacgtcccgtacctaaccctaccaaccgtaaccgttcccgtaccccggtcccttaccgaggttcgtagggaacggacgtacggaacgggtcttaacgttaaactttacgtttaccgtacggtaccgtaaccgggtaccgggtacggggtactaccggttcggtaccttaccggtttacgggtacggggttaccccggtaaccggggtaacccggggaaccgttacggggtcccgttacccgggttaccggtccgggttaaccgaaccccgggtaaccccggaaccgtaccccgtaaaccccgtgttacccgacccttaccgtttacccgtccccgttaaccccccg

SEQ ID NO: 54470 - DNA, 665 bp, Homo sapiens
  misc_feature: GYAE6OF02IY8K4.29.78.H01.1.454.CMB.1.raw
  modified_base (393)..(393): a, c, t, g, unknown or other
  misc_feature (393)..(393): n is a, c, g, or t
  modified_base (661)..(661): a, c, t, g, unknown or other
  misc_feature (661)..(661): n is a, c, g, or t
tcagatagagtactcacgaccggtgctcgatttagtgtgagtagtttgggtttgggggcgcctgggtacggccgggggggtcgctgagactctccctgtgcggcctctggattaagttttaggagtcatgccatgaactgggtccgccaggctccagggaaggggctggagtgggtctcggctattagtggcagtggtggcgctatatattatgcagacgccctgaaggccgttcaccgatttcccagagacaattcgaagaacacgctgtatctgcaaatggagacgcctgagactcgacgtacacgccgtctattattgtgttaaaggcgaagcgttgaagtaccgggaccggggtccccgacttcgacccacgtcggggccagggggacncgtggtcctaccgtctccgtcacgccctccaaccgaacgggccccaagtccggtcccttcccccgtcggccctacccgtccctaccaacgacgtactaccgtcgtcggggccaaccgacgaccaccgcccgtgggacctcgacccgtttcggtaccgtaaacggtacccgttaaccgttaccgtacgttaccgtaccttaacttccggtagtaaccggggtcgggtaccgttacgggaccggaacgggtaccgaccggtacgtacggntacg

SEQ ID NO: 54471 - DNA, 585 bp, Homo sapiens
  misc_feature: GYAE6OF02HMSKV.29.78.H01.1.454.CMB.1.raw
  modified_base (584)..(584): a, c, t, g, unknown or other
  misc_feature (584)..(584): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaaagaacacgctgtatctgcaaatggagagcctgagactcgacgacacggccgtctattattgtagttaaaggcgagctaggaagtacgggaccggggccctacgttcgaccacgtcggggaccaggggacgcgtggtcaccgtctcctcacgcctccaccgaacgggcccacgtccggtccttcccccgtggcccaccctccctccaacgcgcacctcgtcggggacacgagccacgcccgtgggctcgccgtggtccaacggtactaccttccgacgtaccttcttacgtctaggacggtccggtcgtggcgaacggcgcgatgnc

SEQ ID NO: 54472 - DNA, 647 bp, Homo sapiens
  misc_feature: GYAE6OF02IOHT2.29.78.H01.1.454.CMB.1.raw
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgacaaagtggagagcctgagactcgacgacacggccgtctattattgtagttaaaggcgagctaggaagtacggggaccgggcctgacttgaccacggtcggggaccgaggggacgtcgtcggtccgaccgtctcctcgacgccctaccaccgaacggcccacgtccgtcccttccccgtcggccctaccctcctaccgaacgacgcctacccgtcgcggggacacgacgccgacggcccgtacgggcctcggcccgttcggtaccgaaacggtacccttaccgttaccgtacgttaccgttaccgtaacgttccgttacggaccggtccgggtaccgttacgggaccggaacggaccggacgtacgtagtcg

SEQ ID NO: 54473 - DNA, 634 bp, Homo sapiens
  misc_feature: GYAE6OF02IKGQE.29.78.H01.1.454.CMB.1.raw
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctaggaatacgggaccgggcccgacgttgaccacgtcggggccgaggggaccgcgtggtcaccgtctcctcacgccctccaccgaaggcccactccggtccttcccccgtcggcctaccctccctaccaacgacgcctaccgtcgtcgggggccacgacgcgacgcccgtgggcctcggccgttcggtaccgaaacggtaccttacccgttacccgtaacgttaccttaccgttacgtccgttacggacgggtccgggtacgttccgggaccgtaacggggcccggtacgaacgtacgagcg

SEQ ID NO: 54474 - DNA, 613 bp, Homo sapiens
  misc_feature: GYAE6OF02HOOAV.29.78.H01.1.454.CMB.1.raw
  modified_base (610)..(610): a, c, t, g, unknown or other
  misc_feature (610)..(610): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaaatggagagcctgagactcgacgacacggccgtctattattgtgttaaaggcgagctggaatacggggaccgggcccgattcgaccacgtcggggccaggggacgcgtggtcaccggtctccgtcacgccctccaccgaacgggcccacgtccggtccttcccccgtggccacccttcctccctaacgacgccaaccttccgtacgggggccacgcgccacgcccgtgggcctcggcccgtggtaccgaacgggtacctacccgttaccgacgttaccttcctacgtcgtcggacggccgggcgttggaccgaacggccgacgacgtacggntcg

SEQ ID NO: 54475 - DNA, 595 bp, Homo sapiens
  misc_feature: GYAE6OF02GBIRZ.29.78.H01.1.454.CMB.1.raw
  modified_base (502)..(502): a, c, t, g, unknown or other
  misc_feature (502)..(502): n is a, c, g, or t
  modified_base (555)..(555): a, c, t, g, unknown or other
  misc_feature (555)..(555): n is a, c, g, or t
  modified_base (594)..(595): a, c, t, g, unknown or other
  misc_feature (594)..(595): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgcctgaagggccgttcaccatttccagagacaattcgaaagaacacgctgtatctgacaaagtggagagcctgagactcgacgacacggccgtctattattgtagttaaaggcgaagctaggaataccggggaccgggccacgttgaccacgtcggggccgaggggacgcgtggtccaccgtctcctcgacgcctacccacgaacgggcccagtccggtcccttccccgcgcctaccctcctaccaacgacgccacctcggtcggggacacgagcacgtcccgngggcctcgcctcggtacgaaaggtaccttaacgtccacgttactctacgttcnggaacggccggcgtgggaccgtaaggccgacgagtacgnn

SEQ ID NO: 54476 - DNA, 598 bp, Homo sapiens
  misc_feature: GYAE6OF02HGC18.29.78.H01.1.454.CMB.1.raw
tcagatagagtactcacgaccggtgctcgatttagtgtgagtagtttgggtttggggtctgagagaggagtccacccctgggatcttcaggtgttttcatttggtgatcaggacggaacagagagaactcaccatggagtttgggctgagctggctttttcttgtggctattttaaaaggtgtccagtgtgacgtgcagttggtggagtctgggggcgcctgggtacggccgggggggtcgctgagactctcctgtgccggcctctggattaagttttaggagtcatgccatgaactgggtccgccaggctccgagggaaggggctgggagtgggtctcggctattaggtggcaggtggtggcgctatatattatgcagacgccctggaacgggtccggttcacctatttccagacacaattcgaaagaacacgctgtatctgacaaagtggagagcctagacgaccgtcgaacgacaccgggccttagttatttacgttggttagttaaagggcgagcgtaggaacgtaccggggacccggggcccgtacgtcggacccgtacggtcggggaccgacgggggactcgtaggtacccg

SEQ ID NO: 54477 - DNA, 575 bp, Homo sapiens
  misc_feature: GYAE6OF02IW0GO.29.78.H01.1.454.CMB.1.raw
  modified_base (308)..(308): a, c, t, g, unknown or other
  misc_feature (308)..(308): n is a, c, g, or t
  modified_base (322)..(322): a, c, t, g, unknown or other
  misc_feature (322)..(322): n is a, c, g, or t
  modified_base (337)..(337): a, c, t, g, unknown or other
  misc_feature (337)..(337): n is a, c, g, or t
  modified_base (451)..(451): a, c, t, g, unknown or other
  misc_feature (451)..(451): n is a, c, g, or t
  modified_base (496)..(496): a, c, t, g, unknown or other
  misc_feature (496)..(496): n is a, c, g, or t
  modified_base (571)..(571): a, c, t, g, unknown or other
  misc_feature (571)..(571): n is a, c, g, or t
  modified_base (575)..(575): a, c, t, g, unknown or other
  misc_feature (575)..(575): n is a, c, g, or t
tcagatagagtactcacgaccggtgctcgatttagtgtgagtagtttgggtttggtggtctctctcccagcctgtgctgactcaatcgccctctgcctctgcctccctgggaggctcggtcaaggtcacctgtactctgagcagtggacacagcagctacgccatcgcttggcatcagcagaggccagacacgggcctcgttacttgatgacagtcaacaatgatggcagtcacagcgaagggggacggatccctgactcgcttactcacgtctccagtctcgtgggcctgacgcgctactcacatcncgctcagtctgagntgagctgactatacngtacacgaccgtgggcacgtggactagttcgaggttccgtaccgggaccggggacctaagggtccacccggttcggtccggtacgaccgtaccccgaaaggccccgtaaacccncgttacgtacctaaccgttccgttcccgttaccccacccgttccncctaacgttacctcctaactccgtaacggcggtaccgggtccgttacgggacgtacggacgtacgtacgtacggntcgn

SEQ ID NO: 54478 - DNA, 635 bp, Homo sapiens
  misc_feature: GYAE6OF02FJGMQ.29.78.H01.1.454.CMB.1.raw
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacattcgaagaacacgctgtatctgcaaatggagagcctgagactcgacgacacggccgtctattattgtgttaaaggcgagctggaatacgggaccggggcccgacttgaccacgtggggccaggggacgctggtcaccggtctccgtcacgcctccaccgagggcccatccggtccttccccccgtcgggccaccccgtccctaccaacgacgccaaccctccgtcgggggcctacgacgccaacgccccgtgggcctcgtcccgtacggttccgaaacgggtaccttaaccgtttcccgaagttaccgttcctaacgttcccgtaggtaaccgggccgggtccgtcgggaccgaaacgggtcccggaccgaacgttacggcac

SEQ ID NO: 54479 - DNA, 591 bp, Homo sapiens
  misc_feature: GYAE6OF02I0WW5.29.78.H01.1.454.CMB.1.raw
  modified_base (413)..(413): a, c, t, g, unknown or other
  misc_feature (413)..(413): n is a, c, g, or t
  modified_base (454)..(454): a, c, t, g, unknown or other
  misc_feature (454)..(454): n is a, c, g, or t
  modified_base (589)..(589): a, c, t, g, unknown or other
  misc_feature (589)..(589): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacaccggccgtctattattgtaggttaaaggcgagctggaactacggggaccggggcccgacttcgaccacgtggggccgaggggacgcgtggtcaccgtctccctcacgccnccaaccgaacgggcccagtccggtccttcccccgtggcccnccctccctccaacgcgccacctcgtcggggcacgacgcacgccgtcgggcctgcctggtaccgaaacgggtacctaccgttccacgttactctactcgtaggacggtcgggtctagggacgacggcgcgactgancg

SEQ ID NO: 54480 - DNA, 698 bp, Homo sapiens
  misc_feature: GYAE6OF02H9CSL.29.78.H01.1.454.CMB.1.raw
  modified_base (244)..(244): a, c, t, g, unknown or other
  misc_feature (244)..(244): n is a, c, g, or t
  modified_base (310)..(310): a, c, t, g, unknown or other
  misc_feature (310)..(310): n is a, c, g, or t
tcagatagagtactcacgaccggtgctcgatttagtgtgagtagtttgggtttggggtctgagagaggagtccacccctgggatcttcaggtgttttcatttggtgatcaggacggaacagagagaactcaccatggagtttgggctgagcgtgtcttttctagtggctattttaaaaggtgtccagtgtgacgtgcagttggtggagtcgtgggggcgccgtgggtacgggccgggggggtcnctgagctctcctgtgcggcctcgtggtattaagtttaggagtcatgaccagtgaacgtgggtcccnccgaggcctaccgaggggaacggggctgggaggtggggtctcggacttagttagtggacgaggttgggtggcgctagtatattagtgcgagaccgccgtaggaacgggtccgttacacctacttccagacgactaagttacgaaagacaacgtcgtagtactcgtagaactaaagtggaacaggtacctaggacgtaaccgtaccggaaccgacccgtaccgggtaccgttacgttaagttacgtttacggtaaacggttaaaagggtccgtagtacgtacgggtaaaccgggtacccggggggaacccggggtaccccgtaagtttaccggaacccgtacgggtacggggtaccccggagggggtacccgtcggttaccggtacccg

SEQ ID NO: 54481 - DNA, 149 bp, Homo sapiens
  misc_feature: GYAE6OF02H7II9.29.78.H01.1.454.CMB.1.raw
  modified_base (144)..(149): a, c, t, g, unknown or other
  misc_feature (144)..(149): n is a, c, g, or t
tcagatagagtactcacgaccggtgctcgatttagtgtgagtagtttgggtttgggggtctccactcccgccttgacggggctgccatcagcccaaggccaaccccactgtcactctgttcccgccctcctcagtactctatcnnnnnn

SEQ ID NO: 54482 - DNA, 550 bp, Homo sapiens
  misc_feature: GYAE6OF02HDZ7C.29.78.H01.1.454.CMB.1.raw
  modified_base (384)..(384): a, c, t, g, unknown or other
  misc_feature (384)..(384): n is a, c, g, or t
  modified_base (542)..(542): a, c, t, g, unknown or other
  misc_feature (542)..(542): n is a, c, g, or t
  modified_base (549)..(550): a, c, t, g, unknown or other
  misc_feature (549)..(550): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattacttgtgttaaaggccgtaagcttggaatacgggaccggggcccacttgaccactggggccagggggacncgtggtcaccggtctcctcagcctccaccgaagggcccagtcggtccttcccccgtggccaccctcctccaagacgcacctcgtcggggcacgagcacgccgtggctgcctggtcaaggactacttccagtactctatctgagcggctggcaacggcncgatagnn

SEQ ID NO: 54483 - DNA, 624 bp, Homo sapiens
  misc_feature: GYAE6OF02ICZ1X.29.78.H01.1.454.CMB.1.raw
  modified_base (621)..(621): a, c, t, g, unknown or other
  misc_feature (621)..(621): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagacacgctgtatctgcaaatggagagcctgagactcgacgacacggccgtctattattgtgttaaaggcgagctaggaagtaccgggaccggggcccgacgttcgaccacgtggggccgaaggggcgctggtcaccgtcctcctcagccctaccaccgaacgggcccagtcccggtccttcccccgtcgccctaccctccctacctaacgacgacctacccgtcgtcggggaccaacgacgccgacgcccgtacggggcctcgtcccgtggtaccaacgggtaccttaccttcccgagttaccttacttacgtcctacggacggccggggtcgtcgggaccgaacgggccgtacgacgtacgntcg

SEQ ID NO: 54484 - DNA, 628 bp, Homo sapiens
  misc_feature: GYAE6OF02GYV7J.29.78.H01.1.454.CMB.1.raw
  modified_base (385)..(385): a, c, t, g, unknown or other
  misc_feature (385)..(385): n is a, c, g, or t
  modified_base (625)..(625): a, c, t, g, unknown or other
  misc_feature (625)..(625): n is a, c, g, or t
tcagatagagtactcacgaccggtgctcgatttagtgtgagtagtttgggtttgggggcgcctgggtacggccgggggggtcgctgagactctcctgtgcggcctctggattaagtttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtagttaaaggcgaggctggaatacggggaccggggcccgacttgaccacgtgggggccagggggacncgtgggtccaccggtctcctcacgccctccaccgaacgggcccacgtccggtccttcccccgtcggcccaccctccgtaccaagacgacacccgtcgtcggggccacgacgccgacgtcccgtgggcctcgcccgtcggtaccgaacgggtaccttaaccgttaccgtacgttacctaccttacgtccgtggtacgggccgggtcgtacgggacgaacgggtccggtacgacgttacggntcg

SEQ ID NO: 54485 - DNA, 823 bp, Homo sapiens
  misc_feature: GYAE6OF02IGJV1.29.78.H01.1.454.CMB.1.raw
tcagatagagtactcacgaccggtgctcgatttagtgtgagtagtttgggtttgggggtccgagccatggtgcagactccccagagctctcctcctcctccactgcacagggtctctctcccagcctgtgctgactcaatccgccctctgccctctgcctccctgggaggctcggtcaaggtcacctgtactctgagcagtggacacagcagctacgccatcgcttggcatcagcagaggccagacgacgggccctcgttactgatgacagtcaacatgatggcagtcacaggcgaagggggacgactcccgtagactcgtacttctctacggtcctccgacgtccgtcgttcgggacccttggaaccgtccgacccttaccctacgaaccgtaacttcccttcccccggggtaccccttcccggtaacggttccgttgggaaacgggtacgttacggggaaccggttcccttacgggtaaactttttaccgtttaaccgttacgggttaccccgtaaccggggttacccgggttacggggggtaaccctaaccggggtttccgggtaaccgtttaaccggtttttaccggggtaacccgggggttttccgggttttaacccccgggggggaaaccccggggggttaacccgttaaaccggggggttcccttacccgggggttttccgggttaccccggggtaccggtaaccccgggtaacccccccgggaaacgggttcccccccgtaaaaccccccggttccggttacccgggtaacccgtaccccggttttaccccgttcccggtttacccccccccggg

SEQ ID NO: 54486 - DNA, 642 bp, Homo sapiens
  misc_feature: GYAE6OF02JETY9.29.78.H01.1.454.CMB.1.raw
  modified_base (151)..(151): a, c, t, g, unknown or other
  misc_feature (151)..(151): n is a, c, g, or t
  modified_base (344)..(344): a, c, t, g, unknown or other
  misc_feature (344)..(344): n is a, c, g, or t
tcagatagagtactcacgaccggtgctcgatttagtgtgagtagtttgggtttggagtctgcaccatggctcggaccccactcctcttcctcaccctcctcctccactgcacagggtctctctcccagcctgtgctgactcaatcgccctntgcctctgcctcccgtgggagctcggtcaaggtcacctgtactctgagcagtggacacagcagctacgccatcgcttggcatcagcaggacggccagaccgaccgggtcccttacgttacttgatgacagtacaaacaatgatggcagtcaacgaggcggaaagggggcgactccgtgactcgtcttacctcncgtcctccgagtcctcggtcgggtcctggacgtccgtacccttaccgtcaacctaacgttcccgtcccggtacccttaccgacggttacgtacgagggtacgtaggacggtcttacgtacttacgttacgtcgtacacggtaccggtgggacctacggcggtactacgttcgtacgggtccggttacccggggaaccgggtaccgtacgggttccggaccggttcggtacccggttacaacccgggtaccaccggacccctaacccgtaccggtcctaccgtaccgttccgttacccg

SEQ ID NO: 54487 - DNA, 611 bp, Homo sapiens
  misc_feature: GYAE6OF02GPM3R.29.78.H01.1.454.CMB.1.raw
  modified_base (266)..(266): a, c, t, g, unknown or other
  misc_feature (266)..(266): n is a, c, g, or t
  modified_base (609)..(609): a, c, t, g, unknown or other
  misc_feature (609)..(609): n is a, c, g, or t
tcagatagagtactcacgaccggtgctcgatttagtgtgagtagtttgggtttggtggtctctctcccagcctgtgctgactcaatcgccctctgcctctgcctccctgggaggctcggtcaaggtcacctgtactctgagcagtggacacagcagctacgccatcgcttggcatcagcagaggccagacacgggccctcgttacttgatgacagtcaacaatgatggcagtcacagcgaagggggacggatccctgatcgcttcncagtctccagctcgtgggcctggacgcgcctacctcactaactcctccggcctccgagtctgacggatcggaggctgaacttattacgtgtaccagaccgtggggacacgtggctagtttcgacgggttcgttacggggaacccggggtaccaaacgggtcctaaccggtcggtaccggtccacggtaccccgaaacgggccccaaaccccgtacgtacggtaccctaccgtttacccgtccgtttcccccgacccttcctaccgtacgttacccttccgtacgttccgtcggaacgggtcccgggtaccgttcggaccgaacgggccgtacgaacgtcgctncg

SEQ ID NO: 54488 - DNA, 596 bp, Homo sapiens
  misc_feature: GYAE6OF02FTH6U.29.78.H01.1.454.CMB.1.raw
  modified_base (381)..(381): a, c, t, g, unknown or other
  misc_feature (381)..(381): n is a, c, g, or t
  modified_base (503)..(503): a, c, t, g, unknown or other
  misc_feature (503)..(503): n is a, c, g, or t
  modified_base (594)..(594): a, c, t, g, unknown or other
  misc_feature (594)..(594): n is a, c, g, or t
tcagatagagtactcacgaccggtgctcgatttagtgtgagtagtttgggtttgggggcgcctgggtacggccgggggggtcgctgagactctcctgtgcggcctcgtggattaagtttaggagtcatgccatgaactgggtccgccaggctccagggaaggggctggagtgggtctcggctattagtggcagtggtggcgctatatattatgcagacgccctgaagggccgttcaccatttccagagacaattcgaagaacacgctgtatctgcaaatggagagcctgagactgacgacacgccgtctattattgtgttaaaggcgagctaggaatacgggaccgggcccgacgttcgaccacgtggggcccaggggacncgtggcaccgtctcctcacgccctccgaccgacggcccacgtccggtccttcccccgtcggcccacccgtccctacccgaacgacgccacccgtcgtcggggccacgacgccgacgtcccgngggccgtcgtccgtcggtccaacggtacctaccgttccacgttactctactcgtcgacggcggtcgtggccgacggtccgcgacgttacgncg

SEQ ID NO: 54489 - DNA, 562 bp, Homo sapiens
  misc_feature: GYAE6OF02GE2PD.29.78.H01.1.454.CMB.1.raw
  modified_base (184)..(184): a, c, t, g, unknown or other
  misc_feature (184)..(184): n is a, c, g, or t
  modified_base (241)..(241): a, c, t, g, unknown or other
  misc_feature (241)..(241): n is a, c, g, or t
  modified_base (302)..(302): a, c, t, g, unknown or other
  misc_feature (302)..(302): n is a, c, g, or t
  modified_base (374)..(374): a, c, t, g, unknown or other
  misc_feature (374)..(374): n is a, c, g, or t
  modified_base (427)..(427): a, c, t, g, unknown or other
  misc_feature (427)..(427): n is a, c, g, or t
  modified_base (440)..(440): a, c, t, g, unknown or other
  misc_feature (440)..(440): n is a, c, g, or t
  modified_base (458)..(458): a, c, t, g, unknown or other
  misc_feature (458)..(458): n is a, c, g, or t
tcagatagagtactcacgaccggtgctcgatttagtgtgagtagtttgggtttggggtctgagagaggagtccacccctgggatcttcaggtgttttcatttggtgatcaggacggaacagagagaactcaccatggagtttgggctgagcggtgtgtttctaggtcggctaattttaaaaggntccagtgtgacgtgcagttggtggagtctggggcgcctgggtacggccgggggggtnctgagactctcctgtgcggcctctggattaagttttggagtcatgccatgaactgggtccnccaggctccgagggaacgggctggagtgggtctcgggcttagtagtcggcaggtggtagcgctatatattangcagacgcctagacggtcgtcactattcagagactatcgaagacacgctgtancgtgacaatgganacgcctgatcacgacacncgtctactattacttgtagttaaagcgagtcgtaggtacgtacggggaccgggtacccgtagttcgaccgtacggtacggggccaggggctcgtacggtacccg

SEQ ID NO: 54490 - DNA, 667 bp, Homo sapiens
  misc_feature: GYAE6OF02I1KYD.29.78.H01.1.454.CMB.1.raw
  modified_base (244)..(244): a, c, t, g, unknown or other
  misc_feature (244)..(244): n is a, c, g, or t
tcagatagagtactcacgaccggtgctcgatttagtgtgagtagtttgggtttggggtctgagagaggagtccacccctgggatcttcaggtgttttcatttggtgatcaggacggaacagagagaactcaccatggagtttgggctgagctggctttttcttgtggctattttaaaaggtgtccagtgtgacgtgcagttggtggagtcgtgggggcgcctggggtacgggccgggggggtcnctgagactctcctgtgcggcctctggattaagtttggagtcatgccatgaactgggtccgccaggctccgaggggaaggggctgggaggtgggtctcggctagttagtggcagtgggtggcgtctatatattatgcagacgccctggaaggggtccgttcacctatttccagacgactaattcgaaagaacacgctgtatctagactaaagtggagacgcctagagaccgtacggaaccgacgaacccgggtcccgttctttaaacgtttacgtttacggttaaggtttaaaacgggcggtaagtcggttagggaaacgggttaacccggggggaccccggggtacccggtaacgtttaccggaaccccgtacgggtcggggggaacccggtaggggggacccgtcggttaccgggttacccg

SEQ ID NO: 54491 - DNA, 707 bp, Homo sapiens
  misc_feature: GYAE6OF02IXI1D.29.78.H01.1.454.CMB.1.raw
  modified_base (326)..(326): a, c, t, g, unknown or other
  misc_feature (326)..(326): n is a, c, g, or t
tcagatagagtactcacgaccggtgctcgatttagtgtgagtagtttgggtttggggtccgagccatggtgcagactccccagagctctcctcctcctccactgcacagggtctctctcccagcctgtgctgactcaatcgccctctgcctctgcctccctgggaggctcggtcaaggtcacctgtactctgagcagtggacacagcagctacgccatcgcttggcatcagcagacggccagacaccgggccctcgttactgatgacagtcaacatgatggcagtcacgaggacggaagggggacggatcccgtgactcgtcttcncagtcctccagtctcgtcgggcctggacgccgtaccttaccctacaacctaacttcccgtccccgggtccctacccgtaacgttccggtacggaacgggtacgttacgggacgggtccttacgggtaaactttacgtttaccgtcggttacccgaacgggtacccggttacggggggacctacggttccgggctttaacgtttacccggtacggggtttcccgttacccgggggaaacccggggtaaccgtaccggggttacccgtacccggttccgggttaccgggtacccgaaccggtaacccccgtaaccgggaccccctaaacccccgtacgttaccggttaccctaacccgtttccgtaccccgtttacccccccg

SEQ ID NO: 54492 - DNA, 667 bp, Homo sapiens
  misc_feature: GYAE6OF02HRTU1.29.78.H01.1.454.CMB.1.raw
tcagatagagtactcacgaccggtgctcgatttagtgtgagtagtttgggtttggggtctgagagaggagtccacccctgggatcttcaggtgttttcatttggtgatcaggacggaacagagagaactcaccatggagtttgggctgagctggtctttttcttgtggctattttaaaaggtgtccagtgtgacgtgcagttggtggagtcgtgggggcgccgtgggtacgggccgggggggtcgcgtgagactctccgtgtcgcggcctctggattaagtttaggagtcatgcatgaacgtcgggtcccgccaggctccgaaggggaagggcgtggaggtgggtctcggcttagttaggtggcgtaggtgggtggcgtcttaatattagttatgacaacggaccgtaccctagggtaacggggtcccgttaccaacccgttacttttaccgaaggaacgtaactaaacgtttaccggaaacgaaccgaacgtacttaggtactctagacaaagttggaagagtccgtagacgacgtacgaccgacgacggtccgtacttagttacgttagtagtaaaggcgagtcgtaggaacggtacggggacccgggtccgtacgttacggaccgacggtcggggaccggacggggaccgtcggtcggtacccg

SEQ ID NO: 54493 - DNA, 610 bp, Homo sapiens
  misc_feature: GYAE6OF02I2KG2.29.78.H01.1.454.CMB.1.raw
  modified_base (608)..(608): a, c, t, g, unknown or other
  misc_feature (608)..(608): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtggttaaaggcgagctggaacgtacgggaccggggcccgacgttgacccacgtggggccgaggggacgcgtggtccgaccgtctcctcacgccctacccaacccgaacgggacccgacgtaccggtccgttcccccgtccggccctaccctccctacccgaacgacgccacctcgtcgggcacacgcacgccgtcggcgtcgtccgtcggtcgaacggacctaccttaccgtacgtactaccttacgtcgtacgcggacggtcgtggacgaacggaccgcgacagtttncg

SEQ ID NO: 54494 - DNA, 567 bp, Homo sapiens
  misc_feature: GYAE6OF02HNM5E.29.78.H01.1.454.CMB.1.raw
  modified_base (382)..(382): a, c, t, g, unknown or other
  misc_feature (382)..(382): n is a, c, g, or t
  modified_base (565)..(566): a, c, t, g, unknown or other
  misc_feature (565)..(566): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggcccgtctattattgtgttaaaggcgagctggaatacgggaccggggcccgacttgaccactggggccagggggacnctggtcaccgtctcctcagcctccaccaaggcccatcggtcttccccctgccaccctcctccaagacgccaccctcgtcgggggccacgacgccacgccccgtgggcctcgcccgtgggtcaacgggactaaccgttccacgtacctcttactctgacggcgggctggcaaggccgacatagnng

SEQ ID NO: 54495 - DNA, 573 bp, Homo sapiens
  misc_feature: GYAE6OF02F689E.29.78.H01.1.454.CMB.1.raw
  modified_base (571)..(571): a, c, t, g, unknown or other
  misc_feature (571)..(571): n is a, c, g, or t
  modified_base (573)..(573): a, c, t, g, unknown or other
  misc_feature (573)..(573): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccgggcccgacttgaccacgtggggccaggggacgcgtggtcaccgtctcctcacgcctccaccgacggcccagtccggtccttccccctcggcccaccctccctaccaacgacgccacctcgtcggggcacgagcacgccgtcgggctcgccgtggtacgaacggactacgttccgagtactctactctgacggcggtcgtcgggcgacggccgacgacgtacgngn

SEQ ID NO: 54496 - DNA, 622 bp, Homo sapiens
  misc_feature: GYAE6OF02I2AO4.29.78.H01.1.454.CMB.1.raw
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgacaaatggagagcctgagactcgacgacacggccgtctattattgtgttaaaggcgagctgggaatacggggaccgggcccgattcgaccacgtcggggcaggggaccgctgggtcaccggtctcctcagcctccacaacgggcccagtcgtctccccctcggccaccctcctaccgaacgacgcacctcgtcggggccacgacgcacgtcccgacgggtcctcgccgtgggtccgtaacgggtaccttaacccgttaccctaacgggttaccttaccgttaactcgttacggacgggtcccgggtccgttagggaccggtaacgggtccgacggacgtaggtcgac

SEQ ID NO: 54497 - DNA, 171 bp, Homo sapiens
  misc_feature: GYAE6OF02F130T.29.78.H01.1.454.CMB.1.raw
  modified_base (168)..(171): a, c, t, g, unknown or other
  misc_feature (168)..(171): n is a, c, g, or t
tcagatagagtactcacgaccggtgctcgatttagtgtgagtagtttgggtttgggggtctccactcccgccttgacggggctgccatcagcccaaggccaaccccactgtcactctgttcccgccctcctcagtactctatctgagcgggctggcaaggcgcatagnnnn

SEQ ID NO: 54498 - DNA, 699 bp, Homo sapiens
  misc_feature: GYAE6OF02H9QVW.29.78.H01.1.454.CMB.1.raw
tcagatagagtactcacgaccggtgctcgatttagtgtgagtagtttgggtttggagtctgcaccatggctcggaccccactcctcttcctcacccctcctcctccactgcacagggtctctctcccagcctgtgctgactcaatccgccctctgcctctgcctcactgggagctcggtcaaggtccactgtactctgagcagtggacacagcagctacgctatcgcttggcatcagcagacgcagacgcggcctcgttactgatgacagtacaactaagtgtaagtcggacagtacaacgacgacggaacgggggaccggtactcccgttagacgtccgtacgttcctacgtaacgtccgttaccaggtccttcggtcggggccttaggacgtccgacctttaacccaccgtaacgtaacttccccgtaacccgggtccttacccggtaacggttcgtacgggagacgtaggaacgggtctttacggaactttacgtttaacgtcgtaccgacggttacccggtaggggcctaacggttcggaaccttaacgtttccggtaacggttacccgggttaaccggggaacccggggttaccgtaaaccgggttccgaacccggttcggttaccggacccgttaaccgaacccggtaaccggccccaaaccccggttagtcgttaccccgacgtttaccccg

SEQ ID NO: 54499 - DNA, 586 bp, Homo sapiens
  misc_feature: GYAE6OF02ICIYF.29.78.H01.1.454.CMB.1.raw
  modified_base (319)..(319): a, c, t, g, unknown or other
  misc_feature (319)..(319): n is a, c, g, or t
  modified_base (374)..(374): a, c, t, g, unknown or other
  misc_feature (374)..(374): n is a, c, g, or t
  modified_base (386)..(386): a, c, t, g, unknown or other
  misc_feature (386)..(386): n is a, c, g, or t
  modified_base (585)..(586): a, c, t, g, unknown or other
  misc_feature (585)..(586): n is a, c, g, or t
tcagatagagtactcacgaccggtgctcgatttagtgtgagtagtttgggtttggggcgcctgggtacggccggggggtcgctgagactctcctgtgcggcctctggattaagtttaggagtcatgccatgaactgggtccgccaggctccagggaaggggctggagtgggtctcggctattagtggcagtggtggcgctatatattatgcagacgccctgaagggccggttcaccatttccagagaacaattcgaaagaacacgctgtatctgacaaatggagagcctgagactcgacgacacggcctctattattgngttaaagcgagctggaatacgggaccgggcccatcgacactggggccaggggacnctggtcacgtcnctcagcctccacaaggccagtccgtcttccccctgccaccctcctaccaagacgcacctcgtcggggcaacgcgcgaacgtcccgtcggtcgtcgccgttacgggttaccgaaacgggcctaaaccgtttccaacggttacttaccgttaatcgacggttacggccgggtccgtggaccgaacgccgggaccagtacgnn

SEQ ID NO: 54500 - DNA, 604 bp, Homo sapiens
  misc_feature: GYAE6OF02GONMF.29.78.H01.1.454.CMB.1.raw
  modified_base (422)..(422): a, c, t, g, unknown or other
  misc_feature (422)..(422): n is a, c, g, or t
  modified_base (602)..(602): a, c, t, g, unknown or other
  misc_feature (602)..(602): n is a, c, g, or t
tcagatagagtactcacgaccggtgctcgatttagtgtgagtagtttgggtttgggggcgccgtgggtacggccgggggggtcggcgtgagactctcctgtgcggcctctggattaagttttaggagtcatgccatgaactgggtccgccaggctccagggaagggctggaggtgggtcgtcggctattagtggcagtggtggcgctatatattatgcagacgccctgaagggcggttcacatttccagagacaattcgaagaacacgctgtatctgacaaatggagagcctgagactgacgacgacggcctactattacttgtagttaaaggcgaagctaggaagtacgggtacccggggcccgtacttcggaccgtaacgtgggggacccgagggggaccgcgtcgggtaccaccgttcncccgtcacgcctaccaacgaacggcccagtccggtccttcccccgtcggtcccacccctcctacccaacgacgccaccgtcgtcggggccacgacgcacgcccgcggcgtcgccgtgcgaacgactaccttcacgtactctacgtctgacggtcggcgtggacgacggcgacgacgtagngc

SEQ ID NO: 54501 - DNA, 594 bp, Homo sapiens
  misc_feature: GYAE6OF02G0DK3.29.78.H01.1.454.CMB.1.raw
  modified_base (331)..(331): a, c, t, g, unknown or other
  misc_feature (331)..(331): n is a, c, g, or t
  modified_base (339)..(339): a, c, t, g, unknown or other
  misc_feature (339)..(339): n is a, c, g, or t
  modified_base (365)..(365): a, c, t, g, unknown or other
  misc_feature (365)..(365): n is a, c, g, or t
tcagatagagtactcacgaccggtgctcgatttagtgtgagtagtttgggtttggggtccgagccatggtgcagactccccagagctctcctcctcctccactgcacagggtctctctcccagcctgtgctgactcaatcgccctctgcctctgcctcctgggaggctcggtcaaggtcacctgtactctgagcagtggacacagcagctacgccatcgcttggcatcagcagaggccagacacgggccctcgttacttgatgacagtacaaacaatgatggacacgtcacgaggcggaaggggggaccggactcccgtgactccgcttcncgacgtcncgagctcgcggctgacgcgtctaccncacactcccgccgcctccgagtcgtaggaggctaggacgtctagtacttagttacgcgtacgacgtaccggtggggactacggtacggtctaggtttacgacgggtttccggtaccgggaaccgggtaccgtaacgggtccctaccgggttcggtccggacgaccggacccgaaccggtaccctaaccccgtgttccggtaccctaccgttccgtacccgttacccccc

SEQ ID NO: 54502 - DNA, 593 bp, Homo sapiens
  misc_feature: GYAE6OF02IWJIF.29.78.H01.1.454.CMB.1.raw
tcagatagagtactcacgaccggtgctcgatttagtgtgagtagtttgggtttggggtccgagccatggtgcagactccccagagctctcctcctcctccactgcacgagggtctctctcccagcctgtgctgactcaatccgccctctgcctctcgccctcccgtgggaggctcggtcgaaggtccacctgtactctgagcagtggacacgagcagctacgccatcgcgttggcatcgagcaggacggccagaccgaccgggccttcgttacttgatgactagtcaaacagtgagtggcacgtacacgaggacggtaaagggggacgtactcctaggactcgtcttcgacgtacgtcctcgtacgcttcggtacggcctagacgtcctccgtaactcgaactacgtccgtccggtcctcgtacgtcgtacgaggtacgtaggacgtctacgtacttattcgtctagacgacggtgcgacgtgctagtacgtcgtaccggtcgggaaccggtcgtaccggtcgtacggttccggacggtccgaccggaccgtaccgacccgtacctcgtccgtactcgtccgtacctaccccg

SEQ ID NO: 54503 - DNA, 780 bp, Homo sapiens
  misc_feature: GYAE6OF02F6EIB.29.78.H01.1.454.CMB.1.raw
tcagatagagtactcacgaccggtgctcgatttagtgtgagtagtttgggtttgggggcgcctgggtacggccgggggggtcgctgagactctcctgtgcggcctctggatttaagtttaggagtcatgccatgaacgtgggtccgccgaggcctccgaggggaacgggctgggaggttgggtcgtcgggcttagttaggtggcaggtgggtggcgctatatattatgcagaccgcctaggaacgggtccgttccaacctatttccgaagagaactaagttacgaaacgaacacgtctagtatctgacaaagtggagacgctgagactacgacgacgaccggtcctacttaatttacgttaggtaaggttaaacggcgtaaggtcgtaaggaacggtaccgggggacccgggaccgtacgttacgacccgtacggtcggggaccggaggggaccgtcgttcggtacctaccgtcctcccgacgaccgtcccttacccgaaacccggaccgggaccccgtacgttcccggttccccgttcccccggtcggtacccctaccccgttacccctacccgaacggaccgtacccgtacccgttccggtaccggggccaaccgacgaccgaccggtcccggtacggtccgtaccgtcccggtacgtaaccgaacggtaccgttaccgttaccgtaacgttaccgttaccttacgttccggtacggtacgggtcccgggtaccggttacgggacccggtaacgggtccggtacgaacgttagacgcg

SEQ ID NO: 54504 - DNA, 654 bp, Homo sapiens
  misc_feature: GYAE6OF02HJL9O.29.78.H01.1.454.CMB.1.raw
  modified_base (333)..(333): a, c, t, g, unknown or other
  misc_feature (333)..(333): n is a, c, g, or t
tcagatagagtactcacgaccggtgctcgatttagtgtgagtagtttgggtttggggtccgagccatggtgcagactccccagagctctcctcctcctccactgcacagggtctctctcccagcctgtgctgactcaatcgccctctgcctctgccctccctgggaggctcggtcaaggtccacctgtactctgagcaggtggacacagcagctacgccatcgtcttggcatcagcagaggccagaccacggcccttcgttactgatgacagtcaaacatgagtggcagtcacgaggacgaaggggggaccgactcccgtagactccgcttcnctagtcctcagccttcgtcgggcctgacgccgtacctacccgtcaacctaactcccgtaccccggcccttcccgtaacgtcgtaggagggtacgtacggacggtccgtagttaacctttacgttacgtcgtaccgaacggtcccggtaggggtacctacggtcggtcctagtttaccgacgggttaccgttaccggggaacccggggacctaacggggtcccgtaaccggtccgggtccggtaccaacccggacccccgaaccggtacccccgaacccgtaccgtcgtacccgtaccgttccgttaccccggttccccccg

SEQ ID NO: 54505 - DNA, 726 bp, Homo sapiens
  misc_feature: GYAE6OF02IH6JH.29.78.H01.1.454.CMB.1.raw
tcagatagagtactcacgaccggtgctcgatttagtgtgagtagtttggggtttggggagagctctggggagtctgcaccatggctcggaccccactcctcttcctcaccctcctcctccactgcacagggtctcttctccagcctgtgctgactcaatcgccctctgcctctcgcctaccctgggagctcggtcaaagggtcaaccgtgtactctgagcagtgacacgagcagctaacgcctatcgcttggacactcgagacgtaacgacggaccaggtaaccgtaacccgggccccttacggtttaaccttggtaacgtccgaaacctaacggtaccgtaaaaccgaagttggaaactcgggacctaacggttaccaacgtaacggaccggggaaaacgggggtccggtacttaccgtagtactccggtacctttcctacgacgtccgtcccgagtccgttacggtcgggtaccttggaccgtccgtacctaaccgtaccgaaacgtaaccgttccgtaacccgggccttacccgtagttcccgtaggaacggtacgtcgacggtctacgtaccttagttaccgtacgttacgaacgtaccggtcgggaccacggttcggaacctagttccgaggttaccgtcggggaaccgggtaacctcggtacccgtaccgtcggttcgaccggtacccgacccggtaacggtaccccgtaaccgtaccgg

SEQ ID NO: 54506 - DNA, 634 bp, Homo sapiens
  misc_feature: GYAE6OF02GHNL1.29.78.H01.1.454.CMB.1.raw
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctaggaatacgggaccgggcccgacttgaccacgtggggccaggggacgcgtggtcaccgtctcctcacgcctccaccaacgggcccacgtccggtccttccccccgtcggccaccctccctccaacgacgccaccctcgtcgggggccacgacgccgacgcccgtcgggccgtcggtcccgtcgggttaccgaacgggtaccgttaccgtttacccgtacgttaccttccgttaacgttccgttacggacgggaccgggtccgttgggaccgaaccgggtccgaccgtacgttacgcgtcg

SEQ ID NO: 54507 - DNA, 741 bp, Homo sapiens
  misc_feature: GYAE6OF02JBGY6.29.78.H01.1.454.CMB.1.raw
  modified_base (250)..(250): a, c, t, g, unknown or other
  misc_feature (250)..(250): n is a, c, g, or t
tcagatagagtactcacgaccggtgctcgatttagtgtgagtagtttgggtttgggggtctgagagaggagtccgacccctggggatcgttccaaggtgttttcgatttggtgatccaggcggtacagtagagaacttcaccatggagtttggctgagctggcttttctgtgctagtttaaaggtcgtcctagtgtcgaccgtgctagttggtggagtcgtggggcgcgtgggtaccggccggggggtcncgtgagactctcctgtgcggtccttgtcggacttaacgtttagacgtctatgccagtcgaacgtcggtacgacgaggctccggagggaacgggtactcggaggttcggtcgtcgggtacttacgttcggcggacgtagggtcggtacggcgtcttaatagtacgttagtcggtcgtaacggaccgtcccgttacggaaacggggtcccgtttaaccaaccgttacgtttacccgaaggtaccgaaacgttacgttacgggaaacggtaacccgacggtaccgttaaggtaacttccggtaacgggtacttaaggttacgggtaacgtacgtacgtagtacgtactacggtaccgttaccgtacggtccgttacgttacgtttaggttacggttacggtaaacgtcgtaggtaccgttaggtaaacggtaaccggggtaccgggtccctaaggttccgacgtcggtcgggacgtacgggctccgtagtcccg

SEQ ID NO: 54508 - DNA, 603 bp, Homo sapiens
  misc_feature: GYAE6OF02I9FNM.29.78.H01.1.454.CMB.1.raw
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggttccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtagttaaaggcgagctggaatacggggaccgggcccgacgttgaccactgggccaggggacgctgggtcaccgtctcctcacgcctccaccgaaggccccacgtccggtccttccccctcggccaccctcctcccaagacgccaccgtcgtcggggcacgcgccacgcccgtcgggcctacgccgttcggtccgaaacggtaaccttaccttcccgaacgttacctactactccgtggtacggccgggtacgtacggaccgaacggccggactaacgtagcagc

SEQ ID NO: 54509 - DNA, 610 bp, Homo sapiens
  misc_feature: GYAE6OF02I1BNX.29.78.H01.1.454.CMB.1.raw
  modified_base (310)..(310): a, c, t, g, unknown or other
  misc_feature (310)..(310): n is a, c, g, or t
tcagatagagtactcacgaccggtgctcgatttagtgtgagtagtttgggtttggggggaagaggaagactgacggtccacccctgggatcttcaggtgttttcatttggtgatcaggacggaacagagagaactcaccatggagtttgggctgagctggctttttcttgtggctattttaaaaggtgtccagtgtgacgtgcagttggtggagtctgggggcgcctgggtacggccgggggggtcgctgagactctcctgtgcggcctctggatttaagttttaggagtcatgccatgaactgggtccnccaggctccgaggggaaggggctggagtggggtctcggctagttagtggcaggtggtggcgctatatattagtgcagaccgccctaggaacggggtcccgttcaccctagtttcccaagacgacaaagttcgaaagaacacgcttagtatctgactaaagtggagagcctagagactcgacgacgacggcctctattattgtagttaaaggcgagcgtaggaacggtaccggggacccggggaccctacgttacggaccctacgggtcggggaccgaagggggccgtcggtcggtacccg

SEQ ID NO: 54510 - DNA, 671 bp, Homo sapiens
  misc_feature: GYAE6OF02G2LGI.29.78.H01.1.454.CMB.1.raw
  modified_base (239)..(239): a, c, t, g, unknown or other
  misc_feature (239)..(239): n is a, c, g, or t
  modified_base (374)..(374): a, c, t, g, unknown or other
  misc_feature (374)..(374): n is a, c, g, or t
tcagatagagtactcacgaccggtgctcgatttagtgtgagtagtttgggtttggggggagagaggagtccacccctgggatcttcaggtgttttcatttggtgatcaggacggaacagagagaactcaccatggagtttgggctgagcgtgtcgtttctaggtggctatttaaaaggtgtcagtgtgacgtgcagttggtggagtcgtggggcgccgtggggtacggccggggggtcncgtgagactctcctgtcgcgcctctggtattaagtttaggatcatgaccagtgaacgtcggtccgcgacggctccgagggagggtcgtgggtaggtgggtcgtcggcttagttacggtggcgaggtgggtcgcgntatatagtatgactagaccgccgtaggaacggtccgttacaccgtacttccgagtacgactaactcgaaacgaccacgactgtactctagacgtaaagtggaacgacgtaccgaggtacgaccgtaccggaaccgtaaccgaccgggtacccgttactttaagttacgtttagggttaagttaacgggaccggtaggtacgtagggtaaccggtacccggggaccggggtaaccctacggttaccgaccgaccggtacggggacggacggggtccgcgtacggtcccgtacgtcccg

SEQ ID NO: 54511 - DNA, 595 bp, Homo sapiens
  misc_feature: GYAE6OF02F9Y0M.29.78.H01.1.454.CMB.1.raw
  modified_base (320)..(320): a, c, t, g, unknown or other
  misc_feature (320)..(320): n is a, c, g, or t
tcagatagagtactcacgaccggtgctcgatttagtgtgagtagtttgggtttggggtccgagccatggtgcagactccccagagctctcctcctcctccactgcacagggtctctctcccagcctgtgctgactcaatcgccctctgcctctgcctccctgggaggctcggtcaaggtcacctgtactctgagcagtggacacagcagctacgccatcgcttggcatcagcagaggccagacacgggccctcgttacttgatgacagtcaacaatgatggcagtcacgagcgaagggggacgatcccgtgatcgcttcncagtctccagctcgtcgggcctggacgccgacctaccctcaactaacttccgtcccggccttccgaggttccgtacggaggtacgtaggacggtcttagtaaccgttatttaccgtgtaccacgtaccggtgggactacgtgacctattcgacggttaccgttacgggaacccgggacgtaacggtccgaaccggtcggtccggtaccaccggaccccgtaaccggaccccaaccccgtcgtaccgtaccacccttccgtacccgttaccccccg

SEQ ID NO: 54512 - DNA, 663 bp, Homo sapiens
  misc_feature: GYAE6OF02HBLCQ.29.78.H01.1.454.CMB.1.raw
tcagatagagtactcacgaccggtgctcgatttagtgtgagtagtttggggtttggggagagctctggggagtctgcaccatggctcggaccccactcctcttcctcaccctcctcctccactgcacagggtctctctcccagcctgtgctgactcaatcgccctctgcctctcgccctcccgtggggaggctcggtcaaggtccacctgtactctgagcagtggacacagcagctacgccatccgcttggcatcagacagaggccagaccgaccgggccctcgttacttgatgacagtacaacgaatgagtggcagtcacgacggacggaacgggggacggtaactccgtgaacgtcgtcttccgtacgtacgttccgtaccgtacgtccgtacggtcggacccgttagtacggcccgtacccgtaaccctacgtaaccgtaacttcccggtaccggaccctaccgtacgttcgtaaggacggtacgtacggacgtactacgtacttacgttacgtacgtaccgtacgacggttcgggactcggtagaccttgttacgtcggttaccggttacggggaacccgggtaaccgtacggtacccgtaccggttacgggttaccgaccggtaccgaaccccggaccggtacccctaacccgtccgg

SEQ ID NO: 54513 - DNA, 576 bp, Homo sapiens
  misc_feature: GYAE6OF02F106W.29.78.H01.1.454.CMB.1.raw
  modified_base (292)..(292): a, c, t, g, unknown or other
  misc_feature (292)..(292): n is a, c, g, or t
tcagatagagtactcacgaccggtgctcgatttagtgtgagtagtttgggtttgggggcgcctgggtacagccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctganactcgacgacacggccgtctattattgtagttaaaggcgagctggaatacggggaccggggcccgacttgaccacgtcgggggaccacgggggacgcgtggtcaccgtctccctcacgccctccaccgaacgggcccacgtccggtccttcccccgtcggccacccctcctcccaacgacgcaccctcgtcggggcacgacgcacgcccgtgggcctgcctggtcaacggctactccagtacctactactctggcgccggcgtcggcgaaggccgcgacgtagc

SEQ ID NO: 54514 - DNA, 635 bp, Homo sapiens
  misc_feature: GYAE6OF02HDWTW.29.78.H01.1.454.CMB.1.raw
tcagatagagtactcacgaccggtgctcgatttagtgtgagtagtttgggtttggggtccgagccatggtgcagactccccagagctctcctcctcctccactgcacagggtctctctcccagcctgtgctgactcaatcgccctctgcctctgcctccctgggaggctcggtcaaggtcacctgtactctgagcagtggacacagcagctacgccatcgcttggcatcagcagacggccagaccgacgggccctcgttacttgatgacagtcaaactaatgatggcagtcacaggcgaagggggacggatcccgtgacttcgtcttccgtacgtacgtcctacacgctacgtgggcctggacgcgacctacctacacgtaactccgtacccggcctaccgagtccgtaggacgatggaacggtctacggtactagttactgtacacgaccggtcgggactacgtcggacttacgttacggacggttcccggttacgggaacccggggaacctaggggtacccgtaccgggttaccggttcgggtaccgaaccggtaaccccgaaccggggtacccccaaaccccggtagttacccggttaccctaaccgttccgtttaccccgttaccccccgg

SEQ ID NO: 54515 - DNA, 580 bp, Homo sapiens
  misc_feature: GYAE6OF02FI84I.29.78.H01.1.454.CMB.1.raw
  modified_base (379)..(379): a, c, t, g, unknown or other
  misc_feature (379)..(379): n is a, c, g, or t
  modified_base (580)..(580): a, c, t, g, unknown or other
  misc_feature (580)..(580): n is a, c, g, or t
tcagatagagtactcacgaccggtgctcgatttagtgtgagtagtttgggtttgggggcgcctgggtacggccgggggggtcgctgagactctcctgtgcggcctctggattaagtttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacggggaccggggcccattgaccacgtggggccaggggacncgtggtcaccgtctccctcacgccctccaccgaacgggcccagtcggtccttcccccgtcggtccacccgtcctcccaagacgccacctcgtcggggccacgacgccacgcccgtgggcgtacgccgtggtcgaacggactaccgttccagttacctctactctgacgcgggtctggacaacgggtcgacgtactacggan

SEQ ID NO: 54516 - DNA, 634 bp, Homo sapiens
  misc_feature: GYAE6OF02GRTYL.29.78.H01.1.454.CMB.1.raw
  modified_base (246)..(246): a, c, t, g, unknown or other
  misc_feature (246)..(246): n is a, c, g, or t
tcagatagagtactcacgaccggtgctcgatttagtgtgagtagtttgggtttggggtctgagagaggagtccacccctgggatcttcaggtgttttcatttggtgatcaggacggaacagagagaactcaccatggagtttgggctgagctggctttttcttgtggctattttaaaaggtgtccagtgtgacgtgcagttggtggagtcgtggggggcgccgtggggtacgggccgggggggtcncgtgagactctcctgtgcggcctctggattaagtttaggagtcatgccatgaactcgggtccgccgaggcctccgagggaaggggctgggagtgggtctcggctagttagtggcaggtggtggcgctatatattagtgcagaccgccctggaacgggtcccgttacacctactttccaagacgactaattacgaaagaacacgcttagtatctagacaagtggagagcctgagctacggacgaccgacggccgttacgtaatttagttacggttaggtaaacggcgagtacgttagggaacggtaacccgggggacccggggtacccgtacgttaccggacccgtacgggtaccgggggacccgagggggaccgtccggtggtacccg

SEQ ID NO: 54517 - DNA, 599 bp, Homo sapiens
  misc_feature: GYAE6OF02GBQHD.29.78.H01.1.454.CMB.1.raw
  modified_base (598)..(599): a, c, t, g, unknown or other
  misc_feature (598)..(599): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaaatacggggaccggggcccgacgttcgaccacgtgggggccagggggacgctggtcaccgtctcctcgagccctccgaccaacgggcccacgtcggtccttcccccgtcgcccacccctccctacccaacgacgccacctccgtcgggggccacgagccacgcccgtgggcctcgccgtggtccgaacggacctaccttcctacgtactctacttcgtcggtacggccgggtcgtcggacgaacgggtcgaccgagtacgnn

SEQ ID NO: 54518 - DNA, 584 bp, Homo sapiens
  misc_feature: GYAE6OF02HLQOA.29.78.H01.1.454.CMB.1.raw
  modified_base (220)..(220): a, c, t, g, unknown or other
  misc_feature (220)..(220): n is a, c, g, or t
  modified_base (408)..(408): a, c, t, g, unknown or other
  misc_feature (408)..(408): n is a, c, g, or t
  modified_base (411)..(411): a, c, t, g, unknown or other
  misc_feature (411)..(411): n is a, c, g, or t
  modified_base (453)..(453): a, c, t, g, unknown or other
  misc_feature (453)..(453): n is a, c, g, or t
  modified_base (470)..(470): a, c, t, g, unknown or other
  misc_feature (470)..(470): n is a, c, g, or t
  modified_base (582)..(583): a, c, t, g, unknown or other
  misc_feature (582)..(583): n is a, c, g, or t
tcagatagagtactcacgaccggtgctcgatttagtgtgagtagtttgggtttgggggcgcctgggtacggccgggggggtcgcctgagactctcctgtgcggcctctggattaagttttaggagtcatgccatgaactgggtccgccaggctccagggaaggggctggagtgggtctcggctattagtggcagtggtggcgctatatattatgcagacnccctgaagggccggttcaccatttccagagacaattcgaaagacacgctgtatctgcaaatggagagcctgagactcgacgacacggccgtctattattgtagttaaaggcgagctggaacacggggacccggggcccgtacgttcgaccacgtggggccgaggggaccgcgtggtcaccgtctcctnacnccctaccaccaacggcccactccgtccttccccctcggcccncccttcctccaacgacnccgacctcgtcggggcacgcgcacgccgtcggctcgccgtggtccaacggtactaccgttccaacgttctacctacgtcaggcggcgggtcgcggcgaacggcgacaatagnng

SEQ ID NO: 54519 - DNA, 756 bp, Homo sapiens
  misc_feature: GYAE6OF02H6ETB.29.78.H01.1.454.CMB.1.raw
  modified_base (421)..(421): a, c, t, g, unknown or other
  misc_feature (421)..(421): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccgagggaaggggctggagtgggtctcggctattagtggcagtggtggcgctatatattatgcagacgccctggaagggccggttcaccatttccagagacaattcgaagaacacgctgtatctgacaaaagtggagagcctgagactcgacgaacgcggcccgtacttatttacgttgtaggttaaacggcgacgctagggaaacgtaaccgggggacccggggccctacgttcggaacccgacggtcggggaccggagggggtaccnccgttacgggtaccacccggttccgtccctacgaccggtcccctaccgaacccggaaccggggcccctaaccgttcccgggtttaccctttccccccggtcgggtacccctacccccgttacccgtaccccgaaacggtacgtacccaacccggttcggtaccggggggaccctaacggacgacccgaccgtcccggtcgggtcccgtccggtcccgttacggtacccgtaaacgggtaacgttaacccgttacccgacgttaccgtttacctacgtcgtacggaacgggtccgggtcgtaccggacggtaacggaccgtaccgaagtaggacgc

SEQ ID NO: 54520 - DNA, 684 bp, Homo sapiens
  misc_feature: GYAE6OF02J1UTE.29.78.H01.1.454.CMB.1.raw
  modified_base (315)..(315): a, c, t, g, unknown or other
  misc_feature (315)..(315): n is a, c, g, or t
  modified_base (502)..(502): a, c, t, g, unknown or other
  misc_feature (502)..(502): n is a, c, g, or t
  modified_base (618)..(618): a, c, t, g, unknown or other
  misc_feature (618)..(618): n is a, c, g, or t
tcagatagagtactcacgaccggtgctcgatttagtgtgagtagtttgggtttggggtcgtgagagaggagtccacccctgggatcttcaggtgttttcatttggtgatcaggacggaacagagagaactcaccatggagtttgggctgagctggctttttcttgtggctattttaaaaggtgtccagtgtgacgtgcagttggtggaggtctgggggcgcctggggtaccgggccgggggggtcgccgtgagactcgtcctggtgcggcctcgtggattaagttttaggagtcatgccatgaacgtgggtcccnccgaggcctccgaggggaacggggctagggaggtggtctccggcttagttaggtgggactagggtgggtcggcgtacttagtactattagtgccgacggtaccgcccgtaggaaccgggggtcccgttcaacccgtactttccgaagtacgtaactaagtttaccggaaaacgtaacgtacccggtnttacggtaacttacgtagtaacgaaaagtggtaaacgcgacccgttaggaccacgttaaccggaacgaacccgtccgggtaccttacgtaatttacgttgacggttaaaggctagngtaggaacgtccggggacggtcccagttacgaccgtacggtcgggaaccgtgggacctcgtgtacc

SEQ ID NO: 54521 - DNA, 628 bp, Homo sapiens
  misc_feature: GYAE6OF02J22D7.29.78.H01.1.454.CMB.1.raw
  modified_base (476)..(476): a, c, t, g, unknown or other
  misc_feature (476)..(476): n is a, c, g, or t
  modified_base (519)..(519): a, c, t, g, unknown or other
  misc_feature (519)..(519): n is a, c, g, or t
  modified_base (529)..(529): a, c, t, g, unknown or other
  misc_feature (529)..(529): n is a, c, g, or t
  modified_base (537)..(537): a, c, t, g, unknown or other
  misc_feature (537)..(537): n is a, c, g, or t
tcagatagagtactcacgaccggtgctcgatttagtgtgagtagtttggggtttggggagagctctggggagtctgcaccatggctcggaccccactcctcttcctcaccctcctcctccactgcacagggtctctctcccagcctgtgctgactcaatcgccctctgcctctcgcctcccgtggggaggctcggtcaacggtccacctgtactctgagcagtgacacagcagctcgccatcgcttggcatcagcagacggccagacaccgggccctacgttacttgagtcgacgagtacaaacaagtcggaatcggacctaggtccaacgacggtaccggaaaggggggccggtaactcccgtaggtactcgtcctttacgtcgtacggttcctacgcgtccgtcggtcgggtcctggacgtccgtacttaccctacgaacgtaacttccgcccgggtacccttcgacgttacgnggaacgtagtacggcgtactacgtacgttattacgcgtaaccncggtaccggngggtaccncgttcggctagttcgacggttcgtaccggggaccggtaccaaggtcccgtacggacgttcggacgacccggccaacggccctaacccgtcg

SEQ ID NO: 54522 - DNA, 667 bp, Homo sapiens
  misc_feature: GYAE6OF02F6GYH.29.78.H01.1.454.CMB.1.raw
  modified_base (304)..(304): a, c, t, g, unknown or other
  misc_feature (304)..(304): n is a, c, g, or t
  modified_base (365)..(365): a, c, t, g, unknown or other
  misc_feature (365)..(365): n is a, c, g, or t
  modified_base (665)..(665): a, c, t, g, unknown or other
  misc_feature (665)..(665): n is a, c, g, or t
tcagatagagtactcacgaccggtgctcgatttagtgtgagtagtttgggtttggtggtctctctcccagcctgtgctgactcaatcgccctctgcctctgcctccctgggaggctcggtcaaggtcacctgtactctgagcagtggacacagcagctacgccatcgcttggcatcagcagaggccagacacgggccctcgttacttgatgacagtcaacaatgatggcagtcacaggcgaaggggggacggatccctgactcgcttctcagtcctccagcctcgtgggcctgacgcgctaccncaacaatccgtacccggcctaccgagtcctaggacggatggaggctaggacttatttacgngtacacggtaccgtggggcctacgtggcctagtttcgacgggttccgttaccgggggaacccgggggtaacctaacgggtcccgtaacccgggttccggtaccgggttccgaacggaccccgtaaacgggacccccaaacccccgacgttcggtaccctaacccgttccgttaccgtttacccccaacccctttcctaccgtaacgttaacccttcctaacgttcccgttcgggaaccggttcccgggggtaccttacggggaacccgaacggggttccgaccgtaacggtacggcgtancg

SEQ ID NO: 54523 - DNA, 562 bp, Homo sapiens
  misc_feature: GYAE6OF02FVPQI.29.78.H01.1.454.CMB.1.raw
  modified_base (385)..(385): a, c, t, g, unknown or other
  misc_feature (385)..(385): n is a, c, g, or t
  modified_base (443)..(443): a, c, t, g, unknown or other
  misc_feature (443)..(443): n is a, c, g, or t
  modified_base (448)..(448): a, c, t, g, unknown or other
  misc_feature (448)..(448): n is a, c, g, or t
  modified_base (554)..(554): a, c, t, g, unknown or other
  misc_feature (554)..(554): n is a, c, g, or t
  modified_base (561)..(561): a, c, t, g, unknown or other
  misc_feature (561)..(561): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaacgggccggttcaccatttccagacgacaattcgaagaacacgctgtatctgcaaatggagagcctgagactcgacgacacggccgtctattatgtgttaaaggcgaagctaggaatacggggaccgggcccgtacttgaccacgtggggccaggggacncgtggtcaccgtctcctcacgcctcccacgaacgggcccagtccgttccttcccccgnggccnccctcctaccaacgcgccaccgtcgtcggggccacgcgcacgcccgtggctcgccgtgtacagcctacttcattctctactctcgacggcggcgtggcgaggccgnagtacgnc

SEQ ID NO: 54524 - DNA, 605 bp, Homo sapiens
  misc_feature: GYAE6OF02F4HJY.29.78.H01.1.454.CMB.1.raw
  modified_base (602)..(602): a, c, t, g, unknown or other
  misc_feature (602)..(602): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctaggaactacggggaccggggcccgacttgaccacgtcgggggccagggggcgcgtggtcaccgtctcctcgagccctccaaccgacggcccagtccggtccttcccccgtggccaccctcctaccaagacgccacctcgtcggggccacgcgcgacgcccgtagggctcgccgttcgggtacaacggtacctaacctttaccgacgttacctctaacgttccgtaggacggccgggtacgtacgggacgaacgggccgaccagttacgntcg

SEQ ID NO: 54525 - DNA, 679 bp, Homo sapiens
  misc_feature: GYAE6OF02JB890.29.78.H01.1.454.CMB.1.raw
  modified_base (269)..(269): a, c, t, g, unknown or other
  misc_feature (269)..(269): n is a, c, g, or t
tcagatagagtactcacgaccggtgctcgatttagtgtgagtagtttgggtttggggcgcctgggtacggccggggggtcgctgagactctcctgtgcggcctctggattaagttttaggagtcatgccatgaactgggtccgccaggctccagggaagggctggagtgggtctcggctattagtggcagtggtggcgctatatattatgcagacgccctgaagggccggttcaccatttccagagacattcgaaagaacacgctgtanctgacaaatggagagcctagagactcgacgacgacgacccgtctattattgtgttaaaggcgaagctggaagtacgggaccggggtcccgacttcgaccacgtggggaccgaggggacgcgtggtcaccggtctccgtcgacgtccctaccaccgaacggggcccatccggtccttcccccgtggccctacccgtcctacccaagaccgtccacccgttaccgtgggggcccacgacggtaccgaccggcccgttcgggccgttccgacccgttcgggtaacccgtaaaccgggtacccttaacccgtttacccgtaagtttacccgtaccttaacgtttccctagggtaccgggtaccgggtccgttaccgggacggtacggaccgggtacctaacgttacgggctacg

SEQ ID NO: 54526 - DNA, 674 bp, Homo sapiens
  misc_feature: GYAE6OF02GZGXE.29.78.H01.1.454.CMB.1.raw
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagttgcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccggggcccgacgttgacccacgtcgggggccagggggaccgcgtcggtccgaccgtctacccgtcacggccctcccgaacccgaaacggggcccctacgtcccgggttccctttcccccccgtcggggccctaccccttccctaccccgaaacggaccgccaaccccgttcggtcgggggaccacgacgaccaccggcccgtacggggcctcgcccgttgggtaccgaaacgggtacctttaacccgttcccgtaacgttacccttacttacgttccgtggacgggcgggtacctgggacccgaagggccgtacgacttacggactcg

SEQ ID NO: 54527 - DNA, 781 bp, Homo sapiens
  misc_feature: GYAE6OF02I1IXF.29.78.H01.1.454.CMB.1.raw
  modified_base (267)..(267): a, c, t, g, unknown or other
  misc_feature (267)..(267): n is a, c, g, or t
tcagatagagtactcacgaccggtgctcgatttagtgtgagtagtttgggtttgggtggtctctctcccagcctgtgctgactcaatcgccctctgcctctgcctccctgggaggctcggtcaaggtcacctgtactctgagcagtggacacagcagctacgccatcgcttggcatcagcagagccagacacgggccctcgttacttgatgacagtcaacaatgatggcagtcacagcgaagggggacggatcccgtgatcgcttcncagtctccagctcgtcgggcctgcgcgcctacctcacctaatccgtaccggtccctccgagttccgtacggaagggtacgtacggacgggtacttacggtaacctttaacttttccgtacggttaccgtacggtaacccggttacgggggaccgtacccggttaggggtacccgttaagttttacccggtaacggggtttcccggtttacccgggggaaaccccgggggtaaccgtaaaccgggggttacccttaacccggggtttacccgttaccggggttacccggtaaaccggtaaccccccgggtaaaccgggtaccccctaaaacccccggacgtttacccggttaacctacccggtttacccgtttccgggtttaacccccgttccccgttaaccctttcgaaccgttttacccgttacctttaacctcccggttaagaacccgggtcccggggtaccgttcggaacccggaacgggttcccgtaccgtaacgacggttacgccgtag

SEQ ID NO: 54528 - DNA, 667 bp, Homo sapiens
  misc_feature: GYAE6OF02GGZL0.29.78.H01.1.454.CMB.1.raw
tcagatagagtactcacgaccggtgctcgatttagtgtgagtagtttgggtttggggtccgagccatggtgcagactccccagagctctcctcctcctccactgcacagggtctctctcccagcctgtgctgactcaatcgccctctgcctctgcctccctgggaggctcggtcaaggtcacctgtactctgagcagtggacacagcagctacgccatcgcttggcatcagcaggacggccagaccgaccgggtcccttcgttactgatgacagtacaaacaatgagtggacagtcaacgaggacgggaaacgggggacggtactcccgtagacgtccgtccttccgtcgtacgttcctaccgacgtccgttcggtcggggcctaggacgcccgtaccttaccctacaacctaacgttcccgtcccggtccctaccgtacggttccgtagggacggtagtcgggacgtctacgtaacttacgttacgtcgtaccgacggtaccggtgggacctacggtcgtacttagttccggtacgggtttaccgtaccggggaacccgggtacctaacgggttcccgtacccggttccggttccggacgacccggacccgtaaccggaccccaacccgtcgtaccgtaccctaccgttcccgttcccgtcccccg

SEQ ID NO: 54529 - DNA, 665 bp, Homo sapiens
  misc_feature: GYAE6OF02HWTJJ.29.78.H01.1.454.CMB.1.raw
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccgttcaccatttccagagacaattcgaagaacacgctgtatctgacaaatggagagcctgagacgtcgacgacacggccgtacttattagttgtagttaaacggcgagctaggaactacggggaccgggcccgattcggaccacggtggggaccgaggggacgcgtggtacacccgtctcccgtcacgccctaccaccgaacggcccagttcccgggttcccttcccccgtggccctacccgtccctacccgaacgtacgacctacccgttcggtacgggggccacgaccgccgtaccggcccgtcgggtcctcggtcccgttcggtaccgtaacggaccgtttaaccgtaccgtacgttaccttccgttaacgtcgtacgggacggtaccgggtcgtacgggaccgtaacgggcccgtaagacgttacggatcg

SEQ ID NO: 54530 - DNA, 647 bp, Homo sapiens
  misc_feature: GYAE6OF02J2GUV.29.78.H01.1.454.CMB.1.raw
  modified_base (184)..(184): a, c, t, g, unknown or other
  misc_feature (184)..(184): n is a, c, g, or t
  modified_base (211)..(211): a, c, t, g, unknown or other
  misc_feature (211)..(211): n is a, c, g, or t
  modified_base (218)..(218): a, c, t, g, unknown or other
  misc_feature (218)..(218): n is a, c, g, or t
  modified_base (238)..(238): a, c, t, g, unknown or other
  misc_feature (238)..(238): n is a, c, g, or t
  modified_base (240)..(240): a, c, t, g, unknown or other
  misc_feature (240)..(240): n is a, c, g, or t
  modified_base (250)..(250): a, c, t, g, unknown or other
  misc_feature (250)..(250): n is a, c, g, or t
  modified_base (252)..(252): a, c, t, g, unknown or other
  misc_feature (252)..(252): n is a, c, g, or t
  modified_base (443)..(443): a, c, t, g, unknown or other
  misc_feature (443)..(443): n is a, c, g, or t
  modified_base (505)..(505): a, c, t, g, unknown or other
  misc_feature (505)..(505): n is a, c, g, or t
tcagatagagtactcacgaccggtgctcgatttagtgtgagtagtttgggtttgggggaagaggaagactgacggtccacccctgggatcttcaggtgttttcatttggtgatcaggacggaacagagagaactcaccatggagtttgggctgagcgtgtcgtttctgtggctattttaaaggngtccagtgtgacgtgcagttgtgagtntggggcncctgggtacgcggggggtcngngagctctcgngngcgtctgtgtagtttagttgacgtcagtcgctagtacgacggtcgggtacccgcgaggcctacggaggggacggggtctaggtcggtggtccgtcggtacttagttggtcggacgtggtcggtggcgtatagtattagttgacgagacggtaccgccgtggtacgggtccgttcctaccgtacttaccganacgtaacgtacgtacgaaacgacgtacgcgttactacgtacgtacgacgtaaacgtcggtanaccgtacgcgacgtacgcgacgaaccgtccgtcttactagttacgtagtagtaacgtcgagtcggtaaggtacggacccggggcctaccgtgttaccggaccgttacgggcgggaccgaccgggtcgtccggtactacccgg

SEQ ID NO: 54531 - DNA, 532 bp, Homo sapiens
  misc_feature: GYAE6OF02FL2QJ.29.78.H01.1.454.CMB.1.raw
  modified_base (436)..(436): a, c, t, g, unknown or other
  misc_feature (436)..(436): n is a, c, g, or t
  modified_base (454)..(454): a, c, t, g, unknown or other
  misc_feature (454)..(454): n is a, c, g, or t
  modified_base (530)..(530): a, c, t, g, unknown or other
  misc_feature (530)..(530): n is a, c, g, or t
tcagatagagtactcacgaccggtgctcgatttagtgtgagtagtttgggtttggtggtctctctcccagcctgtgctgactcaatcgccctctgcctctgcctccctgggaggctcggtcaaggtcacctgtactctgagcagtggacacagcagctacgccatcgcttggcatcagcagaggccagacacgggccctcgttacttgatgacagtcaacaatgatggcagtcacagcaagggggacggatcccgtgatcgcttctcagtctccagctctgggcctgacgcgctacctcacaactctccggcctccagtctgaggatgaggctgactattactgtcagaccgtggggcacgtggctattcgagggttcttccgggaccgggaccaacggtccaccggttcgtcggtcacgcccaaggcccaacccntcgtccacttctgttccnccgtccctctcagttacctctactccgtggaccggtccgggtcctacgggaccgtaacgggccgtaccgtagtagncg

SEQ ID NO: 54532 - DNA, 648 bp, Homo sapiens
  misc_feature: GYAE6OF02IWEX1.29.78.H01.1.454.CMB.1.raw
  modified_base (296)..(296): a, c, t, g, unknown or other
  misc_feature (296)..(296): n is a, c, g, or t
  modified_base (314)..(314): a, c, t, g, unknown or other
  misc_feature (314)..(314): n is a, c, g, or t
  modified_base (363)..(363): a, c, t, g, unknown or other
  misc_feature (363)..(363): n is a, c, g, or t
  modified_base (485)..(485): a, c, t, g, unknown or other
  misc_feature (485)..(485): n is a, c, g, or t
  modified_base (497)..(497): a, c, t, g, unknown or other
  misc_feature (497)..(497): n is a, c, g, or t
  modified_base (503)..(503): a, c, t, g, unknown or other
  misc_feature (503)..(503): n is a, c, g, or t
  modified_base (513)..(513): a, c, t, g, unknown or other
  misc_feature (513)..(513): n is a, c, g, or t
tcagatagagtactcacgaccggtgctcgatttagtgtgagtagtttgggtttggggtctgagagaggagtccacccctgggatcttcaggtgttttcatttggtgatcaggacggaacagagagaactcaccatggagtttggctgagcggtgtgtttctaggtggctaatttaaaggtgtcagtgtgacgtgcgtagttggtggagtcgtggggcgccgttggggtacgggccggggggttcgctagacgactctccgtgtgccggtcctgtggtatttaagtttagagtcatnacatggactcgggtcccncaaggtctaccggaggggtacgggcgtgggtaggtgggtccttacgggntttaaggtcggttcggagtagggttgggcggtaacgtctaagtttctatttaaggcacgagaccgctaggaacggggttcctaccctatacgtttaccgagaagtacgtaactaccggaaanacacgtcgtatntccgtnaaccgtaagngatcgctagacacgacggaccgtacgtcgtactagttacgttacttaaggtacgtacgagacgtcgtaacggacggtaaccgggtaccgtaccgacgtcgaaccgtacggcggacgggacggtcgtgtcggtacc

SEQ ID NO: 54533 - DNA, 634 bp, Homo sapiens
  misc_feature: GYAE6OF02GTB87.29.78.H01.1.454.CMB.1.raw
  modified_base (351)..(351): a, c, t, g, unknown or other
  misc_feature (351)..(351): n is a, c, g, or t
tcagatagagtactcacgaccggtgctcgatttagtgtgagtagtttgggtttggggtctgagagaggagtccacccctgggatcttcaggtgttttcatttggtgatcaggacggaacagagagaactcaccatggagtttgggctgagcgtggcttttcttgtggctattttaaaaggtgtccagtgtgacgtgcagttggtggagtcgtgggggcgcctgggtacgggccggggggtcgcgtgagactctcctgtgcggcctcgtggatttaaggttttaggagtcatgccatgaactggttccgcaggctcgagggagggctggagtgggtctcgggctagttaggnggctaggtgggtggcgtactagtattagttagtgcagacgtcccgtaggaacgggtccggtttacaccgtagtttccgaaggacgacgtaacgtttacggaaagaaaccgacgtacttgttactcgtacgactaaagtggaagacgcctggacacgtcgaacgacgaccggtccttacgtagtttagtttaggtagttaaaggcgtagacggtaggaacgtaccggggaccggtcccgtagtaccgaccgaccggtggggaccgacggggcgcgtaggtcccg

SEQ ID NO: 54534 - DNA, 835 bp, Homo sapiens
  misc_feature: GYAE6OF02I7ZNO.29.78.H01.1.454.CMB.1.raw
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccgttcaccatttccagagacaattcgaagaacacgctgtatctgcaaatggagagcctgagactcgacacgacggccgtctattattgtagttaaaggcgagcgtaggaagtaccggggaccgggcccgtacgttcgaacccgtacgtacgggggccgtaagggggaccgcggtttacgggtccgtaacccggttccgttccccgttacgaccggtaccccgttccccgaaaccccggtaaaccgggggtcccccaaccgtttcccgggttttacccccgtttccccccccggtttacggggacccccttaaccccccgtttaccccgtaaccccgtaaaaccgggtaccggttaaccccgtaaccccggtttacccggggttacggggggaaccccttaaccgggaacccggtacccgaacccgggttcccccggttacggggtcccgttaccgggtcccggtttacggggtaacccgttaaacgggtaaccccgttaaccgtttaccccgtaacgtttacccgttacctttaaccggttccgtacggtaacgggtccgggtaccgttacgggaccgtaacgggaccgtacgtacgtacgcgcg

SEQ ID NO: 54535 - DNA, 694 bp, Homo sapiens
  misc_feature: GYAE6OF02GQP3L.29.78.H01.1.454.CMB.1.raw
tcagatagagtactcacgaccggtgctcgatttagtgtgagtagtttgggggtttggggagagctctggggagtctgcaccatggctcggaccccactcctcttcctcaccctcctcctccactgcacagggtctctctcccagcctgtgctgactcaatccgccctctgcctctgccctccgtgggagctcggtcaaggtcacctgtactctgagcagtggacacgagcagctacgccatccgcttggcatcagcaggacggccagacgaccgggtcccttacgttactgatcggactacgtacaaacaagtcgagtcggacacgtcaacgacggacgggaaacgggggacggactcccgtagacgtcgtaccttcgtacgacgttcctaccgacgtccgttacggtcggggacctaggaccgtccgtacctacctaccgtaactaaccgttcccgtcccggtaccttaccgtacggtccgtagggaacggtacgtcgggaacggttctaacggtaactttaacgttaccggttgtacccgtacgggtaccggtcgggacctacgggtcggacttacgttccggtacggttcccgggttaccggggaacccgggtaacgtaccgggttaccgaccggtttccggtacggtaccgtacggtacccggaacccggtacccccgtaaccgtaccgg

SEQ ID NO: 54536 - DNA, 613 bp, Homo sapiens
  misc_feature: GYAE6OF02FU150.29.78.H01.1.454.CMB.1.raw
  modified_base (609)..(609): a, c, t, g, unknown or other
  misc_feature (609)..(609): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacggggaccggggcccgacttgaccacgtgggggccgagggggacgcgtcggtcaccggtctcctcacgccctccaccgaacgggcccaactcggtccttcccccgtcggccacccctcctacccaacgacgccaccctcgtcgggggccacgacgccacgcccgtgggcctcgccctgggttacgaacggtaccttacgttcccaacgttactacttacgtctaggacggccgggtccgtcgggacgaacgggccggtacacgttacgntacg

SEQ ID NO: 54537 - DNA, 717 bp, Homo sapiens
  misc_feature: GYAE6OF02GP6CT.29.78.H01.1.454.CMB.1.raw
  modified_base (714)..(714): a, c, t, g, unknown or other
  misc_feature (714)..(714): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgcctgaagggccggttcaccatttccagagacaattcgaagaacacgctgtatctgacaaagtggagacgctagagactcgacgacacggccgtctattattggtagttaaaggcgagtctaggaacgtacggggaccgggtcccgtactcggaaccgacgtcgggggccgaagggggacgcgtaggtccacccggttctccgtaccaacggtcccctacccgaacccgaacgggaccccacggttccggttccctttacccccgtcgggtaccccaccccttcccgtaaccgaaacgtccggacctcccgtaccgggtcgggggtccaaccgtaccggaccgaccggtcccggttcggggtcccttcgggtccggtacgggttaccgaaacgggtaaccttaccgttacccgtaacgttacccttacgttaccgtcggttacggacggggtccgggtacgtacgggaacggtaccgggccgtaacgtagtacggnacg

SEQ ID NO: 54538 - DNA, 616 bp, Homo sapiens
  misc_feature: GYAE6OF02HOUAF.29.78.H01.1.454.CMB.1.raw
  modified_base (615)..(616): a, c, t, g, unknown or other
  misc_feature (615)..(616): n is a, c, g, or t
tcagatagagtactcacgaccggtgctcgatttagtgtgagtagtttgggtttgggggcgcctgggtacggccgggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctatttattgtagttaaaggcgtagcgtaggaagttaccggggaccggggccccgtagttcgaccgacgtcgggggccaagggggacgcgttagggtcacccggttctcccgtcgacgccctcccaaccgaacgggcccacgtccggtaccttcccccgtcggcccacccttccctaccgaacgtacgacctacccgtcgtcggggccaacgacgccacgcccgtggtccgtcgccgtcggtacaacggtactaccgttaccacgtactctagtcgtgacggcggcgtggacgacggcgacagtagnn

SEQ ID NO: 54539 - DNA, 608 bp, Homo sapiens
  misc_feature: GYAE6OF02HE0ID.29.78.H01.1.454.CMB.1.raw
  modified_base (380)..(380): a, c, t, g, unknown or other
  misc_feature (380)..(380): n is a, c, g, or t
  modified_base (606)..(606): a, c, t, g, unknown or other
  misc_feature (606)..(606): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggcgtctattattgtagttaaaggcgagctaggaatacgggaccgggccacgttgaccacgtggggccaggggacncgtggtcaccgtctccgtcacgcctaccaccgaacgggcccaagtccggtccttcccccgtcggccacccctcctaccaacgacgccaccttcgcggggccacgacgacacgcccgtcgggcctcgcccgtcgggtacgaaacggtaccttaccgttaccacgttacttactacgtccgtagacggtccgggacgtgggaccgaacgggtccgaccgtaagtacgncg

SEQ ID NO: 54540 - DNA, 606 bp, Homo sapiens
  misc_feature: GYAE6OF02F9A6M.29.78.H01.1.454.CMB.1.raw
  modified_base (515)..(515): a, c, t, g, unknown or other
  misc_feature (515)..(515): n is a, c, g, or t
  modified_base (585)..(585): a, c, t, g, unknown or other
  misc_feature (585)..(585): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgacaaatggagagcctgagactcgacgacacggccgtctattacttgtagttaaaggcgagcgtaggaagtacggggaccggggccccgacgttcgaccacgtcggggccgaggggaccgcgtcggtcgaccgtctccctacacgccctcccaaccgaacggggcccaacgttccgggtcccttcccccgtggcctacttccctccctacccgaacgcgcctaccgtcggcggggccaacnggccacggcccgtgggctcgccgtcggtacaacggtacctacgttccacgtcttctatctggacgcggcncggcgaagggctacgagtagc

SEQ ID NO: 54541 - DNA, 641 bp, Homo sapiens
  misc_feature: GYAE6OF02GA76P.29.78.H01.1.454.CMB.1.raw
  modified_base (325)..(325): a, c, t, g, unknown or other
  misc_feature (325)..(325): n is a, c, g, or t
tcagatagagtactcacgaccggtgctcgatttagtgtgagtagtttgggtttggtggtctctctcccagcctgtgctgactcaatcgcccactgcctctgcctccctgggaggctcggtcaaggtcacctgtactctgagcagtggacacagcagctacgccatcgcttggcatcagcagaggccagacacgggccctcgttacttgatgacagtcaacaatgatggcagtcacagcgaagggggacggatccctgatcgcttctcagtctccagctcgtgggcctggacgcgctacctcacaatctccggctccagtctgagntgaggctgactattctgtcagaccgtgggccagtcggctagttcgagggttccgttaccggggaacccggggtacctaacgggtccctaaccgggttccggtaccgggtaccaaccggtaccccgaaacgggtccccctaaaccccgtacgttccggttaccctacccgttacccgttacccggtttccccccaacccccgttttccgtaccgtaaccgtttcccttaccttacgttcccggtaggtaaccggggtcccgggtaccgttacggggtacccgtaaacgggccgtaacccgtaagttacggctacgcg

SEQ ID NO: 54542 - DNA, 634 bp, Homo sapiens
  misc_feature: GYAE6OF02JDXTN.29.78.H01.1.454.CMB.1.raw
  modified_base (380)..(380): a, c, t, g, unknown or other
  misc_feature (380)..(380): n is a, c, g, or t
  modified_base (397)..(397): a, c, t, g, unknown or other
  misc_feature (397)..(397): n is a, c, g, or t
  modified_base (435)..(435): a, c, t, g, unknown or other
  misc_feature (435)..(435): n is a, c, g, or t
  modified_base (632)..(632): a, c, t, g, unknown or other
  misc_feature (632)..(632): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccgttcaccatttccagagacaattcgaagaacacgctgtatctgacaaagtggagagcctgagactcgaacgacacggccgtctattatgtagttaaaggcgagctaggaatacgggccggcccgacttgaccacgtggggccaggggacngtggtcaccgtctcctnacgccctcaccgaacggcccacgtcgtccttcccccgnggtacccaccctcctaccaacgcgtccacctcggtcggggaccacgacggcacggtcccgtaggggtccctacggtccgtcgggttaccaaacgggtaccttaccgttaaccgaccgttacccgttcgttaaccgttccggtacgacggggtcccgggacgttacgggaccgtaacgggccgaccgtaagtaccggncg

SEQ ID NO: 54543 - DNA, 630 bp, Homo sapiens
  misc_feature: GYAE6OF02IB8KG.29.78.H01.1.454.CMB.1.raw
  modified_base (244)..(244): a, c, t, g, unknown or other
  misc_feature (244)..(244): n is a, c, g, or t
tcagatagagtactcacgaccggtgctcgatttagtgtgagtagtttgggtttggggtctgagagaggagtccacccctgggatcttcaggtgttttcatttggtgatcaggacggaacagagagaactcaccatggagtttgggctgagctggctttttcttgtggctaattttaaaaaggtgtccagtgtgacgtgcagttggtggagtctgggggcgcctggggtacggccgggggggtcnctgagactctcctgtgcggcctctggattaagttttaggagtcatgccatgaactgggtccgccaggctaccagggaggggctggaggtgggtctcggctattagtggacagtgggtggcgactaagtatagttatgcagacccgcctaggaacgggtccgttacacctagtttccagacgtacaaattcgaaagaacaacgctagtatctgacaaagtgaagagcctagagactcgaacgaccgaccggcccgtctaatttagttacgtagttaaaaggccgaagccgtagggtaacggtaaccggggacccggggtacccgtaacgttacggaacccgtacggtcgggggtaccaacggggggtaccgacggttcggtaacccg

SEQ ID NO: 54544 - DNA, 561 bp, Homo sapiens
  misc_feature: GYAE6OF02FNY2X.29.78.H01.1.454.CMB.1.raw
  modified_base (308)..(308): a, c, t, g, unknown or other
  misc_feature (308)..(308): n is a, c, g, or t
  modified_base (390)..(390): a, c, t, g, unknown or other
  misc_feature (390)..(390): n is a, c, g, or t
  modified_base (428)..(428): a, c, t, g, unknown or other
  misc_feature (428)..(428): n is a, c, g, or t
  modified_base (525)..(525): a, c, t, g, unknown or other
  misc_feature (525)..(525): n is a, c, g, or t
tcagatagagtactcacgaccggtgctcgatttagtgtgagtagtttgggtttggggtccgagccatggtgcagactccccagagctctcctcctcctccactgcacagggtctctctcccagcctgtgctgactcaatcgccctctgcctctgcctcccgtgggagctcggtcaaggtcactgtactctgagcagtggacacagtagctacgcatcgcttggcatcagcagaggccagacacgggcctcgttactgatgacagtcaacaatgaatggcagtcacaggcgaaggggggacggatccgngactcgcttctcacgtctcgagcctcgtcggccgtgacgtcgcctacctcactactcgtcccggcctccagtcgtagaggtntggagtcagtacttattacgtgtcacgtacgtgggacncgtgggctagtcgacggttccgttacgggaaccgggtacctaagggtcccgtaccgttcggtacggtccgaccggacccaaccggccctaaccccgngtcgtaccctacgtccgttacccgttcccgtacccc

SEQ ID NO: 54545 - DNA, 585 bp, Homo sapiens
  misc_feature: GYAE6OF02HRYUP.29.78.H01.1.454.CMB.1.raw
  modified_base (286)..(286): a, c, t, g, unknown or other
  misc_feature (286)..(286): n is a, c, g, or t
  modified_base (582)..(582): a, c, t, g, unknown or other
  misc_feature (582)..(582): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaaagaacacgctgtatctgcaaaatgganagcctgagactcgacgacacggccgtctattatgtagttaaaggcgaagctggaatacgggaccggggcccacttgaccacgtggggccaggggacgctggtcaccgtctcctcagccctcaccaaggccactcggtccttcccctcggccaccctcctccaacgacgcacctcgtcggggccacgacgccacgcccgtacggcgtcgccgtcggtcgaaacggtactaccttaccacgttactacgttacgtcttacggacggcggacgtggtacgacgggacgaccgtataggntag

SEQ ID NO: 54546 - DNA, 735 bp, Homo sapiens
  misc_feature: GYAE6OF02IUYPT.29.78.H01.1.454.CMB.1.raw
  modified_base (358)..(358): a, c, t, g, unknown or other
  misc_feature (358)..(358): n is a, c, g, or t
tcagatagagtactcacgaccggtgctcgatttagtgtgagtagtttgggtttggggtccgagccatggtgcagactccccagagctctcctcctcctccactgcacagggtctctctcccagcctgtgctgactcaatccgccctctcgcctctcgccctcccgtgggacgctcggtcaaggtccacctgtactcgtgagcaggtgacacagcagactacgcatccgcgttggcatcagcaggacgcacgacgccggcctagtttactgactgaacagtacaaacaagtgagtggacagtcaagaggacggaagggggacggactccgtagtacgtcgtctttcgactacggtaccnccgtaggtccttcggtcgggtaccttacggaaccgtccggtaacccgttaaccctacgtaaaccgtaccgtttcccggtccccggtaccttcccggtaaacgttcgttaacgggaacgggttagtacggaacggtcgtacgtaaacgtttcgttaacgtaccgtacggtaacggttacccgggtggggtaaccttaccggtacgtaccgtagttcccgggtaaccgggttcccggttacccggggaaaccgggtaaccgacccggtaccgggttacccggttcggtaacccggactaacccgggacccttaacccggaacccgtaaccccgtaggttaccgttaccccgtaccgtttccgtccccggtttacccccg

SEQ ID NO: 54547 - DNA, 648 bp, Homo sapiens
  misc_feature: GYAE6OF02HOLYD.29.78.H01.1.454.CMB.1.raw
  modified_base (178)..(178): a, c, t, g, unknown or other
  misc_feature (178)..(178): n is a, c, g, or t
  modified_base (197)..(197): a, c, t, g, unknown or other
  misc_feature (197)..(197): n is a, c, g, or t
  modified_base (229)..(229): a, c, t, g, unknown or other
  misc_feature (229)..(229): n is a, c, g, or t
  modified_base (237)..(237): a, c, t, g, unknown or other
  misc_feature (237)..(237): n is a, c, g, or t
  modified_base (243)..(243): a, c, t, g, unknown or other
  misc_feature (243)..(243): n is a, c, g, or t
  modified_base (371)..(371): a, c, t, g, unknown or other
  misc_feature (371)..(371): n is a, c, g, or t
  modified_base (445)..(445): a, c, t, g, unknown or other
  misc_feature (445)..(445): n is a, c, g, or t
  modified_base (553)..(553): a, c, t, g, unknown or other
  misc_feature (553)..(553): n is a, c, g, or t
tcagatagagtactcacgaccggtgctcgatttagtgtgagtagtttgggtttggggtctgagagaggagtccacccctgggatcttcaggtgttttcatttggtgatcaggacggaacagagagaactcaccatggagtttgggctgagcggtgtgttcaggtcgctaatttaaggncagtgtgacgtgcagttgngagtcgtggggcacctgggtacggcgggggtnctagacgntcgtcngtcgcggcctgtggtattagtttaggactcatgacctatagactgggcaccgagcctcgagggaacggtctaggagtgggtctcggcttaagttggtgactcggtcgtgcgtactagtactagttagngcaacgtcgcccgttaggagggtcccgttacaacttcgttaccgacgagaacttaacgtccgaaagggaaaccncggttctagtacgtaccgagtacgtaagagacggtcgaccctgggaaactccgtgaacccgttagcccgtacgtccgttaagttccgttggttaaacgttaaccgggngtagtacgtacggtaaccgggtaacccgggccggttaccctacgttaacccgaccgtacggccgggttacggaccgggtccgtacgtccggtacg

SEQ ID NO: 54548 - DNA, 639 bp, Homo sapiens
  misc_feature: GYAE6OF02HRUXO.29.78.H01.1.454.CMB.1.raw
  modified_base (637)..(638): a, c, t, g, unknown or other
  misc_feature (637)..(638): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctggaagggccggttcaccatttccagagacaattcgaagaacacgctgtatctgacaaatggagagcctgagactcgacgacaccggccgtctattattgtagttaaaggcgagctaggaacgtacggggacccggggcccgacgttcgaccgacgtgggggccagggggaccgcgtcggtaccacccgtctccctcgacgcccctaccaaccgaacgggcccacgtccggttccttcccccgtcggcccaccctccctccgaacgacgccacccgttcggcggggtaccacgacgccgacgcccgtgggccgtcgccgttcggtaccgtaacggtaccttaaccgttcctaacgttaccttacttacgtcgtcggacggcgggtccgtcggacgaacgggccgacgaacgtagnng

SEQ ID NO: 54549 - DNA, 711 bp, Homo sapiens
  misc_feature: GYAE6OF02IL6QP.29.78.H01.1.454.CMB.1.raw
tcagatagagtactcacgaccggtgctcgatttagtgtgagtagtttgggtttggggtccgagccatggtgcagactccccagagctctcctcctcctccactgcacagggtctctctcccagcctgtgctgactcaatcgccctctgcctctgcctcccgtgggaggctcggtcaaggtcacctgtactctgagcaggtggacacagctagctacgccagtcgcttggcatcagcagacggccagacaccgggcctgttacgtgactgacgtacgtacaaactaatgaatcggctaacgtcacgaacggacggaaacggggggtacgacgtcccgtagaacgttccggactttcggactaacggtcctaccaggtcctcggtacgggtaccgtggaaccggtccgtacccggttaacctaccgtaaaccgtaaccgtccccgttcccggtacccgttaccgtacggtacttcgggtaacggtaagggtcgtacgggtcttaacggtaaccgtttacttaacgttcgtaccgtagggttaaccccgtggggacctacggttccgacttacggttcgttacgggtcggttaacccgggaccgggtaacccgagggttacccgtaacggttccggtacgggtacctccggaaacccacggggtacccctaacccgcgttaggtacccctacggttacctcccgggttaccccc

SEQ ID NO: 54550 - DNA, 772 bp, Homo sapiens
  misc_feature: GYAE6OF02G5G9O.29.78.H01.1.454.CMB.1.raw
  modified_base (769)..(769): a, c, t, g, unknown or other
  misc_feature (769)..(769): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccgagggaaggggctggagtgggtctcggctattagtggcagtggtggcgctatatattatgcagaccgccctaggaacgggccgttcacctatttccagagactaattcgaaagaacacgctgtatctgacaaaagtggaagacgcctagacgactcggaacgacgaccggtcccgtcttatttagttggttaaggttaaaggccgaggtacgtagggtaaacggtaccgggggaccccggggtccccgtacgttacggaaccgacggtacggggaccggaacgggggacgtcgttcggtcccgtaaccggttccctaccgtccgaccgtaccccgtacccgtaacccgggaacgggacccgtaccggttcccggtttcccccgtttccccccgtacccggtacccctacccccgtacccgtaacccgtaaccgaccgtacccgtaacccggttccgggtaccgggggacccaacgccggaccgaccggcccggtcgggcgtccggtccgtacggtaccgaaacggttacccttaaccgttaccgtaccgttacttccgtaacgtcggtacggaccggtcgggtacggtacggacgacggaccgacgtacgtacgntag

SEQ ID NO: 54551 - DNA, 572 bp, Homo sapiens
  misc_feature: GYAE6OF02GEB4H.29.78.H01.1.454.CMB.1.raw
  modified_base (447)..(447): a, c, t, g, unknown or other
  misc_feature (447)..(447): n is a, c, g, or t
  modified_base (570)..(570): a, c, t, g, unknown or other
  misc_feature (570)..(570): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtagttaaaggcgagctgggaatacggggaccggggcccgacttgaccacgtggggccaggggacgcgtggtcaccgtctcctcacgcctccaccacgggcccacgtcggtccttcccccgtcggcccnccctcctccaacgacgccacctcgcggggcacgacgcacgccgtgggctcgccgtcggtcaacggtacctaccttccacgttacctctactcgtgacggcggcgtggcgacggcgacagtagncg

SEQ ID NO: 54552 - DNA, 639 bp, Homo sapiens
  misc_feature: GYAE6OF02HZ6CD.29.78.H01.1.454.CMB.1.raw
  modified_base (310)..(310): a, c, t, g, unknown or other
  misc_feature (310)..(310): n is a, c, g, or t
  modified_base (637)..(637): a, c, t, g, unknown or other
  misc_feature (637)..(637): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctgggagtgggtctcggctattagtggcagtggtggcgctatatattatgcagacgccctggaagggcccggttcaccattttccgagagaacaattcgaaagaacacgctgtatctgcaaatggagagcctgagactcgagaccncggccgtctattacttgtagttaaaggcagctaggaatacggggaccgggccctagttcgaccacgtcggggccaggggacgcgtcggtcaaccggttctcctcgacgccctaccgaaccgacgggcccacgtccggttcccttccccgtcgcccgtaccctccctacccgtaagacgaccacccttccggtcggggaccacgacggccacggcccgtacgggtcctcgccgtacggtactaacgggtaccttaaccgttccaacgttacctacgttacgtcgttacggacggccgggtcgtcgggtacaacgggccgacagtcgancg

SEQ ID NO: 54553 - DNA, 717 bp, Homo sapiens
  misc_feature: GYAE6OF02JU5MW.29.78.H01.1.454.CMB.1.raw
  modified_base (410)..(410): a, c, t, g, unknown or other
  misc_feature (410)..(410): n is a, c, g, or t
tcagatagagtactcacgaccggtgctcgatttagtgtgagtagtttgggtttgggggtcggccgtgggtacggccgggggggtcggcgtggagacgtctcctgtgcggcctctggattaagttttaggagtcatgccatgaactgggtccgccaggctccagggaaggggctggagtgggtctcgggctagttagtggcaggtggtggcgctagtatagttatgcagacgcccgtgaacgggccggttcaaccattttcccagagacaattcgaagaacacgctgtatctgcaaatggagagcctgagactcggacgaccacggccgttacgattagttgtagttaaacggcgaagctaggaatacgggaccgggcccagttgaccgacgtcgggggacctaggggacncgtgggtccacggttctccgtcgacgtcccgtccaaccgtaacggggccccacgttccggttacccgttcccccgtcgggccctaccccgtcccgttacccgaaacggtaccgaccctaacccgtccggtaccgggggaccaacggtacgccgtaacggtcccgtcggggccctcgggcccgttacgggtaccgaaaccggtcgtaacccgttacccgacgttaccgtccgtttaacgtccggttacggaacgggtcccgggttcgtacgggtaccgaacgggtcccgacgtacggttacggcgtag

SEQ ID NO: 54554 - DNA, 702 bp, Homo sapiens
  misc_feature: GYAE6OF02GYT9H.29.78.H01.1.454.CMB.1.raw
  modified_base (209)..(209): a, c, t, g, unknown or other
  misc_feature (209)..(209): n is a, c, g, or t
  modified_base (367)..(367): a, c, t, g, unknown or other
  misc_feature (367)..(367): n is a, c, g, or t
  modified_base (383)..(383): a, c, t, g, unknown or other
  misc_feature (383)..(383): n is a, c, g, or t
tcagatagagtactcacgaccggtgctcgatttagtgtgagtagtttgggtttggggtccgagccatggtgcagactcccagacgctctcctcctcctccactgcacagggtctctctccagcctgtcgctgactcaatccgccctctcgcctctcgccctcccgtgggagctcggtcaaggtcacctgtactctgagcaggtgacacngcagctacgccagtcgcgttggcctatcagctagacggcccagacctaccgggccctagtttactggatcgaactcgtacaaactaatggaagtcggactagtaccaacgacggaacggaacggggggtacgacttcccgaggtacgtcgcctttacncgtaacgttcctaccncggtctcgtgggcctaggactcccgcttaccacacgtaactcccgacggtccctacgacgtcgttagacggtacgtcgacgggtcttaacggacctttaaacgtttcgtacgttaaccgtacggtaaccgggttcggggccttaacggcggtaacctactttccggtacgggttccgttacccggggtaacccggggaccttaaccgggttaccggtacccggttccgggttacggtacccgtacggaacccccgaacgggtaaccccaccccggtaacgttcccgtaccggtaccccttggttcccccgtacccccgg

SEQ ID NO: 54555 - DNA, 642 bp, Homo sapiens
  misc_feature: GYAE6OF02HKY15.29.78.H01.1.454.CMB.1.raw
  modified_base (639)..(639): a, c, t, g, unknown or other
  misc_feature (639)..(639): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgacaaagtggagagcctagagactcgacgacacggccgtctattattgtagttaaaggcgagctaggaagtacggggacccggggtcccacgttcgaccacggtcggggaccgaggggacgcgtcggtcaccgtcctccgtcacgccctaccaccgaacggcccacgtccggtcccttcccccgtcggccctaccctcccaccaacgacgcccaccgtcggtcggggccacgacgccgacgtcccgtgggtcctcggtccgtcgggtacgtaaacggtaccgttaaccttcccgtaacgttaccttaccgttacgttctacgggtcggccgggtcgtacgggtacgaacgggaccgacgaagtgntcg

SEQ ID NO: 54556 - DNA, 715 bp, Homo sapiens
  misc_feature: GYAE6OF02HUUN2.29.78.H01.1.454.CMB.1.raw
  modified_base (278)..(278): a, c, t, g, unknown or other
  misc_feature (278)..(278): n is a, c, g, or t
tcagatagagtactcacgaccggtgctcgatttagtgtgagtagtttgggtttggtggtctctctcccagcctgtgctgactcaatcgccctctgcctctgcctcccgtgggaggctcggtcaaggtcacctgtactctgagcagtggacacagcagctacgccatcgcttggcatcagcagaggccagacacgggcctgttactgatgacagtacaacaatgatcgggcagtcacagacggaagggggacggactcccgtgactcgcttctcagtcncagctcgtcgggcctggacgtccgacctacctcaacacttccgtcccggtaccctccgtagttcgaggtacgggtagtcggacggtcgtagtaacttagttaacgtcgtacgtaacggtaccgggtacggggctaaccggtggtaccgtactttacggaccgggtttccggttaccggggggtaaccgggggtaaccggttaacggggttcccgtaccggggtttcccgggttaccggtaccggaaccggaccccgtaaccggtacccccgaaacccgttaccgtacggttacccgtaaccgtttccgttacccggttaccccctaaccgtcccgttacgtaaccgttaccttaccgtttaccgtaccggttaacgggccgggttcgggtaccgtacgggaccctaacggggtccgacgttacggtaacgcgagtac

SEQ ID NO: 54557 - DNA, 594 bp, Homo sapiens
  misc_feature: GYAE6OF02HGL93.29.78.H01.1.454.CMB.1.raw
  modified_base (592)..(593): a, c, t, g, unknown or other
  misc_feature (592)..(593): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacggggaccgggcccgacttgaccacgtggggccaggggacgctggtcaccgtctccctcacgccctccacccgaacgggcccactccggtccttcccccgtcggcccaccctccctcccaacgacgccaaccgtcgtcgggggcacgacgaccgacgcccgtgggcctcgccgtcggtaccgaacggtactaccgttaccacgttacctcttactctagacggccggcgtcggacgacggcgacgacgtagnng

SEQ ID NO: 54558 - DNA, 770 bp, Homo sapiens
  misc_feature: GYAE6OF02IW39I.29.78.H01.1.454.CMB.1.raw
  modified_base (313)..(313): a, c, t, g, unknown or other
  misc_feature (313)..(313): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgacaaatggaagacgcctgagactcgacgacacggccgtntattatgtagttaaaggcgagctagaacgtacggggaccggggccgacttacgaccacgtgggggtccagggggacgcgtggtccaacccggttctacccgtaccacggtaccccgttcccaaaccccgtaacgggggcccccgtaaacgtcccgggtttaccccgtttcccccccttaggggacccctaaccccccttcccgttaaccccaaaaccggaacgaccctaacccgtccggtacggggggacccaaccgaacggaccgacgtccccgttacgggggtccttacgggaccccgttaggggttaacccgtaaaacgggtaacctttaacccgtttcccgtaaaccggtttacccttaccgttaacgtttcccgttagggtaacgggtccgggggtaccgttacgggggaacccgtaaacggggcccggtaacctaaggtaccggtagaccg

SEQ ID NO: 54559 - DNA, 671 bp, Homo sapiens
  misc_feature: GYAE6OF02H5SK2.29.78.H01.1.454.CMB.1.raw
  modified_base (670)..(670): a, c, t, g, unknown or other
  misc_feature (670)..(670): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggaggtgggtctcggctattagtggcagtggtggcgctatatattatgcagacgccctaggaacgggtcccggttacacctatttccagtagaactaattacgaagaaccacgcttagtatctagacaaaatggagagcctgagactcgacgacacggccgtattattagttgtagttaaggcgagacgttaggaacggtaccggggacccggggcccgtacgttcggaccacggtcggggccgagggggaccgcgtggtcgacccgttccgtcctcacgtccctaccgaccgacggacccgagttcccggtccccttccccgtcggccctaccccttccgtacccgaagacgcctacccgttccgggtcggggacccacgacggacccacgtaccccggtcgggccgtccgtccgtcggtaccgaacggtacctacccgttacgtacgttacctccgttactcgtcgggacgtcgggcgtacggcgaacgggcacggatcggnc

SEQ ID NO: 54560 - DNA, 820 bp, Homo sapiens
  misc_feature: GYAE6OF02IHAHL.29.78.H01.1.454.CMB.1.raw
  modified_base (814)..(814): a, c, t, g, unknown or other
  misc_feature (814)..(814): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccgttcaccatttccagagacaattcgaagaacacgctgtatctgacaaatggagagcctgaagctacgacgacgaccggccgtacttatttattggtagttaaaggcgagcgtaggaaagtaccggggacccgggacccgtagttacgacccgtacggtcgggggaccgaacgggggaccgcgttacgggtacccgtaacccggttcctaccgttaccgaacgtcccccgttaccgaaccccggtaaacggggtcccctacggttcccgggtttccccttttaccccccccggtcgggtacccgtacccccctttccccggttaacccgaaacggtaccgtaaccccgtaaccccgttccgggttacgggggtacccaacggtaccggacccgtaaccgggccccggttagggggtacccgttccgggtacccgtcggggttaacccgtaaaaccggggttacccttttacccgttacccgtaccggttaacccttacgttaccgttaccggtacggtaccggggtacccggtccgggttaaccgggccggtaaaccgggggtcccgtaccggtaaggttacgngtacgg

SEQ ID NO: 54561 - DNA, 758 bp, Homo sapiens
  misc_feature: GYAE6OF02GLO0T.29.78.H01.1.454.CMB.1.raw
  modified_base (155)..(155): a, c, t, g, unknown or other
  misc_feature (155)..(155): n is a, c, g, or t
  modified_base (180)..(180): a, c, t, g, unknown or other
  misc_feature (180)..(180): n is a, c, g, or t
  modified_base (216)..(216): a, c, t, g, unknown or other
  misc_feature (216)..(216): n is a, c, g, or t
  modified_base (241)..(241): a, c, t, g, unknown or other
  misc_feature (241)..(241): n is a, c, g, or t
tcagatagagtactcacgaccggtgctcgatttagtgtgagtagtttgggtttggggtctgagagaggagtccacccctgggatcttcaggtgttttcatttggtgatcaggacggaacagagagaactcaccatggagtttgggctgagcgtgngtttctaggtgctattttaaaaggngtcagtgtgacgtgcagttggtggagtctgggggcncctggggtacggccggggggggtcncgtaggagactcgtcctgtcgcggtcctcgtaggtaatttaaggtttaggagtcagtgacctatagtaacgtcgggtccgccgaggtctaccggaaggggaacggggtcgtaggtaggtgggtccgtacggtacgttaagttaggtcggacgtaggtgggtggacgtactaagttaagttagttaagtgacgtaacggaccgtacccgtagggtaaacggggtcccgttaccgaaccgttaacgtttaccgaaggtaacgtaactaaacgttaacggaaacgaacgacgtacgtagtacgtacgtacgaactaaagtaggaacgtacgtacgtagaacgtaaccgtaacggaacgaaccgtaaccggtccgttagttaagtttaagttacggtaaaggttaaacgggacgtaacggtacgtaagggtaacggtaacccggggaacccgggtacccgtaaccgttaacggaacccgtaggtacgggaccggtacggggtaccgtacggtacggtaccg

SEQ ID NO: 54562 - DNA, 637 bp, Homo sapiens
  misc_feature: GYAE6OF02GRILJ.29.78.H01.1.454.CMB.1.raw
  modified_base (635)..(635): a, c, t, g, unknown or other
  misc_feature (635)..(635): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagacacgctgtatctgcaaatggagagcctgagactcgacgacacggccgtctatttattgtagttaaaggcgagcgtaggaataccggggaccggggcccgacttcggacccacgtggggccaaggggaccgcgtggtcaccgtctcctcacgcctacccacgaacggggccccagttccggtcccttcccccgtggcccaccccttccctacccaacggacgcctaaccctcggacggggccaacgacgccgacgcccgtacgggccgtcgcccgttaggtaccgaaaggtaccttaacccgttccgaacgttacctcgttaacgtcgtcggaacggccgggtcgtacgggtacaacgggccgacgaacttagancg

SEQ ID NO: 54563 - DNA, 679 bp, Homo sapiens
  misc_feature: GYAE6OF02GHXWS.29.78.H01.1.454.CMB.1.raw
  modified_base (451)..(451): a, c, t, g, unknown or other
  misc_feature (451)..(451): n is a, c, g, or t
tcagatagagtactcacgaccggtgctcgatttagtgtgagtagtttgggtttggggtctgagagaggagtccacccctgggatcttcaggtgttttcatttggtgatcaggacggaacagagagaactcaccatggagtttgggctgagctggctttttcttgtggctattttaaaaggtgtccagtgtgacgtgcagttggtggagtcgtgggggcgccgtggggtacgggccggggggggtcgctggagactctcctgtgcggcctctggattaagttttaggagtcatgccatgaactcgggtccgccaggctccgaggggaagggggcgtggagtggggtctcggctagttagtggcaggtggtggcgctatatattatgcagacgcctggacgggtccgttcacctatttccagagactaatcgaaacaacacgctagtatcgtnacgaaagtggagacgcctgaacgtaccgtacgaaccggaccgaaccgggtcccgttaacgttaacttttagtttcggtttaagggttaaaacgggccggtaaggtcggttaacgggtaaacgggttaccgggggggaaccccggggttacccggtaaccgtttaccggaacccgtacgggttacgggggacccggaagggggtacccgtacgggttgggtaaccccgg

SEQ ID NO: 54564 - DNA, 763 bp, Homo sapiens
  misc_feature: GYAE6OF02I57T1.29.78.H01.1.454.CMB.1.raw
  modified_base (756)..(756): a, c, t, g, unknown or other
  misc_feature (756)..(756): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgacaaagtggagagcctgacgactacgacgacgacggccgttacgtattagttgttagttaaaggcgagcgtaggaagtaccggggaccggggtacccgacgttcggaccgtacgtcggggggaccgagggggaccgtcgtacgggtaccgaccggttccttcccgtacgaccggtccctacccgaacccggtaacgggcccctaacggtttcccggtcccctttccccccggtgggacccctaaccccgttcccgtaccgaaacggaccgtccctaaccgttccgggtcgggggaccacctacggcccgaacgtccccggtacggggccttaccggcccgttagggtaccaaaccggggtacctttaccggttacccgtaacgttacccttacgttaaccgttccggttacgggaaccgggtcccggggttacccggtacgggaacccggtaacggggcccgtaacgtaacgggttaacgngtaaccg

SEQ ID NO: 54565 - DNA, 608 bp, Homo sapiens
  misc_feature: GYAE6OF02IJIJ5.29.78.H01.1.454.CMB.1.raw
  modified_base (236)..(236): a, c, t, g, unknown or other
  misc_feature (236)..(236): n is a, c, g, or t
  modified_base (607)..(607): a, c, t, g, unknown or other
  misc_feature (607)..(607): n is a, c, g, or t
tcagatagagtactcacgaccggtgctcgatttagtgtgagtagtttgggtttgggggcgcctgggtacggtcgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttnaccattttccagagacaattcgaagaacacgctgtaatctgacaaaatggagagcctgagactcgacgacacggccgtctattattgtgttaaaggcgagctggaaactacggggaccggggcccagttcgaccacgtggggccaggggaccgcgtcggtcaccgtctcctcacgccctccaccgaacgggcccacgtccggtccttcccccgtcggcctaccctcctaccaacgacgcctaaccctcgtcgggggccacgacgaccacggcccgtagggcctcgccgtggtaccgaaacggtaccttaaccgttaccagttacctcttagtccgtaggcggcgggtctgggacgacgggcgacgagtagnc

SEQ ID NO: 54566 - DNA, 673 bp, Homo sapiens
  misc_feature: GYAE6OF02H4XWE.29.78.H01.1.454.CMB.1.raw
  modified_base (235)..(235): a, c, t, g, unknown or other
  misc_feature (235)..(235): n is a, c, g, or t
tcagatagagtactcacgaccggtgctcgatttagtgtgagtagtttgggtttggggtccgagccatggtgcagactccccagagctctcctcctcctccactgcacagggtctctctcccagcctgtgctgactcaatcgccctctgcctctgcctccctgggaggctcggtcaaggtcacctgtactctgagcagtggacacagcagctacgccatcgcttggcatcagcagnggccagacacgggccctgttactgatgacagtacaacaatgatggcagtcacgaggcggaaggggggacgactcccgtgactcgcttctcgagtctcgagcgttcgtcgggcctaggacgcctcgtacctacaattaactccgtacccggtccttccgagttcgtagtaaggagtacggacggcttacgtaactttacttacgtcgtacgacggtaaccggtcggggacctacggtcggtacttacgtttaccggtacgggtttaccggttacccggggaaacccggggtaccgtaacgggttcccgtacccgggttccgggttaccgggttacccgacccgggtaaccccgtaaacccgggaacccccttaaaccccggtaccggtttacccggtacccgttaacccgtttccccgttaccccgtttaacccccccg

SEQ ID NO: 54567 - DNA, 709 bp, Homo sapiens
  misc_feature: GYAE6OF02HSRBY.29.78.H01.1.454.CMB.1.raw
  modified_base (704)..(704): a, c, t, g, unknown or other
  misc_feature (704)..(704): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacattcgaagaacacgctgtatctgcaaatgagagctgagactcgacgacacggccgtctatttacttgtagttaaaggcgagcttaggaacgtaacggggaccggggccccgacgttcgacccaacgtcgggggccaagggggcgcgtcggtcgacccggtctccctcacgtccctcccgaccgaacggggtccccaacgttccggtccctttccccccgtacgggtccctaaccccgttcccctacccgaaacggaccgtccctaacccgttaccggtcgggggaccctaacggacgtacccggacgtccccggtagggtcctcggtcccgttcgggttaccgtaaacgggtaaccttacccgtttaccgaacggttacccttcttaaccgttccgttaggtacggaccgggtaccgtagggtaccgaacgggtccggtaccaagttaccggngtacg

SEQ ID NO: 54568 - DNA, 639 bp, Homo sapiens
  misc_feature: GYAE6OF02F43RI.29.78.H01.1.454.CMB.1.raw
  modified_base (272)..(272): a, c, t, g, unknown or other
  misc_feature (272)..(272): n is a, c, g, or t
  modified_base (283)..(283): a, c, t, g, unknown or other
  misc_feature (283)..(283): n is a, c, g, or t
  modified_base (383)..(383): a, c, t, g, unknown or other
  misc_feature (383)..(383): n is a, c, g, or t
  modified_base (465)..(465): a, c, t, g, unknown or other
  misc_feature (465)..(465): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaagggctggagtgggtctcggctattagtggcagtggtggcgctatatattatgcagacgccctgaagggccggttcaccatttccagagacaattcgaagaacacgctgtatntgacaatgganagcctagagctcgacgacgcggccgtctattattgtagttaaaggcgagctaggagtacggggacccgggccgacttcgaccacgtgggccgaggggacncgtggtcaccgtctcctcgacgtccctccgacgacgggcccagtccgtccttcccccgtgcccgaccctcccaccaacgacncctacccgtcggtcggggtaccaccgtacgaccggtaccgcccggttgggtccgtcggccgttcggtacgaaaccggtacttacccgttaccgacgttacctacctacgttccggtacggtacgggtccgggtacggttacggaccggtacgggccgtacgtaacgtacgctcg

SEQ ID NO: 54569 - DNA, 687 bp, Homo sapiens
  misc_feature: GYAE6OF02IRS7D.29.78.H01.1.454.CMB.1.raw
  modified_base (357)..(357): a, c, t, g, unknown or other
  misc_feature (357)..(357): n is a, c, g, or t
  modified_base (382)..(382): a, c, t, g, unknown or other
  misc_feature (382)..(382): n is a, c, g, or t
  modified_base (414)..(414): a, c, t, g, unknown or other
  misc_feature (414)..(414): n is a, c, g, or t
tcagatagagtactcacgaccggtgctcgatttagtgtgagtagtttgggtttggggtccgagccatggtgcagactccccagagctctcctcctcctccactgcacagggtctctctcccagcctgtgctgactcaatccgccctctgcctctcgcctccgtgggaggctcggtcaaggtcacctgtactctgagcagtgacacagcagctacgccatcgcgttgcatcagcagcgccagacacgggcctgtttactgatgacagtcaaactaagtgtacgtggactaacgtacaacgtaggaccggtaaagggggacggtactcccgtagacttcgtcttgaccgtgtcctaccngtaccgtcgttcggggcctaggacnccgtacctacctacgacacttccgcccgtccnctacggtcgtaggaacggtgaaggtcggtacttacggaacttttaacggttcacggttaaccgtggtaaccccggtaggggtactacgtacgggtcttaacgttacggtaccgggttaaccggttccggggaaacccggggtaacgtaccggtacccggttaacccggttccgggttaaccgaccggtaacccggtaaccccgaacggtaacccccgaacccccgttaggttacccgttataccccggttacccggtcccgttaaccccccgg

SEQ ID NO: 54570 - DNA, 597 bp, Homo sapiens
  misc_feature: GYAE6OF02GCKRX.29.78.H01.1.454.CMB.1.raw
  modified_base (595)..(595): a, c, t, g, unknown or other
  misc_feature (595)..(595): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaagtacggggaccggggcccgacttcgaccacgtcggggccgaggggacgcgtggtcaccgtctcctcacgcctccaccgacgggcccatccggtccttccccctggcccaccctccctaccaacgacgcctacctcgtcggggcaccgacgcgacgcccgtgggcctcgccgttcggtcgaacggtccttaccttacccgacgttaccttctacgtcgtacggacgggcgggcgtggacgacgggccgacacgtacgncg

SEQ ID NO: 54571 - DNA, 594 bp, Homo sapiens
  misc_feature: GYAE6OF02H71FG.29.78.H01.1.454.CMB.1.raw
  modified_base (272)..(272): a, c, t, g, unknown or other
  misc_feature (272)..(272): n is a, c, g, or t
  modified_base (592)..(592): a, c, t, g, unknown or other
  misc_feature (592)..(592): n is a, c, g, or t
tcagatagagtactcacgaccggtgctcgatttagtgtgagtagtttgggtttgggggcgcctgggtacggccggggggtcgctgagactctcctgtgcggcctctggattaagtttaggagtcatgccatgaactgggtccgccaggctccaggggaaggggctggagtggggtctcggctattagtggcagtggtggcgctatatattatgcagacgccctgaagggccgttcaccatttccagagacaattcgaagacacgctgtatcngcaaatggagagcctgagactcgacgacacggccgtctattattgtagttaaaggcgagctggaatacggggaccgggcccgtacttgacctacgtggggccagggggacgccgtgggtcaccgttctcctcgacgcctcccaacgaacgggcccacgtcggtcttccccctcggcctaccctcctacccacgacgcacctcgcggggccacgacgcacggcccgtcgggctcgcctcgggtacaacgggctaaccgttccgacgtaccttacgtacttctcggaggcgggcgtacggacgaacggccgcgaacgtacgncg

SEQ ID NO: 54572 - DNA, 568 bp, Homo sapiens
  misc_feature: GYAE6OF02GOGFS.29.78.H01.1.454.CMB.1.raw
  modified_base (566)..(566): a, c, t, g, unknown or other
  misc_feature (566)..(566): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccggggcccgaacgttgaccacgtggggccaggggacgcgtggtcacgtctcctcacgcctccaccaggcccactcgtcttcccctcggccaccctcctccaacgacgaccacctcgtcggggcacgacgcacgcccgtcgggctcgtccgtcggtacaacgggacttaactccacgtactctacgtcgtgacggcggcgtggacgacggcgcgagtacgncg

SEQ ID NO: 54573 - DNA, 783 bp, Homo sapiens
  misc_feature: GYAE6OF02FJCA5.29.78.H01.1.454.CMB.1.raw
  modified_base (357)..(357): a, c, t, g, unknown or other
  misc_feature (357)..(357): n is a, c, g, or t
tcagatagagtactcacgaccggtgctcgatttagtgtgagtagtttgggtttggggtctgagagaggagtccacccctgggatcttcaggtgttttcatttggtgatcaggacggaacagagagaactcaccatggagtttgggctgagctggctttttcttgtggctattttaaaaggtgtccagtgtgacgtgcagttggtggagtctgggggcgccgtggggtacggccgggggggtcgcgtgagactctcctgtgcggcctcgtggattaagttttaggagtcatgccatcgaacgtgggtccgccgaggcctccgaggggaaggggctggaggtgggtctcggctattggnggcaggtggtgcgctatatattatgcagaccgcccgtaggaaggggcccgtttacaacccttagtttccagacgaactaagttacggaaagaaccacggtcttaggttaactcctaggaacctaaagtagggaacgacggtaccctaggaacggtaaccgtaccgggaacccgggtaaccgacccggggtacccgtttaaccgtttaagttttaacgttttagggtttaaacgggttttaaaaacggggcccggtaagggtaccggttaacgggggtaaaaccgggttaaccccggggggggaaccccggggggttacccccggtaacggttttaccgggaacccccggttaaccgggttcggggggggaaacccccggtaacggggggggtaacccggttccgggttaccggggttaacccccgg

SEQ ID NO: 54574 - DNA, 629 bp, Homo sapiens
  misc_feature: GYAE6OF02HZWQ6.29.78.H01.1.454.CMB.1.raw
  modified_base (627)..(627): a, c, t, g, unknown or other
  misc_feature (627)..(627): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccgagggaaggggctggagtgggtctcggctattagtggcagtggtggcgctatatattatgcagacgccctgaagggccggttcaccatttccagagaacaattcgaaagaacacgctgtatctgacaaatggagagcctgagactcgacgacacggccgtactattattgtgttaaaggcagctggaatacgggaccgggcccgacgttcgaccacgtggggccgaggggaccgcgtgggcaccggtctcctcacgccctaccaccgaacggacccacgtccggtccttcccccgtcggcctacccgtaccctacccgaacggacgaccacccgttcggtcgggggaccacggacgccaacgcccgtaggggcctgccgttacggtaccgaaacggaccttaccgttaccctacgtaccttccgtactccgtaggacggccgggtcgtcggacgaacgggcgacgaagtcgancg

SEQ ID NO: 54575 - DNA, 874 bp, Homo sapiens
  misc_feature: GYAE6OF02FXBIS.29.78.H01.1.454.CMB.1.raw
  modified_base (460)..(460): a, c, t, g, unknown or other
  misc_feature (460)..(460): n is a, c, g, or t
tcagatagagtactcacgaccggtgctcgatttagtgtgagtagtttgggtttggggcgcctgggtacggccgggggggtcgctgagactctcctgtgcggcctctggattaagttttaggagtcatgccatgaactgggtccgccaggctccagggaagggctgggagtgggtctcggctattagtggcagtggtggcgctatatattatgcagacgcccgtgaacgggccggttcaccatttccagagacaattcgaaagaaccacgctgtactcgtcgacaaagtggagacgcctgacgactcgacgacgaccggccgtactagtttattgtacggttaaaggcgtaacggaccggaaattaccgggggacccggggacccgtactttcggacccctacggttcggggacccgtaagggggccgtccgttcgggtccgacccggttctaccccgtanaccggccccttaccccgaacccgaaacggggtccccctaacggttacccggtttccccgtttcccccccgtacgggtcccctaacccccgtccccgttaaccccgtaaaccggaccgacccgtaccccgttacccgggttacggggggaccctaaccggaaccggacccgtaaccgggtcccccgggttacggggtaccccgttaccgggtaccccggtttacggggtacccgttaaaacggggttaaccccgttaaaccccggttttaccctaaccgggtttaacccgttacctttaaccggttccgttaaaccgggggaccgggtttaacccgggggtcccggttaaccggggtaacccggtaaacgggggtaccccggtaaccggtaaacggtttcggtaccgtagtacgg

SEQ ID NO: 54576 - DNA, 672 bp, Homo sapiens
  misc_feature: GYAE6OF02HTBFB.29.78.H01.1.454.CMB.1.raw
  modified_base (262)..(262): a, c, t, g, unknown or other
  misc_feature (262)..(262): n is a, c, g, or t
  modified_base (418)..(418): a, c, t, g, unknown or other
  misc_feature (418)..(418): n is a, c, g, or t
  modified_base (668)..(668): a, c, t, g, unknown or other
  misc_feature (668)..(668): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgcaggctccagggaaggggctggagtgggtctcggctattagtggcagtggtggcgctatatattatgcagacgccctgaagggccgttcaccatttccagagacaattcgaagaacncgctagtatctgcaaatggagagcctggacgactcgacgacgacggccgtacttattagttgtagttaaaggcgagctaggaagtaccggggacccggggcccacgttcgaccacgtggggaccgaggggacgcgtacggtccaccgtctcctacncgccctaccaccgtaacgggccctacgtccggtcccttcccccgtcggaccctaccctccctaccgaacgacgaccgtacccgtcgtcggggacctacgacgaccgacggcccggtcgggtaccgtccgtcccggttcgggtaccgtaaaccggtactacccgttacctaacgttaccttcgttaccgtcgtaggaccgggtcggtaccggtacgggaccggaacgggtacccgacggttaacgtacggntacg

SEQ ID NO: 54577 - DNA, 580 bp, Homo sapiens
  misc_feature: GYAE6OF02G4373.29.78.H01.1.454.CMB.1.raw
  modified_base (208)..(208): a, c, t, g, unknown or other
  misc_feature (208)..(208): n is a, c, g, or t
  modified_base (239)..(239): a, c, t, g, unknown or other
  misc_feature (239)..(239): n is a, c, g, or t
  modified_base (318)..(318): a, c, t, g, unknown or other
  misc_feature (318)..(318): n is a, c, g, or t
  modified_base (391)..(391): a, c, t, g, unknown or other
  misc_feature (391)..(391): n is a, c, g, or t
tcagatagagtactcacgaccggtgctcgatttagtgtgagtagtttgggtttggagtctgcaccatggctcggaccccactcctcttcctcaccctcctcctccactgcacagggtctctctcccagcctgtgctgactcaatcgccctctgcctctgcctccctgggagctcggtcaaggtcacctgtactctgagcagtggacanagcagctaacgcatcgcttggcatcagcagnggccagactacgggccctcgttactgatgacagtcaaacaatgatggcagtcacagcaaggggacggatcccgtgatcncgttctcagtctccgagctcgtgggcctgacgcgtctacctcaactaatcctaccggcctcagtctgaggtanggagctagacttattacgcgttcagtacccgtggggtacctacgtcgggctaagtttaccgagggtttccgttaccggggacccgggtaacggtaacggtccctaaccgggttccgtaccgacggttaccaaccggtacccaaccggggtacccaaacccccggtacttacggtacctaccgttacccg

SEQ ID NO: 54578 - DNA, 679 bp, Homo sapiens
  misc_feature: GYAE6OF02GIZV2.29.78.H01.1.454.CMB.1.raw
  modified_base (677)..(677): a, c, t, g, unknown or other
  misc_feature (677)..(677): n is a, c, g, or t
tcagatagagtactcacgaccggtgctcgatttagtgtgagtagtttgggtttggtggtctctctcccagcctgtgctgactcaatcgccctctgcctctgcctccctgggaggctcggtcaaggtcacctgtactctgagcagtggacacagcagctacgccatcgcttggcatcagcagaggccagacacgggccctcgttactgatgacagtcaacaatgatggcagtcacagcgaagggggacggactcctgactcgcttctcagtcctccgagctcgtcgggcctggacgccgtacctaccgtacaacaacgttcccgtaccccggtcccttaccgacggttcctagggaaggtactagggacgggtcttacggtaactttaagtttacgtcggtaccgaacggtacccggtgggggacctacggtggacctacgtttccggacggggtttcccgttaccgggggaacccgggggtaacctaacgggtcccgtaaccgggttcccggtaccggtaccgaccggtaccccgaacggaccccaaacccgtctacgtccctaccgttccgttacccgttccccctacccgttcctacgtaccgttacctcgttactccggtcggaccgggtccgggtccgtacgggaaccgacgggtccgaacgtagtacggccngc

SEQ ID NO: 54579 - DNA, 692 bp, Homo sapiens
  misc_feature: GYAE6OF02F3XPG.29.78.H01.1.454.CMB.1.raw
  modified_base (178)..(178): a, c, t, g, unknown or other
  misc_feature (178)..(178): n is a, c, g, or t
  modified_base (215)..(215): a, c, t, g, unknown or other
  misc_feature (215)..(215): n is a, c, g, or t
  modified_base (237)..(237): a, c, t, g, unknown or other
  misc_feature (237)..(237): n is a, c, g, or t
  modified_base (507)..(507): a, c, t, g, unknown or other
  misc_feature (507)..(507): n is a, c, g, or t
tcagatagagtactcacgaccggtgctcgatttagtgtgagtagtttgggtttggggtcgtgagagaggagtccacccctgggatcttcaggtgtttcatttggtgatcaggacggaacagagagaactcaccatggagtttggctgagctggcttttcttgtggctatttaaaggtntccagtgtgacgtgctagttggtggagtctgggggcncctgggtacggccggggggtcnccgtgagacgtctcctgtgcggcctacgtggattaaggtttaggagtcatgcctagtgaacgtgggtaccgccaggctacccggagggaacggggcgtgggaggtggggtactcgggcctagtttaggtggcgtaggttggtggcgtacgtatagttagtactgcgagaccgtccctggaacgggtccggttacaccgtactttccagacgtactaagttacgaaagaacaacgtcgtagtacgtcctaggaccaaagtcgggaagtacncccgttgaaccgtacgtaccggaacgaacgtacccgggtacctcgttaacgttagttcttaagggttaaaaccggcgaggttacgtaggaacgggttaaccggggggaccccgggtccccggtaacgtttaccgaccccgtaaggtccgggggaccgtaaccgggggcgtaccgtggtaccccgg

SEQ ID NO: 54580 - DNA, 682 bp, Homo sapiens
  misc_feature: GYAE6OF02JCL5W.29.78.H01.1.454.CMB.1.raw
  modified_base (680)..(680): a, c, t, g, unknown or other
  misc_feature (680)..(680): n is a, c, g, or t
tcagatagagtactcacgaccggtgctcgatttagtgtgagtagtttgggtttgggggcgcctgggtacggccgggggtcgctgagactctcctgtgcggcctctggattaagttttaggagtcatgccatgaactgggtccgccaggctccgagggaagggctggagtgggtctcggctattagtggcagtggtggcgctatatattatgcagacgcctgaaggccgttcacattccagagacaattcgaagaacacgctgtatctgacaaatggagagcccgagactacgacgacacggccgtctagttattgtagttaaaggcgagccgtaggaaacgtaccggggaccgggcccgtacgttgaccacggtcgggccgaagggggacgcgtcgggtcctaaccggtctacccgtcgacgtcccgtacccgaacccgaacgggcccctaacgtcccggttccctttccccccgtacggtacccctaacccctcccgtacccgaaacgacgcccgtaccgttaccggttcgggggaccaaccgacgtacgaaccggtcccgtcgggtaccgtcggtacccgtcgggtaccgaacggtaccgtaccgttaccgtacgttaccgtctaacgtcgtacggacggtcggtacgtcggacgacggtccgactacgtacgcgtancg

SEQ ID NO: 54581 - DNA, 765 bp, Homo sapiens
  misc_feature: GYAE6OF02JUH4S.29.78.H01.1.454.CMB.1.raw
  modified_base (309)..(309): a, c, t, g, unknown or other
  misc_feature (309)..(309): n is a, c, g, or t
  modified_base (326)..(326): a, c, t, g, unknown or other
  misc_feature (326)..(326): n is a, c, g, or t
tcagatagagtactcacgaccggtgctcgatttagtgtgagtagtttgggtttgggggtcggccgtgggtacggccgggggggtcggcgtgagacgtctcctgtgcggcctctggattaagtttaggagtcatgccatgaactgggtccgccaggctccagggaagggctggagtgggtctcggctagttagtggcagtggtggcgcgtatatattatgcagacgccctggaacgggccggttcaccatttccagagacaagttcgaaagacacgcagtatctagcaaagtggagagcctagacgtacncgacgacaccggccgtntacgttatgtaggttaaaggcgacgacgttggaaacgttaccggggaccccgggccgtaacgttggaacccgacggttcgggggacccgaagggggtactcgttacgggtacctaacccggttcgtacccgtcgaaccggtccccttacccggaaccgtaaccggggacccctacggttacccggttccccgtttaccccccgcgggtacccctacccccgttcccgtaacccgtaacgacggccctaacccggtaccgttcgggggaccctacgacgtacccaacggtccccgtacgggccctacggcccgttacgggtaccgaaaccgggtaccttaaccgttccgaacgttaccgttacctacgttacgttccggaacggtccgggtaccttacggggacctaacggggtcccgacgtaaccggttaggacgtccg

SEQ ID NO: 54582 - DNA, 724 bp, Homo sapiens
  misc_feature: GYAE6OF02HB7TJ.29.78.H01.1.454.CMB.1.raw
  modified_base (700)..(700): a, c, t, g, unknown or other
  misc_feature (700)..(700): n is a, c, g, or t
tcagatagagtactcacgaccggtgctcgatttagtgtgagtagtttgggtttggggtccgagccatggtgcagactccccagagctctcctcctcctccactgcacagggtctctctcccagcctgtgctgactcaatcgccctctgcctctgcctccgtgggaggctcggtcaaggtcacctgtactctgagcgagtggacacagcagctacgccatcgcttggcatcagcagacggccaacggaccgaccgggccccttcggttaacttgatacgacgtagtaccaaaacgtaatggacgtcggacacggtcaaccggaggaccggaaggggggaccggacttcccgtagacgtccgtcttacgtcgtacggtcctcgacgtcttcgtcgggtacctgacgtccgtacctaccgttacaacttaaccgtccgtacccggtccttaccgtacggttcgtaacggtacgggtactacgggacggtaccgttacgtaaccgtttaagtttacgtacggttaccgaacggtaacccggtcgggggtaccaaccggttcggtaccttaacggtttcgtaaaccgggtttcccggttaaccggggaaaccgggtacccgtaacgggtcccggtaaccggttcggttaccgggtacgaccggaccccgtaaccggacccctaaacccgttcgtaaccgttaccnccgtttaccgtacccttacccccg

SEQ ID NO: 54583 - DNA, 726 bp, Homo sapiens
  misc_feature: GYAE6OF02IW5WK.29.78.H01.1.454.CMB.1.raw
  modified_base (212)..(212): a, c, t, g, unknown or other
  misc_feature (212)..(212): n is a, c, g, or t
  modified_base (248)..(248): a, c, t, g, unknown or other
  misc_feature (248)..(248): n is a, c, g, or t
  modified_base (595)..(595): a, c, t, g, unknown or other
  misc_feature (595)..(595): n is a, c, g, or t
  modified_base (617)..(617): a, c, t, g, unknown or other
  misc_feature (617)..(617): n is a, c, g, or t
tcagatagagtactcacgaccggtgctcgatttagtgtgagtagtttgggtttggggtctgagagaggagtccacccctgggatcttcaggtgttttcatttggtgatcaggacggaacagagagaactcaccatggagtttgggctgagcgtggtcttttctggtcggctaagttttaaaaggtgtccagtgtgacgtgcaggttggtggngtcgtggggcgccgttggggacgggccggggggtcncgtgagctctcctgtcgcggcctcgtggaatttaaggtttaggagtcgagtcgccagtgaacgttcggttccgccgaggcctccgaaggggaacggggtcgtgggaggtcgggtcgttcggacttaagttacggtggcgtaggtgggtggcgcgtagtattaattagtgcgaaggtaccgacccgtggaacgggtccgttacaaccgtaagtttccgaagtaccggtaataacggtttacgaaaacgaaccgtaccgtataccgttagtacgtaacgactaaaaggtgggaaacgtacgtccgtagactaacgtcgaaccggaaccgtcggaccgttcttaacgttnttaggtaacggttaaaaccggngggtacgtacggtaaggaacgggtaacccggggtacccgggtacccgtaacgttaccgaccggtacggtacggggacccgaacggggtccgtaccggtaccggtaccgg

SEQ ID NO: 54584 - DNA, 755 bp, Homo sapiens
  misc_feature: GYAE6OF02J1K7I.29.78.H01.1.454.CMB.1.raw
  modified_base (240)..(240): a, c, t, g, unknown or other
  misc_feature (240)..(240): n is a, c, g, or t
  modified_base (287)..(287): a, c, t, g, unknown or other
  misc_feature (287)..(287): n is a, c, g, or t
  modified_base (754)..(754): a, c, t, g, unknown or other
  misc_feature (754)..(754): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgccaggctccagggaaggggctggagtgggtctcggctattagtggcaggtggtggcgctatatattatgcagacgccctagaagggccgttcaccntttccagagacaattcgaagaacacgctgtactctgctaaagtgganaggcctgagactcgacgaccacggccgtacttattacttgtagttaaacggcgaagtcgtagggaagtaccgggggacccggggtaccccgacgttacggacccgaaccgttcggggggacccgaggggggaacctcgtacgggttccaacccggttcgttacccgtaccgaaccggtccccttcccgaaacccggaaccggggacccctaccgtaccggtttccccgtttaccccccgttgggaaccccctaccccgtacccctacccgaaacggtaccggaccctaacccttccgggtacggggtacccaccgacggtacccgaacggtccccgtacgggccgttacgcccggttacggttaaccgaccggtaacccttaaccgttacccgtacgtcccttacgtaccgttaccgtacggacgtccggggtaccgtcggacggttaaccggccgacgaactcggnc

SEQ ID NO: 54585 - DNA, 626 bp, Homo sapiens
  misc_feature: GYAE6OF02FMFCX.29.78.H01.1.454.CMB.1.raw
  modified_base (384)..(384): a, c, t, g, unknown or other
  misc_feature (384)..(384): n is a, c, g, or t
  modified_base (623)..(623): a, c, t, g, unknown or other
  misc_feature (623)..(623): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctggaagggccggttcaccatttccagagacattcgaagacacgctgtatctgcaaatggagagcctgagactcgacgacacggccgtctattattgtagttaaaggcgagctggaagtaccgggaccgggcccgacttgaccacgtcggggccgaggggacncgtcggtccaccgtctccgtcacgccctacccaccgaacgggccctacgtccggttcccttcccccgtcggaccctacccctccctacccaacgacgacctaccgtccggtcggggccacgacgccgacgcccggtggccgtcgccgtggtaccgaacggtaccttaccgttacctacgtaccttacgtactcgtacggacggtcggtccggtacggacgaaccggccgacgacgtagntcg

SEQ ID NO: 54586 - DNA, 689 bp, Homo sapiens
  misc_feature: GYAE6OF02IV3SY.29.78.H01.1.454.CMB.1.raw
  modified_base (498)..(498): a, c, t, g, unknown or other
  misc_feature (498)..(498): n is a, c, g, or t
  modified_base (513)..(513): a, c, t, g, unknown or other
  misc_feature (513)..(513): n is a, c, g, or t
tcagatagagtactcacgaccggtgctcgatttagtgtgagtagtttgggtttggggtctgagagaggagtccacccctgggatcttcaggtgttttcatttggtgatcaggacggaacagagagaactcaccatggagtttgggctgagcgtgtcgtttctaggtgctaagtttaaaaggtgtcagtgtgacgtgcagttggtggagtcgtgggggcgccgtggggtacggccggggggtcgcgtgagctcgtcctggtgccggcctctggagtttaagttttaggagtcatcgccagttgaacgtgggtccgaccagggctccggaagggaacggggcgtggacggtgggttcctcgggaccttagtttagttggcgtaggttgggcggcgtcttagtatagttacgtgctagacgtccctagggtaacgggcccgtttacgaccttacgttccgaaggtacgaacacgttacgaagtaacacgtctgtataccgngacaaacggtggaancggcctagagaccgtcgaacgaccgtaaccgtcgtaccgttagttactttaacgggttgttaaaacggcggtacgtcgttaagggaaccggttaacccgggggacccggggtacccgttaacgttacgaaccgtacgggtaccgggaccggacggggaacgtcgtccggtacccgg

SEQ ID NO: 54587 - DNA, 621 bp, Homo sapiens
  misc_feature: GYAE6OF02FRZUY.29.78.H01.1.454.CMB.1.raw
  modified_base (179)..(179): a, c, t, g, unknown or other
  misc_feature (179)..(179): n is a, c, g, or t
  modified_base (238)..(238): a, c, t, g, unknown or other
  misc_feature (238)..(238): n is a, c, g, or t
  modified_base (343)..(343): a, c, t, g, unknown or other
  misc_feature (343)..(343): n is a, c, g, or t
  modified_base (346)..(346): a, c, t, g, unknown or other
  misc_feature (346)..(346): n is a, c, g, or t
  modified_base (403)..(403): a, c, t, g, unknown or other
  misc_feature (403)..(403): n is a, c, g, or t
tcagatagagtactcacgaccggtgctcgatttagtgtgagtagtttgggtttggggtctgagagaggagtccacccctgggatcttcaggtgttttcatttggtgatcaggacggaacagagagaactcaccatggagtttgggctgagcgtgcgttttctgtggctattttaaaggngtccagtgtgacgtgcagttggtggagtctgggggcgcctgggtacggccggggggtcncgtgagctctcctgtgcggcctcgtggattaagttttaggagtcatgccatgaactgggtccgccaggctccgagggaagggctggagtggtctcggctattggngcngtggtggcgctagtatattatcgcagtcgcccgtggaacgggtcccggttcaccgtntttacccgagtacgactaacttcgaaagaacgtacgcttgtactcgtgacaaagttcggagtacgcctacgagtaccgtcgaacgtacaccggtccgttacgttattacgttgtacggttaaaggccgtagtaccgtaggtaacggtccggggacccggggtacccctaagtccggacccgtacggtcggggaccctaggggcctccggtggtacccg

SEQ ID NO: 54588 - DNA, 671 bp, Homo sapiens
  misc_feature: GYAE6OF02HOVCD.29.78.H01.1.454.CMB.1.raw
tcagatagagtactcacgaccggtgctcgatttagtgtgagtagtttggggtttggggagagctctggggagtctgcaccatggctcggaccccactcctcttcctcaccctcctcctccactgcacagggtctctctccagcctgtgctgactcaatcgccctctgcctctcgcctcccgtgggaggctcggtcaaggtcacctgtactctgagcagtggacacagcagctacgccatcgcttggcatcagcagacggccagaccgaccgggcccttcgttacttgatgacagtacaaacaatgatggctagtcacgaggacggaaggggggacggtactcccgtgactcgtcttctcgtacgtcctaccgacgtcctccggtcgggtccgtggacgccgtacccttaccgtacctaacctaacgttcccgtccccgggtcccttaccgtacggttccgtagggaacggtacgtcgggtacggtcttacggtaaccttaagttaccgtacgtaccgacggtacccggttcggggtactacggtcgacgttacgttccggacggttccggttaacccggggaacccggggtacccgtaacgggtaccccgtaccggttccggtaccggtaccgacccggtaaccccgaacccggacccctaaccccgtacg

SEQ ID NO: 54589 - DNA, 642 bp, Homo sapiens
  misc_feature: GYAE6OF02JGP1M.29.78.H01.1.454.CMB.1.raw
  modified_base (153)..(153): a, c, t, g, unknown or other
  misc_feature (153)..(153): n is a, c, g, or t
  modified_base (244)..(244): a, c, t, g, unknown or other
  misc_feature (244)..(244): n is a, c, g, or t
  modified_base (275)..(275): a, c, t, g, unknown or other
  misc_feature (275)..(275): n is a, c, g, or t
  modified_base (294)..(294): a, c, t, g, unknown or other
  misc_feature (294)..(294): n is a, c, g, or t
  modified_base (640)..(641): a, c, t, g, unknown or other
  misc_feature (640)..(641): n is a, c, g, or t
tcagatagagtactcacgaccggtgctcgatttagtgtgagtagtttgggtttgggggtcggtccgtgggtacggccgggggggtcggcgtggagacgtctcctgtgcggcctcgtggattaagtttaggagtcatgccatgaactgggtccnccaggctccagggaaggggctggagtgggtctcggctattagtggcagtggtggcgctatatattatgcagcgccctgaaagggccggttnaccatttccagagacaattcgaagaacacgntagatctgacaaagtgganacgctagagactcgacgacaccggtctctattagtgtaggtaaacggcgagtcgtaggaacgtaccggggaccggggacccgtacgtacgaccgtacggtcggggaccgaaggggccgtacgttcggtaccgaccgttcctacccgtcgacgcccctaccgaaccgaacgggcccacgtccggtccttccccgtcgcccaccctcctaccgacgacgccgacctccgtcgggccacgacgaccgacgcccgtggccgtcgtccgtcggtaccgaacggtacctaccgtccgtacgtacgtcgtacgtcgttacggcgcgggtcgtacggcgacgggcgacgagcgnng

SEQ ID NO: 54590 - DNA, 607 bp, Homo sapiens
  misc_feature: GYAE6OF02IHXI1.29.78.H01.1.454.CMB.1.raw
  modified_base (605)..(606): a, c, t, g, unknown or other
  misc_feature (605)..(606): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctggaagggccggttcaccatttccagagacaattcgaaagaacacgctgtatctgacaaagtggagagcctgagactcgacgacacggccgtctattattgtagttaaaggcgagctaggaaacgtaccggggaccgggcccgacttcgaccgacgtcggggccgaaggggacgcgtcggtcaccggttctcctcgacgccctacccgaccgaacgggccctacgtccggtcccttcccccgtcggccctaccctccctccaacgacgccaccgtcgcggggccacgacgacacgcccgtacggctcgccgtcggtacaacggtacctactccagttactcttactctaggacgcgggcgtcggacgacggccgacacgtagnng

SEQ ID NO: 54591 - DNA, 769 bp, Homo sapiens
  misc_feature: GYAE6OF02FJSPD.29.78.H01.1.454.CMB.1.raw
  modified_base (218)..(218): a, c, t, g, unknown or other
  misc_feature (218)..(218): n is a, c, g, or t
  modified_base (241)..(241): a, c, t, g, unknown or other
  misc_feature (241)..(241): n is a, c, g, or t
tcagatagagtactcacgaccggtgctcgatttagtgtgagtagtttgggtttgggggtctgagagaggagtccacccctgggatcttcaggtgttttcatttggtgatcaggacggaacagagagaactcaccatggagtttgggctgagctggctttttctgtggctattttaaaaggtgtccagtgtgacgtgcagttggtggagtctgggggcncctgggtacggccgggggggtcnctgagactctcctgtgcggcctctggattaaggttttaggagtcatgccatgaactgggtccgccaggctccaggggaaggggctggagtgggtctcggctattagtggcaggtggtggcgcttatactattagtgctagaccgcccgtaggaacggggtccggttaccacctagttttacccgaaggacgaactaacgttacgaaacgtaaaccaccggtcttacggttaacttccgttagaaccgtaaagttagggaacggtaacggacccgtaggaacggtaccgtacgggaaccggtaaccggacccgggtacccggttacctttaagtttaacgttttacggttaaacgggtttaaaacggggaccgtagggttaccgtaaggggtaaaccggtaaccccgggggggtaacccggggggtaccccccggtaaccggtttaccggaaccccggttaacgggtacccgggggggaaccccggtaccgggggggtaaccggttcccgggttagggttaacccccgg

SEQ ID NO: 54592 - DNA, 628 bp, Homo sapiens
  misc_feature: GYAE6OF02F2VAN.29.78.H01.1.454.CMB.1.raw
  modified_base (400)..(400): a, c, t, g, unknown or other
  misc_feature (400)..(400): n is a, c, g, or t
tcagatagagtactcacgaccggtgctcgatttagtgtgagtagtttgggtttggggtctgagagaggagtccacccctgggatcttcaggtgttttcatttggtgatcaggacggaacagagagaactcaccatggagtttgggctgagcgtggcttttctagtggctattttaaaaggtgtccagtgtgacgtagcagttggtggagtcgtgggggcgccgtggggtacgggccggggggggtccgtgagactctccctgtgcggtcctctgggattaaggttttaggagtcattgcctagtgaacgtgggtcccgccgaggtccgtcccgaggggaaggggcgtggaggtgggtcgtcggctagttagtcggcgagtggtggcgctagtatagttangctagccgcctaggacgggtccgtcacctattccaagagactaagttcgaaacgaacacgctagtatcgtagacaaagtgagacgcgtgacgacgtacgaccgacgaccgccgttactagtttacttaggtagtaacggcgtagtcgtaggaccggtacgggacccgggtacccgtacgttacgacccgtacggtccggggaccgaggggaccgtcggtcggtacccg

SEQ ID NO: 54593 - DNA, 737 bp, Homo sapiens
  misc_feature: GYAE6OF02G3YWR.29.78.H01.1.454.CMB.1.raw
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccgttcaccatttccagagacaattcgaagaacacgctgtatctgacaaatggagagcctgagactcgacgacacggccgtctaattacttgtagttaaaggcgagcgtaggaacgtacggggaccgggcccgacgttcgaccacgttcggggaccgagggggaccgcgttcggtaccgaccggttctcccgtcacggccccttacccgaaccgtaacggggccctaaccgtccgggttacccctttccccccgtacggaccctaaccccgtcccgtacccgaaaccgacgtacccgtaacccgttaccggtcgggggtacccaaccgtacgaccgaaccgtcccggtaccgggtccgttccgtacccggttaccgggttaccgtaaacgggtacccttaccgttacccgtaacggttacccgttaccgttacgttaccgtacggtaacgggtccgggtaccgttacgggacccggaacgggtacccggtacgtaacgttagagtacg

SEQ ID NO: 54594 - DNA, 827 bp, Homo sapiens
  misc_feature: GYAE6OF02HWG0F.29.78.H01.1.454.CMB.1.raw
  modified_base (823)..(823): a, c, t, g, unknown or other
  misc_feature (823)..(823): n is a, c, g, or t
tcagatagagtactcacgaccggtgctcgatttagtgtgagtagttgggtttgggggtcgccgtgggtacggccggggggtcgcgtgacgtactcctccgtgtcgacggcccttcctggtagttaagtttaggacgtcatcggccatacgaacgtggggtccccaccaggtcgtacccgagggggaaacggggtcgtagggaggttcggggttccttcgggtacttagttaggttgggacgtaggtcgggtggcgcgtagtatattatggcgaagtcgcccgtaggaacgggtccggttcacctagtttccgagacgaactaacgttcgaaagaacctcgtcctaggtatctagactaaagtggagtacgccgttagagtactcggacgtacgaccggtccgtacgtacttacgttgtacgttaacggcggtagcgttaggaacgttacccggggaccggggaccctaacgttacgaaacccgtaacggtcgggggtacccgaaggggggtaactaccggtttacgggtccgtaacccggttcgtcccgttacggaccggtacccgtacccgaacccgttaaccggacccgtacgtccggttacccccgttacccccgtacgggccctaaaccccgtcccgtaaaccgtacgaccgaccgtaacccgttcggtacggggccaactacggaccgaacgtcccccgtgggtaccctcggtaccgtacgggttacgaacggtaccttaccttaccgtaacggtaccttcggtactcggttcggaacggtccggtacgtcggacgtacggtaccgtcgtaaggtcgntacg

SEQ ID NO: 54595 - DNA, 767 bp, Homo sapiens
  misc_feature: GYAE6OF02GX9S7.29.78.H01.1.454.CMB.1.raw
tcagatagagtactcacgaccggtgctcgatttagtgtgagtagtttgggtttggggtctgagagaggagtccacccctgggatcttcaggtgttttcatttggtgatcaggacggaacagagagaactcaccatggagtttgggctgagctggtcttttcttgtgctattttaaaagtgtcagtgtgacgtgcagttggtgagtcgtggggcgccgtggggtacggccgggggggtcgcgtgagactctcctgtgcggcctcgtggtatttaaggttttagggagtcatgccatcgaacgtcgggtcccgaccgaggccgtccggaagggggtaaggggttgggaggttggggtcgtcggtacttagttaggtggcgtaggtcgggtgggcgtacgttaatattatttagtcgcgtacggtacccgtcccggttaggggtaaccggggtcccggttaccgtaaccgttactttacccgaacggtaacgtaaacgtaacgtttaaccggaaaacgaaaccgaaccggtacgttagttaacgttacttacggaacgtaaagttacgggaaggtacgtccgtaggaacgtaccgtaccggaccgaccggtaccgtaccgtacttacgtttaacgtttagtttaagggtaaacggccggtagtacgtacgggtaacggtaccgggggtacccgggccccggtaacttccggaacccgtacgggtccggggaccggtacgggggaccgtcgggtccggttaccggtacccg

SEQ ID NO: 54596 - DNA, 665 bp, Homo sapiens
  misc_feature: GYAE6OF02GZEEG.29.78.H01.1.454.CMB.1.raw
  modified_base (269)..(269): a, c, t, g, unknown or other
  misc_feature (269)..(269): n is a, c, g, or t
  modified_base (661)..(661): a, c, t, g, unknown or other
  misc_feature (661)..(661): n is a, c, g, or t
  modified_base (664)..(664): a, c, t, g, unknown or other
  misc_feature (664)..(664): n is a, c, g, or t
tcagatagagtactcacgaccggtgctcgatttagtgtgagtagtttgggtttgggtgggtctctctccagctgtgctgactcaatcgccctctgcctctgcctccctgggaggctcggtcaaggtcacctgtactctgagtcagtggacacagcagctacgccatcgcttggcatcagcagaggccagacacgggcctgttactgatgacagtcaacaatgatgggcagtcacaggcgaagggggtcggattccgtgacttcgcttcncagtccacgagtcctcgtcgggcctggacgcgtactcctacacgtaacgttccgtacccggaccttacgacggttcctagggaggtagttgggacggtctaaggtaacctttaagttaccgtacggtaccgtacggttacccggtacgggggtccaacggttcggtaccttacgggtttaccgacggggtttcccgtaccgggggaaacccggggttaactaaacgggttcccgaaccgggtttcggtaccgggtacaacggtaccccgaacggtcccctaaacccgtgttaccggtaccttaacgttccgtaccgtttccccacccttcgtacgtacgtacctacgtatcgtcgggacgtcggtactaggacgtacggcctactaggtacnganc

SEQ ID NO: 54597 - DNA, 677 bp, Homo sapiens
  misc_feature: GYAE6OF02I7GQ5.29.78.H01.1.454.CMB.1.raw
tcagatagagtactcacgaccggtgctcgatttagtgtgagtagtttgggtttggggtccgagccatggtgcagactccccagagctctcctcctcctccactgcacagggtctctctcccagcctgtgctgactcaatccgccctctgcctctgcctccctgggagctcggtcaaggtcacctgtactctgagcagtggacacagcagctacgccatcgcttggcatcagcagacgccagacacggcctcgttactgatgacagtcaactaatgatggacagtccaacgaggacgggaacgggggacggtactcccgtagacgtcgtcttctcgacgtcctccagtctcgtcgggactggacgctcctacctacacgtactcccgtccgcctacgtacgtcgtaggacggtactacggacgtcgttacgttaactttacgttacgtcgttaccgacgggtccggttacgggggtacctacggttacggtacctagtttccgtaacgggtttccggttaacccggggaacccggggttaaccgtaacgggttacccgtaaccggggttacccggtccggggtaccgacccgggtaccccgtaaacccgggtaacccccaacccggttacgttacccggacccgtttaacccgttcccggttaccccgttaccccccg

SEQ ID NO: 54598 - DNA, 561 bp, Homo sapiens
  misc_feature: GYAE6OF02G1I7K.29.78.H01.1.454.CMB.1.raw
  modified_base (381)..(381): a, c, t, g, unknown or other
  misc_feature (381)..(381): n is a, c, g, or t
  modified_base (559)..(559): a, c, t, g, unknown or other
  misc_feature (559)..(559): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccggggcccgacttgaccactgggggccaggggacnctggtcaccgtctcctcagcctccaccaagggcccatcgtcttccccctggcaccctcctccaagacgcaccctcgtcgggggcacgacgcacgccctgggcctgcccgtggtccaaacgggactacttaccgacgtactcttatctgacggcggcttggacgaggccgacagtacgntc

SEQ ID NO: 54599 - DNA, 618 bp, Homo sapiens
  misc_feature: GYAE6OF02F3P8W.29.78.H01.1.454.CMB.1.raw
  modified_base (616)..(616): a, c, t, g, unknown or other
  misc_feature (616)..(616): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtagttaaaggcgagctggaacgtaccggggaccggggcccgtacgttggaccacggtcgggggccgaagggggaccgcgttgggtccaccgtctccctcacgccctccacccgaacgggcccacgtccggtccttcccccgtcggccaccctccctaccacgacgccacccgtcgtcggggccacgacgcgacgtcccgtgggcctacgtccgtcggtacgaacggtaccttaaccgttccgacgttaccttctacttcgtagacggtccgggcgtcggacgacggccgcgactagncg

SEQ ID NO: 54600 - DNA, 623 bp, Homo sapiens
  misc_feature: GYAE6OF02G15ZM.29.78.H01.1.454.CMB.1.raw
  modified_base (245)..(245): a, c, t, g, unknown or other
  misc_feature (245)..(245): n is a, c, g, or t
  modified_base (373)..(373): a, c, t, g, unknown or other
  misc_feature (373)..(373): n is a, c, g, or t
tcagatagagtactcacgaccggtgctcgatttagtgtgagtagtttgggtttgggggtctgagagaggagtccacccctgggatcttcaggtgttttcatttggtgatcaggacggaacagagagaactcaccatggagtttgggctgagctggctttttctgtggctattttaaaaggtgtccagtgtgacgtgcagttggtggagtctggggggcgcctggggtacgggccggggggggtcncgtgagactctcctgtgcggcctctggattaagtttaggagtcatgccatgaactgggtccgccaggctcagggaaggggctggagtgggtctcggctattagtggcagtggtggcgctatatattangcagacgcctgaagggccgttcaccatttccagagacaattcgaaagaacacgtctagtactctcgactaaagtggagacgcctaggagacctacggaaccgaaccaccgggcccgttccttaagtttactttggttaggttaaacgggcgaggccgttaggggaacgtaaccggggggacccggggtcccgtaacgtttcggacccgtacggtcgggggaccggacgggggaccgcggttcggtacccg

SEQ ID NO: 54601 - DNA, 573 bp, Homo sapiens
  misc_feature: GYAE6OF02HIT8T.29.78.H01.1.454.CMB.1.raw
  modified_base (570)..(570): a, c, t, g, unknown or other
  misc_feature (570)..(570): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccggggcccgacgttgaccacgtggggccaggggacgctggtcaccgtctcctcagccctccaccaacgggcccagtccggtccttcccccgtcgggccaccctccctaccaacgacgccacctcgtcgggggcacgagccagcccgtgggctcgccgtggtcgaaggtacctacgttccagtacctctactctggagtccgggctggacacggccgacagtagntcg

SEQ ID NO: 54602 - DNA, 695 bp, Homo sapiens
  misc_feature: GYAE6OF02HZZQ7.29.78.H01.1.454.CMB.1.raw
  modified_base (249)..(249): a, c, t, g, unknown or other
  misc_feature (249)..(249): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccaggggaaggggctggagtgggtctcggctattagtggcagtggtgcgctatatattatgcagacgccctgaagggccgttcacctatttccaganacaattcgaaagaacacgtctgtaatctgactaaaagtggagagcctgaagactacgacgaacacggcccgtacttatttagttgtagttaaaaggcaagcttaggaaacgtacggggaccccggggacccgtacgttacgaccgtacgtcgggggaccgagggggacgcgttgggaccaccggttcctaccctcaacggtcccctaacccgaaccgaaacgggcccctaacgttcccgggttcccgttaccccccgtacgggccctaaccccgttccctaccaacgacgaccctaacccgtcggtcggggaccacgacgccgacgcccgtagggcctcgtcccgtacggtacgaacggtaactaccgtttaccaacgttaccttacgttacgtaccgtaggtacgggaccgggtacgcggtacgaacgggcgaccaagtacgagc

SEQ ID NO: 54603 - DNA, 701 bp, Homo sapiens
  misc_feature: GYAE6OF02GIR8F.29.78.H01.1.454.CMB.1.raw
  modified_base (215)..(215): a, c, t, g, unknown or other
  misc_feature (215)..(215): n is a, c, g, or t
  modified_base (228)..(228): a, c, t, g, unknown or other
  misc_feature (228)..(228): n is a, c, g, or t
  modified_base (477)..(477): a, c, t, g, unknown or other
  misc_feature (477)..(477): n is a, c, g, or t
tcagatagagtactcacgaccggtgctcgatttagtgtgagtagtttgggtttggggtccgagtccgatggtgcagactccccagagcctcgtcctcctcctccactgcacgagggtctctcctcccagcctgtcgctgactcaatccgccctctcgtccctcgtcgccttcccgtgggacgctcggtacaacggtccacctgtactcgtggacncgagtcggaaccncgagcacgcctacgccagtccgcgttggctatcacgctaaggacggccaggaccaccggggtcccttggtttaactggaatcgactacggtcaaactaactcgaagttcggcagtccaagaggacgggaaagggggttcgaaacctcccgtaggctccggtctttccgactaggtccctcaggtcctacgcggcctagacgtcctacctactacgactactccgtacccgtcacgtgtacgtggacggnttcggaacgcttacggtaactaacgtttcgaggtcccaacgggtaccggtcgggaacctcgttcgggaaccttcgggttactccgggggttaccttaccggggaaccggttaaccgtaccgggttggaacccgggtttccgggccttacgggaacccgtacccggaaccggtccccaacccgttcggttccaacccgttaccgttcccttacccggtacccccc

SEQ ID NO: 54604 - DNA, 610 bp, Homo sapiens
  misc_feature: GYAE6OF02GJPNU.29.78.H01.1.454.CMB.1.raw
  modified_base (311)..(311): a, c, t, g, unknown or other
  misc_feature (311)..(311): n is a, c, g, or t
  modified_base (401)..(401): a, c, t, g, unknown or other
  misc_feature (401)..(401): n is a, c, g, or t
  modified_base (412)..(412): a, c, t, g, unknown or other
  misc_feature (412)..(412): n is a, c, g, or t
  modified_base (607)..(607): a, c, t, g, unknown or other
  misc_feature (607)..(607): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcacctatttccagagacaattcgaagacacgctgtatctgcaaatggagacgcctgagctcgacgacacggccgtntattattggtagttaaaggcgagctaggaacgtacggggacccgggcccgacttcgacctacgtgggggccacggggacgtcgtgggtcncccgtctcccngacgccctaccgaaccgacgggcccacgtccggtcccttaccccgtcggaccctacccctccctaccgaacgaccgcctaccgtcgcggggcacgacgccgacgcccgtgggctcggccgtcggtacaacggtacctacgttcctacgtactctacgtctggacgtcgggctggaccgacggcgactagttacgntag

SEQ ID NO: 54605 - DNA, 587 bp, Homo sapiens
  misc_feature: GYAE6OF02IVRYA.29.78.H01.1.454.CMB.1.raw
  modified_base (260)..(260): a, c, t, g, unknown or other
  misc_feature (260)..(260): n is a, c, g, or t
  modified_base (298)..(298): a, c, t, g, unknown or other
  misc_feature (298)..(298): n is a, c, g, or t
  modified_base (337)..(337): a, c, t, g, unknown or other
  misc_feature (337)..(337): n is a, c, g, or t
  modified_base (415)..(415): a, c, t, g, unknown or other
  misc_feature (415)..(415): n is a, c, g, or t
tcagatagagtactcacgaccggtgctcgatttagtgtgagtagtttggggtttgggggagagctctggggagtctgcaccatggctcggaccccactcctcttcctcaccctcctcctccactgcacagggtctctctcccagcctgtgctgactcaatcgccctctcgcctctcgccctcccgtggggaggctcggtcaaggtcacctgtactctgagcagtgacacagcagctaccgcatcgcttggcatcagcagnggccagaccgacggcctcgttactgatgacagtacaanaatgatggcagtcagagacggaagggggacgactaccgngacgtcgtcttctcgtacgtctccagtcctcgtcgggacctgacgccgtactacctacactactccgtccgcctacgngtcgagagtagtgacgctagtacttacttactacgtcgacgtaccggtcgggactcgcggaactcgttacgtcgggttaccggttaccggggaacccgggtaccgtaacgggtcccgtaaccgggttccgtacggtaccgaccggacccgaaccggtaccccaacccgtacg

SEQ ID NO: 54606 - DNA, 636 bp, Homo sapiens
  misc_feature: GYAE6OF02JYKAU.29.78.H01.1.454.CMB.1.raw
  modified_base (180)..(180): a, c, t, g, unknown or other
  misc_feature (180)..(180): n is a, c, g, or t
  modified_base (249)..(249): a, c, t, g, unknown or other
  misc_feature (249)..(249): n is a, c, g, or t
  modified_base (273)..(273): a, c, t, g, unknown or other
  misc_feature (273)..(273): n is a, c, g, or t
  modified_base (633)..(633): a, c, t, g, unknown or other
  misc_feature (633)..(633): n is a, c, g, or t
tcagatagagtactcacgaccggtgctcgatttagtgtgagtagtttgggtttggtggtctctctcccagcctgtgctgactcaatcgccctctgcctctgcctccctgggagctcggtcaaggtcacctgtactctgagcagtggacacagcagctacgccatcgcttgcatcagcagnggccagaccacggccctgttactgatgaacagtcaacatgatggcagtcacagacgaaggggacggacncctagactcgtctctcagtctccngcgtcgtcgcgtagcgcgctcgtacacactcgtccgtctaccgtagcgtcgagtagaggtttttcgacgtacgtattacttacgtacgtacgtaacggtccggtcgggacgtacgtacgtaccgttaacgttccgtaccgggttacgggttaaccggaaccgggggtaaccgtaaacggtcccggtaaccgttacgggtcccgtacggtacccgacccgaacgaaccccgtaaccgtaccgtacgtaccgtacccgtacgttacccgtcccgtaccctaccgtactaccttacgaccgtttactccggtaggtccgccggtacgtacggaaccgtacggacggttacgacgtaagccgtntcg

SEQ ID NO: 54607 - DNA, 696 bp, Homo sapiens
  misc_feature: GYAE6OF02IMUO1.29.78.H01.1.454.CMB.1.raw
  modified_base (693)..(693): a, c, t, g, unknown or other
  misc_feature (693)..(693): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccaggggaaggggctggagtgggtctcggctattagtggcagtggtggcgctatatattatgcagacgccctgaagggccggttcaccatttccagagacaattcgaagaacacgctgtatctagactaaatggagacgcctagagactacgaccgaacaccggtccgtacttatttatggtagttaaaacggcgtagcgtaggaaacgttacggggaacccgggtacccgtaacgttcggaaccgacgtcgggggaccgaagggggaccgtcgtagggtcctaacccggttcctacccgtacacggtccctacccgaaccgaacggggccccaacggtcccggttcccttcccccgtggaccctacccgtccctaccaaacgacgacctaacctccggtacggggaccaacgacgacgacgcccgtagggtcctcgtaccgttcggtaccgaaacggtacctaacccgtaccgtacgttacctactaacgttctaacggtacggccgggtacgtacggacgacgggccacgtacgtacgnacg

SEQ ID NO: 54608 - DNA, 665 bp, Homo sapiens
  misc_feature: GYAE6OF02GOH63.29.78.H01.1.454.CMB.1.raw
  modified_base (264)..(264): a, c, t, g, unknown or other
  misc_feature (264)..(264): n is a, c, g, or t
  modified_base (661)..(661): a, c, t, g, unknown or other
  misc_feature (661)..(661): n is a, c, g, or t
tcagatagagtactcacgaccggtgctcgatttagtgtgagtagtttgggtttggtggtctctctcccagcctgtgctgactcaatcgccctctgcctctgcctccctgggaggctcggtcaaggtcacctgtactctgagcagtggacacagcagctacgccatcgcttggcatcagcagaggccagacacgggcctgttacttgatgacagtcaacaatgatggcagtcacagcgaagggggacggatccctgatcgcttcncagtcctcagtctcgtggcctggacgccgtactaccacaactaacgtcccgtccggaccttccgacggttacctagggacggtagtcggtacggtcttaacggtactttacgttacgtacgtaccgtacggtacccgggtgggacctacggtcggaccttattaccggtacgggtccgttaccggggaacccggggtaactaaaccgggttccgaacccgggttcggtaccggttacaccgggtacccgtaaacggccccaaccccgtaagtccgttaaccgtaccgtttaccgttacccgttcccctaacccgttcccgtacgtaaccggttcctacgtaccttccggtacggtaccgggtccggtccgtaggtacccgaggtccgataaggcgtnagtc

SEQ ID NO: 54609 - DNA, 742 bp, Homo sapiens
  misc_feature: GYAE6OF02F3QQO.29.78.H01.1.454.CMB.1.raw
  modified_base (737)..(737): a, c, t, g, unknown or other
  misc_feature (737)..(737): n is a, c, g, or t
tcagatagagtactcacgaccggtgctcgatttagtgtgagtagtttgggtttggtggtctctctcccagcctgtgctgactcaatcgccctctgcctctgcctccctgggaggctcggtcaaggtcacctgtactctgagcagtggacacagcagctacgccatcgcttggcatcagcagaggccagacacgggccctgttacttgatgacagtcaacaatgatggcagtcacagcgaagggggacggatccctgatcgcttctcacgtcctccagtcctcgtgggcctggacgccgacttaccctcaactaatccgtcccggcccttaccgagttccgtaggaacggaagtcggacggtccttacggaactttaacgtttaacgtcggttaccaacggtacccggttgggggcctaacggttgggtactacgtttccgggacgggttcccggtacccggggggtaaaccccggggaaaccgtaaccggggttaccccgtaacccgggttcccgggtaccgggttacccgaacccgggtaaccccgaaacccggggtaacccccaaacccccgtccgttacgtacccgtacccgttcccgttcccggttaccccccgtcccctttacccgtaccgttaaccgttaacccttcgttaaccgtccggttacggaccgggtcccggggtccggttacgggaaccggttaacgggccccgttacgtaacggtaaccggtntgacg

SEQ ID NO: 54610 - DNA, 876 bp, Homo sapiens
  misc_feature: GYAE6OF02HWS95.29.78.H01.1.454.CMB.1.raw
tcagatagagtactcacgaccggtgctcgatttagtgtgagtagtttgggtttgggggcgccgtgggtacggccggggggtcgcgtgagactctcctgtgcggcctctggattaagttttaggagtcatgccatgaactgggtccgcaggctccagggaagggctggagtgggctcggctatagtggcagtggtgcgactatatattatgcaagacgccctggaacgggtccggttacaccgtatttccagagacaaattcgaaagaaccaagccgtagtatctagactaaaagtggaagacgcctggaagtaccgtcggaacgaacgaccgggtccctacgtaatttaacgttgtagttaaaacggcgaacgcgttagggaaacttacggggaccccgggaccgtacgttcgaaccacggttcgggggaccaagggggacctcggttcgggaccgaaccccggttctacccgttacgaccggtaccccttacccgaacccccggaaacgggtaccccgtaacgttcccggttaccccgttttccccccggtaccggtacccgttacccccgtaccccgttacccgtaaaccggtaccgaacccgaaccccgtttccggtaccggggggaccctaaaccgtacggacccgttaaacccggaccccgttaccggggcccgttaacccgggtcccgttaaccgggttacccgttaaaacggtaccctttaaacccggtttacccgtaaccggttaacccctttacgttaaccgtttacccggtttaaccggccggggttaacccggggacccggtttacccggggtaccgggtaaaccgggacccgggtaaccccggtaggtttaacggccgtaacgg

SEQ ID NO: 54611 - DNA, 589 bp, Homo sapiens
  misc_feature: GYAE6OF02F944Q.29.78.H01.1.454.CMB.1.raw
  modified_base (320)..(320): a, c, t, g, unknown or other
  misc_feature (320)..(320): n is a, c, g, or t
  modified_base (335)..(335): a, c, t, g, unknown or other
  misc_feature (335)..(335): n is a, c, g, or t
  modified_base (351)..(351): a, c, t, g, unknown or other
  misc_feature (351)..(351): n is a, c, g, or t
tcagatagagtactcacgaccggtgctcgatttagtgtgagtagtttgggtttggggtccgagccatggtgcagactccccagagctctcctcctcctccactgcacagggtctctctcccagcctgtgctgactcaatcgccctctgcctctgcctccctgggaggctcggtcaaggtcacctgtactctgagcagtggacacagcagctacgccatcgcttggcatcagcagaggccagacacgggccctgttactgatgacagtcaacaatgatggcagtcacaggacgaagggggacggatccctgactcgcttcncagtctccagctcgnggcctgagcgctaccncaacactccgtccgtcctccgagtcgtagacggtagtggacggctcgtacttaactttacgtcgtacgacggtaccggtcggggactaccgtggtctagttcgtacggttccgttaccgggaccgggtaaccgtaacgggtccacccgggttccggtccgggtaccaccgggaaccccgaacggacccctaaccccgtacgttacccggtacctaccgttacccgtccttaccccccg

SEQ ID NO: 54612 - DNA, 609 bp, Homo sapiens
  misc_feature: GYAE6OF02I3F46.29.78.H01.1.454.CMB.1.raw
  modified_base (364)..(364): a, c, t, g, unknown or other
  misc_feature (364)..(364): n is a, c, g, or t
tcagatagagtactcacgaccggtgctcgatttagtgtgagtagtttgggtttgggggtccgagccatggtgcagactccccagagctctcctcctcctccactgcacagggtctctctcccagcctgtgctgactcaatccgccctctgcctctgccctccctgggaggctcggtcaaggtcacctgtactctgagcagtggacacagcagctacgccatcgcttggcatcagcagacggccagaccgaccgggcccttcgttacatgatgacactacaaacaatggatggactagtacaacgaggacgggaaacgggggaccggtactcccgtagacgtccgtctttccgtacgacgttccnccgtagtccgtacggtcgggtcctggacgccgtacctacctacaactactcccgtcccgtacctccgagttcgtacggaggtatcggacggtcgtagtacttacgttacgtcgtaccgacggtaccggtggggacctacgtcgacgttagttccgtacgggttccgtacgggaccgggactacggtcgtaccgtggtaccgcaccgtaccgaacgccctaccgactcgtacctccgtcctacccg

SEQ ID NO: 54613 - DNA, 601 bp, Homo sapiens
  misc_feature: GYAE6OF02FSSLI.29.78.H01.1.454.CMB.1.raw
tcagatagagtactcacgaccggtgctcgatttagtgtgagtagtttgggtttggggtctgagagaggagtccacccctgggatcttcaggtgttttcatttggtgatcaggacggaacagagagaactcaccatggagtttgggctgagcgtggcttttcttgtggctattttaaaaggtgtccagtgtgacgtgcagttggtggagtctgggggcgcctgggtacggccgggggggtcgcgtgagactctcctgtgccggcctcgtggattaagttttaggagtcatgccatgaactgggtcccgccaggcctccgagggaaggggctagggaggttgggtcgtcgggctagtttaggtggcaggtggtggcgctatatattatcgcagacgccctaggaacggggtccgttcaccctagtttcccaagagactaattcgaagaacacgctgtatctgacaaagtggagacgcctagacgactcgaacgacgacggccgtactattattagtagttaaaggcaggcgtaggaagtaccggggacccgggcccgtacttggaccctacggtacggggcccgaggggaccgcgtggtaccg

SEQ ID NO: 54614 - DNA, 556 bp, Homo sapiens
  misc_feature: GYAE6OF02GOWSS.29.78.H01.1.454.CMB.1.raw
  modified_base (346)..(346): a, c, t, g, unknown or other
  misc_feature (346)..(346): n is a, c, g, or t
  modified_base (370)..(370): a, c, t, g, unknown or other
  misc_feature (370)..(370): n is a, c, g, or t
  modified_base (461)..(461): a, c, t, g, unknown or other
  misc_feature (461)..(461): n is a, c, g, or t
tcagatagagtactcacgaccggtgctcgatttagtgtgagtagtttgggtttggggtctgagagaggagtccacccctggtatcttcaggtgttttcatttggtgatcaggacggaacagagagaactcaccatggagtttgggctgagctggctttttcttgtggctattttaaaaggtgtccagtgtgacgtgcagttggtggagtctgggggcgcctggggtacggccgggggggtcgctgagactctcctgtgcggcctctggattaagtttaggagtcatgccatgaactgggtccgccaggctccagggaaggggctggagtgggtctcggctattagnggcagtggtggcgctatatattangcagacgccctgaagggccggttcaccatttccagagacaattcgaagaacacgctgtatctgacaaatggagagcctgagactcgacganacggccgtactattattgtgttaaagcgagctggaatacggggaccgggcccgacttcgaccacgtcggggaccagggggaccgcgtggtacccg

SEQ ID NO: 54615 - DNA, 805 bp, Homo sapiens
  misc_feature: GYAE6OF02ISI26.29.78.H01.1.454.CMB.1.raw
  modified_base (244)..(244): a, c, t, g, unknown or other
  misc_feature (244)..(244): n is a, c, g, or t
  modified_base (406)..(406): a, c, t, g, unknown or other
  misc_feature (406)..(406): n is a, c, g, or t
tcagatagagtactcacgaccggtgctcgatttagtgtgagtagtttgggtttggggtcgtgagagaggagtccacccgtgggatcttcaggtgttttcatttggtgatcaggacggaacagagagaactcaccatggagtttgggctgagctggactttttctgtggctaattttaaaaggtgtccagtgtgacgtgcagttggtggagtcgtggggcgccgtgggtacgggccggggggtcncttggacgtactctcctgtgccggcctacgtggtatttaaggttttggagtcatgaccatggaacgtcgggtccgccgaggcctccgagggaacgggctgggagtgggtcgtcggtctacgttaggtcggcgtaggttcggtggcgtactagtactagttangtcacgtacgacccgtaggaacgggtcccggttacctaacctacgttttaccgaacgtacgtaaacccgtaaagtttaacccggaaaacgtaaaccgtaaccggtacgttaagttaacgttaccgtaggttaaaccgtaaaaggttacggggtaaaggttaccggaaccgtttgaaacggtacccgttaacggaaaccgtaacccgtaaccgggtacccgttaacgttaacgttttaagtttacggtaaacggttaaacgggtacgtaacgggtacgttaaacgggtaaccggtaaccggggggtaaccccggggtaccggtaaaccgttaccggaacccggtacgggtaccgggaccgggtaccgggggtaaccggtccggttaccgggttaccccgg

SEQ ID NO: 54616 - DNA, 684 bp, Homo sapiens
  misc_feature: GYAE6OF02JLR47.29.78.H01.1.454.CMB.1.raw
  modified_base (161)..(161): a, c, t, g, unknown or other
  misc_feature (161)..(161): n is a, c, g, or t
  modified_base (230)..(230): a, c, t, g, unknown or other
  misc_feature (230)..(230): n is a, c, g, or t
  modified_base (257)..(257): a, c, t, g, unknown or other
  misc_feature (257)..(257): n is a, c, g, or t
  modified_base (311)..(311): a, c, t, g, unknown or other
  misc_feature (311)..(311): n is a, c, g, or t
  modified_base (361)..(361): a, c, t, g, unknown or other
  misc_feature (361)..(361): n is a, c, g, or t
  modified_base (396)..(396): a, c, t, g, unknown or other
  misc_feature (396)..(396): n is a, c, g, or t
  modified_base (468)..(468): a, c, t, g, unknown or other
  misc_feature (468)..(468): n is a, c, g, or t
tcagatagagtactcacgaccggtgctcgatttagtgtgagtagtttgggtttggggggtaaggaggaagactgacggtccacccctgggatcttcaggtgttttcatttggtgatcaggacggaacagagagaactcaccatggagtttgggctgagcgnggtcgttttctaggtggctattttaaaaggtgtccagtgtgacgtgcagttggtggagtcgtgggggcnccgtggggtaccggccggggggggtcnctaggagtctcgtcctggtggccggcctcgtggtatttaaggttttaggacgtnatcgctatgaacgtggtccgcaggctccgagggagggctggagtcggtcncggctagtgtggctaggtggtcgcgactatacgtnttatgcctaggacgcctaggacggtcccgttcgactacttccgagtagaacgtaacgttacgaaacgaaccngacgttagactcggtacaataacggtgaacgcggtacctaggataccgcgaaccgacgtaccggccgtaacttcgtttaattccggttaagtaaacggtcgtaacggtacttacgggggaacgtacccgggggacccggggtacccgtaacggtttccggaaccccgtcgggttaccggggaacggacgggggtacccgtggggtaaccctcccgg

SEQ ID NO: 54617 - DNA, 783 bp, Homo sapiens
  misc_feature: GYAE6OF02IR47J.29.78.H01.1.454.CMB.1.raw
  modified_base (241)..(241): a, c, t, g, unknown or other
  misc_feature (241)..(241): n is a, c, g, or t
  modified_base (535)..(535): a, c, t, g, unknown or other
  misc_feature (535)..(535): n is a, c, g, or t
tcagatagagtactcacgaccggtgctcgatttagtgtgagtagtttgggtttggggggagagaggagtccacccctgggatcttcaggtgttttcatttggtgatcaggacggaacagagagaactcaccatggagtttgggctgagctggctttttcttgtggctattttaaaaggtgtccagtgtgacgtgcagttggtggagtcgtgggggcgccgtgggtacgggccggggggtcnctgagactctcctgtgccggcctcgtggtattaagttttaggagtcatgaccagtgaaccgtgggtaccgccgaggcctccgaggggaacggggctagggaggttcggggtctcgggcttagttaggtcggtcaggtgggtggcgcgtaattatattatggcaacggacccgtcccgttaggaaacggggtcccggtttacaaccctacgtttcccgaaggtacgaacgtaacgttacgaaaacgaaaccgaccggacttaggtacttacgtacgaacgtaaaagttggggaanaacggtcccgtaggaaaccggtacctaccgggaaccgtaacggtacccggtaccccggttatttaagtttaaccggttttggtaacgggtttaaaagggccgtaaagggaccgttaagggaacggttaacccggggggaccccggggtcccccggttaacgttaccggaaccccgtaacgggttacgggggggacccgtaacggggggtacccgacgggtttaccgggtccccgtacccggttacccg

SEQ ID NO: 54618 - DNA, 576 bp, Homo sapiens
  misc_feature: GYAE6OF02H6TD3.29.78.H01.1.454.CMB.1.raw
  modified_base (294)..(294): a, c, t, g, unknown or other
  misc_feature (294)..(294): n is a, c, g, or t
  modified_base (407)..(407): a, c, t, g, unknown or other
  misc_feature (407)..(407): n is a, c, g, or t
  modified_base (573)..(573): a, c, t, g, unknown or other
  misc_feature (573)..(573): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgccaggctccagggaaggggctggagtggggtctcggctattagtggcagtggtggcgctatatattatgcagacggccctgaagggccggttcacccatttccagagacaattcgaagaacacgctgatctgcaaaatggagagcctganactcgacgacacggcgtctattatgtcgttaaaggcgagctaggaatacggggtaccgggcccgacgttgacccacgtggggaccaggggaccgcgtcggtcacggtctcccnacgcctccaccaagggtcccatccggtctcccctggccaccctcctccaagacgcaaccgtctggggcacgagcacgccctgggctgcctggtcaaagggacttacgtcccaagtaccttacactcttcggaacggcggcgaggtccgaaggtccgacctagtagnacg

SEQ ID NO: 54619 - DNA, 587 bp, Homo sapiens
  misc_feature: GYAE6OF02IIBP4.29.78.H01.1.454.CMB.1.raw
  modified_base (349)..(349): a, c, t, g, unknown or other
  misc_feature (349)..(349): n is a, c, g, or t
  modified_base (466)..(466): a, c, t, g, unknown or other
  misc_feature (466)..(466): n is a, c, g, or t
  modified_base (492)..(492): a, c, t, g, unknown or other
  misc_feature (492)..(492): n is a, c, g, or t
tcagatagagtactcacgaccggtgctcgatttagtgtgagtagtttgggtttggggtctgagagaggagtccacccctgggatcttcaggtgttttcatttggtgatcaggacggaacagagagaactcaccatggagtttgggctgagctggctttttcttgtggctattttaaaaggtgtccagtgtgacgtgcagttggtggagtctgggggcgcctggggtacggccgggggggtcgcgtggagactctcctgtgcggcctcgtggattaagttttaggagtcatgccatgaactgggtccgccaggctcgagggaagggctggagtgggctcggctagttagnggcaggtggtggcggctagtattattatgtcagaccgcctggaacgggtccggttcacctatttccgagagaacaattcgaaagacacgctgtatcgtgacaagtgagagcctaganacgtcgacgacgacggccgtctattntagtagtaaaggcgagtctagggaacgtccggggaccgggtcccgtacgttacggacctacgggcgggacccgaagggggaccgcgtggtacccg

SEQ ID NO: 54620 - DNA, 726 bp, Homo sapiens
  misc_feature: GYAE6OF02JY3C2.29.78.H01.1.454.CMB.1.raw
  modified_base (283)..(283): a, c, t, g, unknown or other
  misc_feature (283)..(283): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgccaggctccagggaagggctggagtgggtctcggctattagtggcagtggtggcgctatatattatgcagacgccctgaagggccgttcaccatttccagagacaattcgaagaacacgctgtatctgacaaagtgganacgcctggagactcgacgacacggccgtactattattgtagttaaaggcgtagctagggaaacgtaccggggacccgggcccgacttcggaacccgacgttcgggggacccaagggggaccgcgttcgggtaccaacccggttcctcccgtcacggtcccctaccgacccgaacgggccccaacgttcccggttacccgttccccccgtggtaccctaccccgttcccgtacccgaaacgtccgaccctaacccgttcggtaccgggggacctaccgacggacccgtaaccggccccgttacgggtcccgtacgtcccggttacgggtaccgtaaacggtaccgttaaccgtttacccgtaacgttaccgttacttacgtccggttaacggacggtccgggtaccgtacggacgtaaccgggaccgtagtaacggtcgtagcg

SEQ ID NO: 54621 - DNA, 705 bp, Homo sapiens
  misc_feature: GYAE6OF02IJGHB.29.78.H01.1.454.CMB.1.raw
  modified_base (207)..(207): a, c, t, g, unknown or other
  misc_feature (207)..(207): n is a, c, g, or t
  modified_base (246)..(246): a, c, t, g, unknown or other
  misc_feature (246)..(246): n is a, c, g, or t
  modified_base (267)..(267): a, c, t, g, unknown or other
  misc_feature (267)..(267): n is a, c, g, or t
  modified_base (280)..(280): a, c, t, g, unknown or other
  misc_feature (280)..(280): n is a, c, g, or t
  modified_base (282)..(282): a, c, t, g, unknown or other
  misc_feature (282)..(282): n is a, c, g, or t
  modified_base (307)..(307): a, c, t, g, unknown or other
  misc_feature (307)..(307): n is a, c, g, or t
  modified_base (354)..(354): a, c, t, g, unknown or other
  misc_feature (354)..(354): n is a, c, g, or t
  modified_base (367)..(367): a, c, t, g, unknown or other
  misc_feature (367)..(367): n is a, c, g, or t
  modified_base (372)..(372): a, c, t, g, unknown or other
  misc_feature (372)..(372): n is a, c, g, or t
  modified_base (450)..(450): a, c, t, g, unknown or other
  misc_feature (450)..(450): n is a, c, g, or t
  modified_base (586)..(586): a, c, t, g, unknown or other
  misc_feature (586)..(586): n is a, c, g, or t
tcagatagagtactcacgaccggtgctcgatttagtgtgagtagtttgggtttggggtctgagagaggagtccacccctgggatcttcaggtgttttcatttggtgatcaggacggaacagagagaactcaccagtggagtttgggctgagctggtcttttcttgtggcttaattttaaaggtgtccagtgtgacgtgctagttggnggtagtcgtggggcgccgtgggtacgggccggggggtcncgtgagctctctgtgcgctcngtattagtttagntnatgccagtgacgtcgggtccgacgnggcctcgaggggagggctggagtcgggtctggcttagtacgtggacnggtggtcggcgtntagtntacttagcgacgacgccgtcgtagggtacggtcccgtaccactccgttcgaagtacaaactagaacgaacgtaaaccncgtacgttagttcttcacggaaactagggttaggaacgaccgtcggtagtaacggtacctaacccggtaacaaacccggttccggtaccggtttaacttagtttttaccggttaggtttaaacggttaaaccgggnggacgttagggtaacgggtaaccggggtccccgggggtaacccggcccgttaaccggtaccgaccggtacccgggtcggggacccgggggtacggacgggttcccgtacgttaccccgg

SEQ ID NO: 54622 - DNA, 725 bp, Homo sapiens
  misc_feature: GYAE6OF02I2ETV.29.78.H01.1.454.CMB.1.raw
tcagatagagtactcacgaccggtgctcgatttagtgtgagtagtttgggtttggggtccgagccatggtgcagactccccagagctctcctcctcctccactgcacagggtctctctcccagcctgtgctgactcaatcgccctctgcctctgccctcccgtgggaggctcggtcaaggtcacctgtactctgagcagtggacacagcagctacgccatcgcttggcatcagcagaggccagacgacgggcccttcgttactgatacgacagtacaaactaagtgatcggcagtaccacgaggacggaaggggggacggtactcccgtgactcgtcttctcgacgtcctccacgtcgtacgtcggtctaggacgccgtacctacccgtacaactacgttcccgtcccggtacccttacgacgttcgtaggaacggtgtacggacggtccttaggtaactttaagttacccgtaggtaccgtaaccgggtaccgggtcggggtactaccgggttcggaacttacgggttttaacccggtacggggttttccgggttaaaccccggggtaaccccgggggtaccgtaaccggggttccctaacccggggttccgggttaccggttaacccgacccgggtaaccccggtaaccgggtacccccctaaaccccgttccgttaacccgggtacccctaccggttccccgttacccgggttacccccccg

SEQ ID NO: 54623 - DNA, 661 bp, Homo sapiens
  misc_feature: GYAE6OF02H9DQT.29.78.H01.1.454.CMB.1.raw
  modified_base (660)..(661): a, c, t, g, unknown or other
  misc_feature (660)..(661): n is a, c, g, or t
tcagatagagtactcacgaccggtgctcgatttagtgtgagtagtttgggtttgggggcgcctgggtacggccgggggggtcgctgagactctcctgtgcggcctctggatttaagttttaggagtcatgccatgaactgggtccgccaggctccgagggaagggctggagtgggtctcggctattagtggcagtggtggcgctatatattatgcagacgcccgtgaacgggccggtttcaacctattttacccgagagaactaaattacggaaagaaccacgcttagtatcgtgacaaagtggagagcctgagacgtcgacgaccacggccgtactattatgtagtaagcgagcgtaggaagtaccgggaccgggccgattcgaccgacgtcggggaccgaggggacgcgtggccgaccgttctacctcgacgccctaccgaccgaacggccgacgtccggttccccttcccccgtcggaccctacccctacccgtaccgtaacgccgtaccctccgtccggtacggggaccacgacgccgacgtcccggtggaccgtccgccgttcgaccgtaacggtaccttaaccgtccgtacgttaccttactcgtacgtcggacggtcccgggtacgtcggacggtaacggccgtacagtacgnn

SEQ ID NO: 54624 - DNA, 740 bp, Homo sapiens
  misc_feature: GYAE6OF02IRFBL.29.78.H01.1.454.CMB.1.raw
  modified_base (645)..(645): a, c, t, g, unknown or other
  misc_feature (645)..(645): n is a, c, g, or t
  modified_base (651)..(651): a, c, t, g, unknown or other
  misc_feature (651)..(651): n is a, c, g, or t
  modified_base (725)..(725): a, c, t, g, unknown or other
  misc_feature (725)..(725): n is a, c, g, or t
tcagatagagtactcacgaccggtgctcgatttagtgtgagtagtttgggtttggggtctgagagaggagtccacccctgggatcttcaggtgtttcatttggtgatcaggacggaacagagagaactcaccatggagtttgggctgagctggcttttctgtggctaattttaaaaggtgtccagtgtgacgtgcagttggtggagtcgtggggcgccgtgggtacgggccggggggtcgcgtgagactctccgtgtcgcggcctcgtggtatttaagttttaggagtcagtgccatgaacgtgggtcccgcgaggtcctaccggaaggggagggggcgtgggtaggtcggggtcgtccgggtacttagttcggtacgggcgtagggttgggtacgggctacttagttaaagtttagttaagtcggtacgtaaggtaccccgtccgtaagggaacgggtcccggttaccgaaccttacgtttacccgaaaggtaccgtaaactaacggtttaaaccgaaacgaacctaaccggtcgttacgtacttcgtacgtaacgtaaaggttcgacggacgtcgtaggtaacgtaccgttcgacggaacctaccgggtccttacgtattaggtttagtacgttaaaacgggntacggngtaacggtacggtaccggggtacccgggtacctaacgttcggaacccgttcggggtcggaccggaggggtaccnccggtgtaaccccgg

SEQ ID NO: 54625 - DNA, 760 bp, Homo sapiens
  misc_feature: GYAE6OF02H1HER.29.78.H01.1.454.CMB.1.raw
  modified_base (235)..(235): a, c, t, g, unknown or other
  misc_feature (235)..(235): n is a, c, g, or t
  modified_base (284)..(284): a, c, t, g, unknown or other
  misc_feature (284)..(284): n is a, c, g, or t
tcagatagagtactcacgaccggtgctcgatttagtgtgagtagtttgggtttggggcgcctgggtacggccggggggtcgctgagactctcctgtgcggcctctggattaagttttaggagtcatgccatgaactgggtccgccaggctccagggaaggggctggagtgggtctcgggctattagtggcagtggtggcgctatatattatgcagacgccctgaagggccggttnaccatttccagagacaattcgaagaacacgctgtatctgcaaaatgganagcctgagactcgacgacacggcccgtacatttaagttgtgttaaaagcgagcctggaaatacgggaccggggcccacttagaccaactgggggcccaaggggcactgggtacaacccgtgtaccctgacgcccttaccaccgaaacggggtcccaacgtcccgggttaccgtttaccccccccgtaggtccgtacccccgtaccctttaccccgaaacggtaacgtaccgtaaacccgtttaccggtacgggggggtccctaaccgaacgggtacccaacgggtcccccggttacggggttacccgtttacggtcccggtttacgggtttacccgaaaccggggttaacttaaaccgttttaccccgtaaccggttaaccgttaccgtttaaccgttccggtttacggaacggtaccgggggtaccgtttaccgggacccgtaaacgggacccggtacggtaacgtacggtagcg

SEQ ID NO: 54626 - DNA, 946 bp, Homo sapiens
  misc_feature: GYAE6OF02FG52F.29.78.H01.1.454.CMB.1.raw
tcagatagagtactcacgaccggtgctcgatttagtgtgagtagtttgggtttggggtcgtgagagaggagtccacccctgggatcttcaggtgttttcatttggtgatcaggacggaacagagagaactcaccatggagtttgggctgagctggcttttctgtggctatttaaaggtgtccagtgtgacgtgcagttggtggagtctgggggcgcctgggtaccggccgggggggttcaccgttgacgactcctccgtgtcgcgggcctcgtggtactttaaggttttacggagttcgaattcggacctagtcggtaaacctcgggggttaccccgcccgaaggggcccttacccgaacgggggaaacggggggtcctagggtaacggttcgggggttaccctcggggtacctttaaacggtttacgtacggggtaccgtaacgggttcggggttacggggtccgggtaccgtttaaacttaacgtttaagtttacgtttaacgggaccgtaacgggtaaccccggtacccccgttacgggggtaaaaaccggggggtcccccggggtttttaacccaaacccccggttaacctttttaccccgaacgggtaaccggtaaacccgtaaaacggtttaccgggtaaaaacccgaaaacccggtaccggtacccgttaacgggtttaaactttacccgttaacgggaaacccgttaaaacgttacggggaaacgtaaccggtaccccgtaagggtaaaccggtacccgtaaccgggtaaacccggaacccggtaacccggggtacccgtttaacggttaacttttacggtagtttaaacggttaaacgggccgaacgtacgtacgggaacgtaaccgggggacccgggacccgtaacgtcgaacccgacggtacggggtccgaggggtaccgtaccgtgggtacccc

SEQ ID NO: 54627 - DNA, 573 bp, Homo sapiens
  misc_feature: GYAE6OF02GLJLH.29.78.H01.1.454.CMB.1.raw
  modified_base (570)..(571): a, c, t, g, unknown or other
  misc_feature (570)..(571): n is a, c, g, or t
  modified_base (573)..(573): a, c, t, g, unknown or other
  misc_feature (573)..(573): n is a, c, g, or t
tcagatagagtactcacgaccggtgctcgatttagtgtgagtagtttgggtttggtggtctctctcccagcctgtgctgactcaatcgccctctgcctctgcctccctgggaggctcggtcaaggtcacctgtactctgagcagtggacacagcagctacgccatcgcttggcatcagcagaggccagacacgggccctcgttacttgatgacagtcaacaatgatggcagtcacagcgaaggggggacggatcccgtgatcgcttctcagtctccagctcgtggccctgacgccgctacctcaacatcctccggcctcagttctggaggatggacggctagaacttattactgtacgagtaccgtggggactacgtggctaacgtttcgacgggttccgttccggggaacccggggacctaacgggtccgaaccggttcggtccggtacaccggacccaacggcccaaaccccgtgtcgcctaccttcgtccgttcccacccgtcctacacgttcctctactcgtacggacgtcgggacgttcggaccgtacgggcaacctagtacggnngn

SEQ ID NO: 54628 - DNA, 610 bp, Homo sapiens
  misc_feature: GYAE6OF02JHT8G.29.78.H01.1.454.CMB.1.raw
  modified_base (312)..(312): a, c, t, g, unknown or other
  misc_feature (312)..(312): n is a, c, g, or t
  modified_base (602)..(602): a, c, t, g, unknown or other
  misc_feature (602)..(602): n is a, c, g, or t
  modified_base (606)..(606): a, c, t, g, unknown or other
  misc_feature (606)..(606): n is a, c, g, or t
tcagatagagtactcacgaccggtgctcgatttagtgtgagtagtttgggtttggtggtctctctcccagcctgtgctgactcaatcgccctctgcctctgccctccccgggaggctcggtcaaggtcacctgtactctgagcagtggacacagcagctacgccatcgcttggcatcagcagaggccagacacgggccctcgttacttgatgacagtacaacaatgatggcagtcacgagcgaagggggacggatccctgactcgcgtctcagtctccgagctcgtcggcctgagcgcctacctcacatccnccggcctccagtctgagagtgagctagacttattacgtgtacgacggtaccggtcggggactacgtggctacttcgacgggttccgttaccgggacccggggtaccgtaacgggtcccgtaccggttccggtccggttcgaccgaccccgaacggacccccaaccccgtacgttcgtacctaccttccggttaccttacccccacccgttccctactaaccgttcctacttaccgtcctgggtaccggccgggtaccgtcgggaccgaacgggccgtacgacgttacggntacngtac

SEQ ID NO: 54629 - DNA, 592 bp, Homo sapiens
  misc_feature: GYAE6OF02JJJYQ.29.78.H01.1.454.CMB.1.raw
  modified_base (474)..(474): a, c, t, g, unknown or other
  misc_feature (474)..(474): n is a, c, g, or t
  modified_base (476)..(476): a, c, t, g, unknown or other
  misc_feature (476)..(476): n is a, c, g, or t
  modified_base (482)..(482): a, c, t, g, unknown or other
  misc_feature (482)..(482): n is a, c, g, or t
  modified_base (584)..(584): a, c, t, g, unknown or other
  misc_feature (584)..(584): n is a, c, g, or t
  modified_base (590)..(590): a, c, t, g, unknown or other
  misc_feature (590)..(590): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccgaggggaaggggctggagtgggtctcggctattagtggcagtggtggcgctatatattatgcagacgccctaggaacgggccgttcacctatttccagagacatcgaaagacacgctgtactctgacaaagtggagacgcctagaacgactcgacgacacggcctctattattgtagttaaaggcgagcgtaggaacggtaccgggacccggggaccgtacgttcgaccgacggtcggggacgtacgggaccgtcgtaggcctaccgtctcctacgacgcctccgaaccgacggccacgtcgtccctcccgtgccctccncncacgcnccaccgtcgcggacacgcgcgacgcgtacggctcgtccgacgtcgaacgacctcgtacgattcctgtacgtcgtagacggcggtcgtaggcgtacgccgtangtacgngc

SEQ ID NO: 54630 - DNA, 757 bp, Homo sapiens
  misc_feature: GYAE6OF02H51EC.29.78.H01.1.454.CMB.1.raw
  modified_base (310)..(310): a, c, t, g, unknown or other
  misc_feature (310)..(310): n is a, c, g, or t
tcagatagagtactcacgaccggtgctcgatttagtgtgagtagtttgggtttggggcgcctgggtacggccggggggtcgcgtgagactctcctgtgcggcctctggattaagttttaggagtcatgccatgaactgggtccgccaggctccagggaagggctggagtgggtctcggctatagtggcagtggtggcgctagtatattatgcagacgccctgaagggccggttcaccatttccagagacaattcgaagaacagctgtatctgcaaatggaagagcctgagaactcgagacaacggccgtntattatgtagttaaaggcgaagtacgtgggaaacgttacgggggacccgggacccgtaaacttcggaacccgtaaccgttcgggggggaccctaaggggggaaccgtcgttggaccgacccgtcgtaccctcgacgtcccctacgaacccgaacgggacccaacgttccggtacccgttttcccccgcggtacccgaaccccgttaccctacccgtaacggacgaccccgtacccgtttaccggcgggggtaccaaccgtacggccgttaacggccccgtttacggggcccttaccgggccgtacgggttacgaaaccgggtaccgtttaacccttaccggtaaccgttaccgttaaccgtttaccgtaccgtacgggtacggtaccccggggttactacggggttaaccgaaacgggtccccgtaaccgtacgttaccgggatacg

SEQ ID NO: 54631 - DNA, 630 bp, Homo sapiens
  misc_feature: GYAE6OF02GM9P9.29.78.H01.1.454.CMB.1.raw
  modified_base (281)..(281): a, c, t, g, unknown or other
  misc_feature (281)..(281): n is a, c, g, or t
  modified_base (283)..(283): a, c, t, g, unknown or other
  misc_feature (283)..(283): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtaggcagtggtggcgctatatattatgcagacgccctgaaggcggttcaccatttccagagacaattcgaagaacacgctgatctgcaaatgananctgagactcgacgacacggccgtctattatgtgttaaaggcgagcgtggaaactacgggaccgggcccgattcgaccaacgtcgggccaaggggcgtcgtggtcaaccggtctccgtcagccctccgaacgaacgggcccacgtccggtccttcccctcggacccaccctacccgtaccaacgacgacctaccgtcgtcgggggtaccactacggacacgacccgtgggacctcggcccgttcggtaccaaacgggtaccttaaccgttccgaacgttaccgtacgttactcgttacggacggccgggtacgtgggaccgtaacgggaccgactaaggtacgcgacg

SEQ ID NO: 54632 - DNA, 707 bp, Homo sapiens
  misc_feature: GYAE6OF02JPSJ5.29.78.H01.1.454.CMB.1.raw
  modified_base (400)..(400): a, c, t, g, unknown or other
  misc_feature (400)..(400): n is a, c, g, or t
tcagatagagtactcacgaccggtgctcgatttagtgtgagtagtttgggtttgggggtccgagccatggtgcagactccccagagctctcctcctcctccactgcacagggtctctctcccagcctgtgctgactcaatcgccctctgcctctcgcctcccgtgggagctcggtcaaggtccacctgtactctgagcagtggacacagcagctacgcactcgcttggcatcagcagacgccagaccgacgggtccctagttactgatcgacagtacaacaatgagtggcagtcacgaggcggaaacgggggacgggtactccgagacgtccgtccgttacacgtagtcctcggagccggtttcgtacgggacccgttggacgtcccgtacctttaaccncctaaacgtaaccgtttcccgtcccgtaccccgttcccgtagtttaccggtacgaacgggtaacgttcggaacggtccttacggttaaacttaccgtttaacgttcgtaccgggtaccggttaccggtaccgggggtaccttaccggttacgggtacccttgggttacccgttacggggttacccggtcccggggaaaccgggaccgttaacggtcccgttacgggtccgggtaccggtacgaccgaacccgtaacggcccctaaccccggtatcccgtaccgtaccgttccgttaccgtcccccgg

SEQ ID NO: 54633 - DNA, 621 bp, Homo sapiens
  misc_feature: GYAE6OF02FMSTE.29.78.H01.1.454.CMB.1.raw
  modified_base (620)..(620): a, c, t, g, unknown or other
  misc_feature (620)..(620): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtagttaaaggcgagctggaactacggggaccggggcccgattcgaccacgtcggggccgagggggcgcgtcggtccaccgtctcctcacgccctccaccgaacgggcccacgtccggttcccttcccccgtcggccctacccctccctacccaacgacgccaccctccggtcggggccacgacgccacgcccgtgggccgtcgccgtcggtacgaacggaccttaccgttacctacgttacctcttacttccgtcggacgggccgggtccgtacgggacgtaacgggccgacgacgtacgnc

SEQ ID NO: 54634 - DNA, 682 bp, Homo sapiens
  misc_feature: GYAE6OF02I1X9D.29.78.H01.1.454.CMB.1.raw
  modified_base (216)..(216): a, c, t, g, unknown or other
  misc_feature (216)..(216): n is a, c, g, or t
  modified_base (240)..(240): a, c, t, g, unknown or other
  misc_feature (240)..(240): n is a, c, g, or t
  modified_base (302)..(302): a, c, t, g, unknown or other
  misc_feature (302)..(302): n is a, c, g, or t
  modified_base (325)..(325): a, c, t, g, unknown or other
  misc_feature (325)..(325): n is a, c, g, or t
  modified_base (334)..(334): a, c, t, g, unknown or other
  misc_feature (334)..(334): n is a, c, g, or t
  modified_base (360)..(360): a, c, t, g, unknown or other
  misc_feature (360)..(360): n is a, c, g, or t
  modified_base (365)..(365): a, c, t, g, unknown or other
  misc_feature (365)..(365): n is a, c, g, or t
  modified_base (374)..(374): a, c, t, g, unknown or other
  misc_feature (374)..(374): n is a, c, g, or t
tcagatagagtactcacgaccggtgctcgatttagtgtgagtagtttgggtttggggtctgagagaggagtccacccctgggatcttcaggtgttttcatttggtgatcaggacggaacagagagaactcaccatggagtttgggctgagctggctttttctgtggctattttaaaggtgtcagtgtgacgtgcagttggtggagtcgtgggggcnccgtggggtacggccggggggtcnctgagactctcctgtcgcggcctcgtggattaagttaggatcatgccatgaacgtcggtccncaggctcgaggggagggcgtggnggtgggtcncggtctagttacggtggcgtgtgggngcgtntatatattngacagccgctggaacgggtccgttacaacctagtttccgaagacgaactaagtacgaaagtaaccacgtactaggttactccgttagacgtaaagtagggaaggtacgtccgttaaggacgtaaccggtacgaaccggtaccgacggtccgttacgttaagtttacgtttaggttaacggttaaacggcgtaaggtaccgttaagggaaccggtaaccggggaacccggggtacccgtaacgttaccggaaccgtacgggtaccgggtaccgggggggaacggtaccgggtccggtacgggtaccccg

SEQ ID NO: 54635 - DNA, 736 bp, Homo sapiens
  misc_feature: GYAE6OF02JD2TK.29.78.H01.1.454.CMB.1.raw
  modified_base (212)..(212): a, c, t, g, unknown or other
  misc_feature (212)..(212): n is a, c, g, or t
  modified_base (235)..(235): a, c, t, g, unknown or other
  misc_feature (235)..(235): n is a, c, g, or t
  modified_base (262)..(262): a, c, t, g, unknown or other
  misc_feature (262)..(262): n is a, c, g, or t
tcagatagagtactcacgaccggtgctcgatttagtgtgagtagtttgggtttggggtctgagagaggagtccacccctgggatcttcaggtgttttcatttggtgatcaggacggaacagagagaactcaccatggagtttgggctgagcgtgcttttctgtggctatttaaaggtgtcagtgtgacgtgcagttggtggagtctggggcnccgtgggtacggccgggggggtncgtgagcgtctccgtggtgcggccctntaggtattaaggttttagagtcatggccatgaacgtggtccgcgaggctcgacgggagggcgtggagtgggtctcggacgtagttagtgcgtaggtggtggtcgatagattatgtagtcgagcgcccgtagaacgggtccggttacacccgtagtttcccgaagtagacctaaagtttaccggaaagaaaccgacgagtacggtaatcgtacgaactaacggttaaggacgtacggaccgttggaaacgtcgtaaccggtaggtaaccccgtacgggacccgttacgttaactttacgtttacgggttaaacggttaaaacggggtcgtaaccgttcgggtaacggggtaaacggttaaccccgggggaaaccccgggggttcccgtaaaccgttcgggtaacccgttaaccgggtccggggggttaacccggaccggggggtaaccgttaccccgggtcgggttaacccccgg

SEQ ID NO: 54636 - DNA, 872 bp, Homo sapiens
  misc_feature: GYAE6OF02G1608.29.78.H01.1.454.CMB.1.raw
  modified_base (144)..(144): a, c, t, g, unknown or other
  misc_feature (144)..(144): n is a, c, g, or t
  modified_base (219)..(219): a, c, t, g, unknown or other
  misc_feature (219)..(219): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccnccaggctccgagggaaggggctggagtgggtctcggctattagtggcagtggtggcgctatatattatgcagacnccctgaacgggccgttcacctatttccagagacaattcgaagaacacgactagtatccttagaccaaaagttggaagtacgaccgttagaacgtacctaccgacgaaccgtaccgggtaccgtaccgttaactttagtttacggttagttaaaacgggccgtaacggtacgttaagggaaaccggttaccgggggaaccccgggggtaccccgtacgttacgggaccctaaacggtccggggtaccgaacggggggtaacctccggttacgggttccggtaaaccccgttccgttaacccgtacgtaaccgtcccccgttaacccgtaaacccggaacccgggtcccgaaccggtttaacccgggttccccctttaccccccgtacgggtacccctaccccgttacccgtacccgaaacggtcccgtaacccgtacccggttaccggttacgggggaccctaaccgtacggtacccgaccggttccccggtacgggtcccgtacggtacccggttacgggtaaccccgtaaacggaccccgttttaaaccgttacccgttaaacggttacctttaccggtaacttccggttaaccgtcgggtaaacccggtcgttaacggaccgttaacggccggtacaaccgttagacctgg

SEQ ID NO: 54637 - DNA, 653 bp, Homo sapiens
  misc_feature: GYAE6OF02FICCL.29.78.H01.1.454.CMB.1.raw
  modified_base (622)..(622): a, c, t, g, unknown or other
  misc_feature (622)..(622): n is a, c, g, or t
  modified_base (651)..(651): a, c, t, g, unknown or other
  misc_feature (651)..(651): n is a, c, g, or t
tcagatagagtactcacgaccggtgctcgatttagtgtgagtagtttgggtttgggggcgcctgggtacggccgggggggtcgctgagactctcctgtgcggcctctggattaagtttaggagtcatgccatgaactgggtccgccaggctccgagggaaggggctggaggtgggtctcggctagttagtggcagtggtggcgctatatattatgcagacgccctggagggccggttcaccatttccagagacaattcgaagaacacgctgtatctgacaaagtggagagcctgagacctacgacgacgaccggccgtactagttattgtagttaaaggcgagcgtagggaagtaccggggacccggggaccccgtacgttcgaccgacggtcggggccgagggggacgtcgtcggtccaccggtcctccctcgacgccctacccgaaccgacggacccgacgtccggtcccgttcccccgtccgtccctacccctccctaccgaacgacgccgtacccgtccggtacgggccgacgacgccgacgccgtcggcgtcgccgtcgtacgaacgtacgttaccttccgtacgtactactacttcgtgacccccccccccccggnggtccgtcggacgacggcgacgacgtagngc

SEQ ID NO: 54638 - DNA, 674 bp, Homo sapiens
  misc_feature: GYAE6OF02GENFZ.29.78.H01.1.454.CMB.1.raw
  modified_base (319)..(319): a, c, t, g, unknown or other
  misc_feature (319)..(319): n is a, c, g, or t
  modified_base (406)..(406): a, c, t, g, unknown or other
  misc_feature (406)..(406): n is a, c, g, or t
  modified_base (670)..(670): a, c, t, g, unknown or other
  misc_feature (670)..(670): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgcctggaagggccgttcacctatttccagagacaattcgaaagaacacgctgtatctgacaaagtggagagcctgagactcgacacgacggccgtctattnttgtagttaaaggcgagctagggaacgtaccggggacccggggcccgtacgttcgaacccgtacgtcggggggcctaagggggaccncgtcgggtccaccggtctccctcacgtccctcccgaaccgaacggcccaacgtcccggtcccttcccccgtcggccctacccctccctacccgaacgacgtaccgtaccgtccggttcgggggacctaacgacggtccaacggtccccggtgggtccgtcggtcccgtcggttaccgaaacggtaccttaccttaccgaacgttacctcgttacgtcgtacggacggtccgggcgttcgggaccgacgggccgacgtacgtacngtcg

SEQ ID NO: 54639 - DNA, 632 bp, Homo sapiens
  misc_feature: GYAE6OF02G7C3J.29.78.H01.1.454.CMB.1.raw
  modified_base (430)..(430): a, c, t, g, unknown or other
  misc_feature (430)..(430): n is a, c, g, or t
  modified_base (630)..(630): a, c, t, g, unknown or other
  misc_feature (630)..(630): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccgaggggaaggggctggaggtgggtctcggctattagtggcagtgggtggcgctatatattatgcagacgccctggaacgggccggttcacctatttccagagacaattcgaagaacacgctgtatctgacaaatggagacgcctgagactcgacgacgacggccgtctattagttgtaggttaaaggcgaagcgtagggaaacgtaccggggaccggggcccctacgttcgaccgtacgtcggggaccgagggggcgtcgtggtacaccgtctccnacgccctccaaccgacggccacgtccgtccttccccgtcggccctaccctcctccaacgacgccacccgtcggtcgggcacgcgccacgcccgtacggtccgtcgccgtcggtaccgaacggtacctaccgttccgaacgttacctcttacgcgttcggacgggtccggtcgtacgggacgaccgggccgacgagtacgncg

SEQ ID NO: 54640 - DNA, 697 bp, Homo sapiens
  misc_feature: GYAE6OF02ICVOD.29.78.H01.1.454.CMB.1.raw
  modified_base (245)..(245): a, c, t, g, unknown or other
  misc_feature (245)..(245): n is a, c, g, or t
  modified_base (383)..(383): a, c, t, g, unknown or other
  misc_feature (383)..(383): n is a, c, g, or t
  modified_base (401)..(401): a, c, t, g, unknown or other
  misc_feature (401)..(401): n is a, c, g, or t
  modified_base (425)..(425): a, c, t, g, unknown or other
  misc_feature (425)..(425): n is a, c, g, or t
  modified_base (589)..(589): a, c, t, g, unknown or other
  misc_feature (589)..(589): n is a, c, g, or t
tcagatagagtactcacgaccggtgctcgatttagtgtgagtagtttgggtttggggggtaggagaggagtccacccctgggatcttcaggtgttttcatttggtgatcaggacggaacagagagaactcaccatggagtttgggctgagcgtggtctttttctgtggcttaagttttaaaaggtgtccagtgtgacgtgcagttggtggagtcgtgggggcccgtgggtacggccgggggggtncgtgaagctctccgtgcggcggcctcgtggactttaaaggttttaggagtctattcggccagtgaacgtcggggtccgcccgaaggcctccgaaggggaacgggggcgtggaggtcgggtcgtcggtctagtttaggngtcgagtggttggccggntaagtatagtactgcagacgcccnggaacgggccggttacacacttttccgagtacgaacaagttcgaagaaacacggctaggtatcgtacgtacgaaaagttacggaagaggaccttggaccgacgttacggaaccgaacgaccgggtaccctacgtttaccgttaatttgtaaggtttaaaccggngtaaccgtgtaacggtagtaaccgggtacccggggaaccctacggttccggaacctaccggtacggggccggtaacggggccgaacggtttcggaccctccgttaccg

SEQ ID NO: 54641 - DNA, 620 bp, Homo sapiens
  misc_feature: GYAE6OF02F80RF.29.78.H01.1.454.CMB.1.raw
  modified_base (444)..(444): a, c, t, g, unknown or other
  misc_feature (444)..(444): n is a, c, g, or t
  modified_base (618)..(618): a, c, t, g, unknown or other
  misc_feature (618)..(618): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtagttaaaggcgagctggaatacggggaccgggcccgacttgaccacgtggggccgaggggacgcgtggtcaccgtctcctcacgccctccaccgaacgggcccagtccgtccttccccgtcgcnccctccgtccaacgacgcaccgtccgtggggtccacgagccgacgcccgtacgggtccgtcgcccgttacggtaccgtaaacggtaaccgttacctttacccgacgttacctccttacttccgtggacggtccgggccgtacgggaccgaacgggtaccggacgtacgtaggcncg

SEQ ID NO: 54642 - DNA, 637 bp, Homo sapiens
  misc_feature: GYAE6OF02IBUH3.29.78.H01.1.454.CMB.1.raw
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtcttattattgtagttaaaggcgagcgtaggaagtaccggggacccggggcccgtaacgttcgaaccgaacgtcgggggaccgaacgggggcgctgggtccaccggttctccctcgacgccctccgacccgaacgggcccacgtccggtcccttcccccgtcggacctacccctcctacccaacggacgaccaccctccgtcgggggccacgacgccgacgcccgtcgggcctcgccgtcggtacgaacgtactaccttaccgacgttactcctagtcgtacgacggtccgggtcgtcgggaccgaacgggccgacgtagtacgctag

SEQ ID NO: 54643 - DNA, 836 bp, Homo sapiens
  misc_feature: GYAE6OF02JJTMB.29.78.H01.1.454.CMB.1.raw
  modified_base (214)..(214): a, c, t, g, unknown or other
  misc_feature (214)..(214): n is a, c, g, or t
  modified_base (833)..(833): a, c, t, g, unknown or other
  misc_feature (833)..(833): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctaccgaggggaaggggctggagtgggtctcggctattgtggcagtggtggcgctatatattangcagaccgccctggaacgggtccgttacacctatttccgaagagaacctaagttacgaaagaaccacgctagtactcgtagacgaaagtgggaagacgtccgttaggacgtaccgtaccggaacgaccgtaccgggtacccgttacttaagtttacgtttaggttaacggttaaaacgggccgtaacggtccgggttaagggtaaaaccggttacccgggggggaaccccgggggttaccccgtaacggttttaccggaacccggtaaccgggtaccgggggggacccggtaaggggggtaccgtaccggttcgggtacccgtaacccggtcccttcccgtacgaccgtaccccgtacccgaaccggtaaccggggaccctacggtcccgggtttacccctcccccggtacggtacccctacccgtcccgtaaccgtaaacgtaccgacccgtaacccgttccgggtaccggggaccaaccgtaccgtaccggaccgacccggttcgggtacccgtccgtcccggtacggtaccgtaaccggtaccgttaccgtacttaccgtacttacgtacgtcgtaggaccggcggtacgcggacgacggtacgcgtaacgtcgtnacg

SEQ ID NO: 54644 - DNA, 657 bp, Homo sapiens
  misc_feature: GYAE6OF02GKLE5.29.78.H01.1.454.CMB.1.raw
  modified_base (298)..(298): a, c, t, g, unknown or other
  misc_feature (298)..(298): n is a, c, g, or t
  modified_base (352)..(352): a, c, t, g, unknown or other
  misc_feature (352)..(352): n is a, c, g, or t
  modified_base (612)..(612): a, c, t, g, unknown or other
  misc_feature (612)..(612): n is a, c, g, or t
tcagatagagtactcacgaccggtgctcgatttagtgtgagtagtttgggtttggtgggtctctctcccagcctgtgctgactcaatcgccctctgcctctgcctccctgggagctcggtcaaggtcacctgtactctgagcaggtggacacagcagctacgccatcgcttggcatcagcagacggccagacacgggccctgttacttgatgacagtcaaacaatgatggacagtcacaggcgaagggggcgactcccttggaacttccggacttctcgacgttcctccagccttcgngggacctggacgcgtcctacctcgaactagtcctccggacctcgaacgttccgnggtacgtatcgggagtcttaggacctttagttcctggtaccacggtaccgtggggacctacgtggtcctaacgttcggtacgggtttcgggaccgggtaacgtaggtcccgtaccggttacggtacggttccgacggaccccgtaacggccccgtaaacccgtcgttaccgaccttaccggttaccttaccgggttccccgacccgtttaccctacggtaccgttacctacttaccgtcgtacgtcgggtaacccgggtntaccgggaccaacgggttaccgacgtaagttaccggctctgtacg

SEQ ID NO: 54645 - DNA, 729 bp, Homo sapiens
  misc_feature: GYAE6OF02IQBM2.29.78.H01.1.454.CMB.1.raw
tcagatagagtactcacgaccggtgctcgatttagtgtgagtagtttgggtttgggggcgcctgggtacggccgggggggtcggcgtgagactctcctgtgcggcctctggattaagttttaggtagtcatgccatgaactgggtccgccaggctccagggaaggggctggagtgggtctcggctattagtggcagtggtggcgctatatattatgcagacgccctgaagggccggttcactatttccagagacaattcgaagaacacgctgtatctgcaaatgagagctagagactcgacgacgacggccgtactattattgtagttaaacggcgagtacgtagggaaacgtaccgggggacccgggggaccccgtaacgttaccgggaccctaccggtcgggggacccggaagggggaaccggccgtagggtccctaacccggtcctaccctccgaccgtccctacccgaacccgtaacgggccccacgtcccggtccctttaccccccgtacgtaccctacccctcctacccagtcgaccgtcctaccgtccggttaccgggggacctaccgacgtccgaccgggtaccccgtcggggtaccgtcggtaccccgttcgggtaccgtaaacgggtaccctttaacgttacccgtacggtttaccttaccgttactaccgtcgtacgggtccgggtacgtcggaccggacggtaccgactagtacgtc

SEQ ID NO: 54646 - DNA, 594 bp, Homo sapiens
  misc_feature: GYAE6OF02H6KN8.29.78.H01.1.454.CMB.1.raw
  modified_base (475)..(475): a, c, t, g, unknown or other
  misc_feature (475)..(475): n is a, c, g, or t
  modified_base (590)..(590): a, c, t, g, unknown or other
  misc_feature (590)..(590): n is a, c, g, or t
tcagatagagtactcacgaccggtgctcgatttagtgtgagtagtttgggtttggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgcccctgaagggccggttcaccatttccagagacaattcgaagaacacgctgtatctgacaaagtggagagcctgagactcgacgacacggccgtctattacttgtagttaaagcgagctggaagtacgggaccgggcccgacgttcgaccacgtggggaccgaggggacgcgtcggtccgaccgtctcctcacgccctacacccgaacggccctacgtccggtcccttccccgtcggcctaccctccctaccagacnccaccgtcgtcgggcacagccacgcccgtggcctcgccgtgtacaacggtctacgtaccagtacctctacgtcgtagacggccgggtcgtcggacgaacggccgcgtaactaggntacg

SEQ ID NO: 54647 - DNA, 622 bp, Homo sapiens
  misc_feature: GYAE6OF02IIIGK.29.78.H01.1.454.CMB.1.raw
  modified_base (462)..(462): a, c, t, g, unknown or other
  misc_feature (462)..(462): n is a, c, g, or t
  modified_base (490)..(490): a, c, t, g, unknown or other
  misc_feature (490)..(490): n is a, c, g, or t
  modified_base (619)..(619): a, c, t, g, unknown or other
  misc_feature (619)..(619): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccgttacaccatttccagagacaattcgaagaacacgctgtatctgcaaatggagagcctgagactcgacgaccacggcctctattattgtagttaaaggcgagctggaagtacgggacccggggacccacgttgaccacgtggggaccgaggggaccgcgtcggtcaccgtctctacgagcctccaccgaacgggcccatccggttccttaccccgtcggcctaccctcccnccaagacgccaaccgtcgtcggggaccncgacgcgtacgaccccgtgggcctggtccgtcgggtaccgaacgggtacctaccgtttaccgacgttaccgtcttacgttacgtcggacggtccgggtactcgggaccgaacgggccgacgtagtacgntcg

SEQ ID NO: 54648 - DNA, 633 bp, Homo sapiens
  misc_feature: GYAE6OF02HIZL2.29.78.H01.1.454.CMB.1.raw
  modified_base (631)..(631): a, c, t, g, unknown or other
  misc_feature (631)..(631): n is a, c, g, or t
tcagatagagtactcacgaccggtgctcgatttagtgtgagtagtttgggtttgggggcgcctgggtacggccgggggggtcgctgagactctcctgtgcggcctctggatttaagttttaggagtcatgccatgaactgggtccgccaggctccagggaaggggctggagtgggtctcggctattagtggcagtggtggcgctatatattatgcagacgccctggaagggccgttcaccatttccagagacaattcgaagaacacgctgtatctgcaaatggagagcctgagactcgacgacacggccgtctattattgtagttaaaggcgagctaggaatacggggacccggggacccgacgttgacccacgtcgggggaccacggggacgcgtcggtcaccgttcctcctaccgacgccctacccaaccgaacggggcccctaacgtccgggttccctttacccccgtgggcccctaccccttccctcccgtaaacgcgacctaacccgtcggtcggggacacgacggccacgtccccgtagggcctcgccgtcgtcgaacggtactaccttacagtaccgttctacgtcgtgcggtcggcgtcggacaacgggtccgacgtacgtgncg

SEQ ID NO: 54649 - DNA, 822 bp, Homo sapiens
  misc_feature: GYAE6OF02GBJM2.29.78.H01.1.454.CMB.1.raw
  modified_base (317)..(317): a, c, t, g, unknown or other
  misc_feature (317)..(317): n is a, c, g, or t
  modified_base (389)..(389): a, c, t, g, unknown or other
  misc_feature (389)..(389): n is a, c, g, or t
tcagatagagtactcacgaccggtgctcgatttagtgtgagtagtttgggtttggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccgttcaccatttccagagacaattcgaagacacgctagtatctgcaaatggagagcctgagactcgacgacacggccgtctattattgngttaaaggcgagcgtggaaatacggggaccgggccccgacgttgacccacgtgggggaccctagggggaccncgtaggtccaaccgtcgttaccctccgacggtccccttacccgaacccgtaaacggggccccctaacgtcccgggttaccccgttttaccccccccgtacggggtacccctaaaccccccgttccccgttaccccgaaaaccgggtaccggacccgtaaacccccgtttcccggttaccggggggggtaccctaacccggaaccggtacccgaaccgggtaccccccggttggggtaccccgttcgggtccccggttcggggttaacccgtaaaccgggttaaccccgtttaaacccgtttaccccgtaaccgggttttacccttaccgtttaaccgtttacccgttacgggttaccgggtacccggggttacccggttcgggtaacccggttaacggggacccggtaccgtaaccggttaagggccctaacg

SEQ ID NO: 54650 - DNA, 547 bp, Homo sapiens
  misc_feature: GYAE6OF02GQYGW.29.78.H01.1.454.CMB.1.raw
  modified_base (344)..(344): a, c, t, g, unknown or other
  misc_feature (344)..(344): n is a, c, g, or t
  modified_base (346)..(346): a, c, t, g, unknown or other
  misc_feature (346)..(346): n is a, c, g, or t
  modified_base (362)..(362): a, c, t, g, unknown or other
  misc_feature (362)..(362): n is a, c, g, or t
  modified_base (395)..(395): a, c, t, g, unknown or other
  misc_feature (395)..(395): n is a, c, g, or t
  modified_base (419)..(419): a, c, t, g, unknown or other
  misc_feature (419)..(419): n is a, c, g, or t
  modified_base (431)..(431): a, c, t, g, unknown or other
  misc_feature (431)..(431): n is a, c, g, or t
tcagatagagtactcacgaccggtgctcgatttagtgtgagtagtttgggtttggggtccgagccatggtgcagactccccagagctctcctcctcctccactgcacagggtctctctcccagcctgtgctgactcaatcgccctctgcctctgcctcccgtggggaggctcggtcaaggtcacctgtactctgagcagtggacacagcagctacgccatcgcttggcatcagcagacgccagaccaccgggcccttcgttacttgatgacagtacaaacaatggaagtggacagtcacgaggacggaagggggacggactccgtgactcgcttctcacgtccncngctcgtcggcctgacnccgctacctcactactcctccggctcgagtcgngagatggagtctagacttattcgngacacggtcggnggctagtgactagttcgagggttccgtacggggaaccggtacaggtcctaccggtcgtacggaccacggacccaacggacccaacctgttccgaccttccgtccgtcccgtccccg

SEQ ID NO: 54651 - DNA, 695 bp, Homo sapiens
  misc_feature: GYAE6OF02JJPDY.29.78.H01.1.454.CMB.1.raw
  modified_base (395)..(395): a, c, t, g, unknown or other
  misc_feature (395)..(395): n is a, c, g, or t
tcagatagagtactcacgaccggtgctcgatttagtgtgagtagtttgggtttgggggtcgcctgggtacggccgggggggtcggctgagactctcctgtgcggcctctggattaagtttaggagtcatgccatgaactgggtccgccaggctccagggaaggggctggagtgggtctcggctattagtggcagtggtggcgctatatattatgcagacgccctgaagggccgttcaccatttccagagacaattcgaagacacgctgtatctgcaaatggagagcctgacgactcgacgacacggccgtactattacttgtagttaaaggcgaagtctaggaacgtacggggacccgggtcccacgttgacccacgtggggaccgaggggaccncgtcggccaccggtctccgtacagtccccgtaccaacccgtaacgggccctacgtccgggtaccttccccccgtacggccctaaccccgtccctacccgaacgaccgccgaacccgttccggtacggggtaccaaccgtaccggaccgaacgtccccggtcgggaccgtcggtcccgttcgggtaccgaaacgggtacccttaccgttaccgtaacgttaccgttaccgttacgtccgtaggtaccgggtccgggtaccgttacgggacccgtaacgggccgtacgtaacgtacggcacg

SEQ ID NO: 54652 - DNA, 615 bp, Homo sapiens
  misc_feature: GYAE6OF02HFG5C.29.78.H01.1.454.CMB.1.raw
  modified_base (469)..(469): a, c, t, g, unknown or other
  misc_feature (469)..(469): n is a, c, g, or t
  modified_base (613)..(613): a, c, t, g, unknown or other
  misc_feature (613)..(613): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgacaaatggagagcctgagactcgacgacgacggccgtactattattgtagttaaaggcgagcgtaggaacgtacggggacccggggacccgtacgttacgaccacgtcggggaccgagggggacgcgtggtccaccgtctcctcacgccctccaccgaacgggcccacgtccggtccttcccccgtcggacccnccctccaccacgacgcctaccgtccggtcggggccacgacgcacgcccgtcggccgtcgccgtcggtacgaacggtacctacttccacgtacctacgtactcgtacgacggccggtacgcggacgacgggccgacgtacgtagncg

SEQ ID NO: 54653 - DNA, 638 bp, Homo sapiens
  misc_feature: GYAE6OF02JLONZ.29.78.H01.1.454.CMB.1.raw
  modified_base (402)..(402): a, c, t, g, unknown or other
  misc_feature (402)..(402): n is a, c, g, or t
  modified_base (419)..(419): a, c, t, g, unknown or other
  misc_feature (419)..(419): n is a, c, g, or t
tcagatagagtactcacgaccggtgctcgatttagtgtgagtagtttgggtttgggggtcgcctgggtacggccgggggggtcggcgtgagactctcctgtgcggcctctggattaagttttaggaggtcatgccatgaactgggtccgcaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccggtctattacttgtgtttaaaaggcgaggtctagggaactacggggacccggggtcccacgttgaccctacgtgggggcccaagggggccncgtggcaccggtctccncagccctccgaccgaacgggcccatccggtccttcccccgtaggccctcccgtcctccgaagaccgaccacccgtcgtacgggggccacgtacggcctacgcccgttgggaccctcgcccgtcggtaccgaacgggaccttacgtcccgaagttccctacgtactaacccggttgaccggttccgggacttcgggacgtaacggcgaccaggtacagcg

SEQ ID NO: 54654 - DNA, 805 bp, Homo sapiens
  misc_feature: GYAE6OF02F8Z4R.29.78.H01.1.454.CMB.1.raw
  modified_base (239)..(239): a, c, t, g, unknown or other
  misc_feature (239)..(239): n is a, c, g, or t
  modified_base (387)..(387): a, c, t, g, unknown or other
  misc_feature (387)..(387): n is a, c, g, or t
tcagatagagtactcacgaccggtgctcgatttagtgtgagtagtttgggtttggggtctgagagaggagtccacccctgggatcttcaggtgttttcatttggtgatcaggacggaacagagagaactcaccatggagtttgggctgagcgtgtcgtttctaggtggctaatttaaaggtgtcagtgtgacgtgcagttggtgagtctggggctccgtagggtacggccggggggtcncgtgagactctccgtgtcgcggcctcgtggtattaaggttttacggagttcacgttgcctagtacggtaaccgtgggtcccgaccgacggtcctaccgaggggaacgggtcgtaggtcgttggggtccgttcggacgttagttaaggnggtaccgtagggttcgggcggtcgacggttattatagtttacgtacggtacgacggtacccggtcccgtagggtaacggggttcccggttacccgtaaacccttaacggttttcccaagggtaactaacgtaaaccgtttaacgggaaaacgaaccgtacggtacttacgggttaacttccgtagtacctaaaagttcgggaacgtacgcccgtagacgtaccgtaaccggacgaacggtaccggtacctttacgttaattttagttacgggtaaagttaacggcgtaacggtcggtaaggtaaaccggggttcccggggaaaccccgggttcccggtaacgttccgggaaccccgttaggggtacccgggttacccggggaagggtccccggttacggtttaccgggtaacccccgg

SEQ ID NO: 54655 - DNA, 655 bp, Homo sapiens
  misc_feature: GYAE6OF02JGRS2.29.78.H01.1.454.CMB.1.raw
  modified_base (217)..(217): a, c, t, g, unknown or other
  misc_feature (217)..(217): n is a, c, g, or t
  modified_base (240)..(240): a, c, t, g, unknown or other
  misc_feature (240)..(240): n is a, c, g, or t
  modified_base (253)..(253): a, c, t, g, unknown or other
  misc_feature (253)..(253): n is a, c, g, or t
  modified_base (300)..(300): a, c, t, g, unknown or other
  misc_feature (300)..(300): n is a, c, g, or t
  modified_base (336)..(336): a, c, t, g, unknown or other
  misc_feature (336)..(336): n is a, c, g, or t
tcagatagagtactcacgaccggtgctcgatttagtgtgagtagtttgggtttggggtctgagagaggagtccacccctgggatcttcaggtgttttcatttggtgatcaggacggaacagagagaactcaccatggagtttgggctgagcgtgcgttttctaggtggctaatttaaaaggtgtcagtgtgacgtgcagttggtggagtctggggcnccgtgggtacggccggggggtcnctggagactctcngtagcggcctgtggattaagtttgagtcatgccatgaacgtggtccncaggctccgagggaacgggctggagtggtctcgggntagtagtcggcaggttcggtgcgtctaagtatattagtgacgagccgcctaggaaacggccgttcaaccgtatttcccgaagtacgaacgtaattacggaaagaacgtacggtcttaggtaactcctagacctaaaagtggaacgtacgtaccgagtaacggaccttaccggaacgtaccgtacggtcccgtaattacgttaattacggtacgttaaaacgcgagtaccgtaggtaaaccgtaccggggtaccgggtacccgactttcggaacccctaggttaccgggacgtacgggggtaacctcgttacggaacccg

SEQ ID NO: 54656 - DNA, 789 bp, Homo sapiens
  misc_feature: GYAE6OF02H0OFD.29.78.H01.1.454.CMB.1.raw
  modified_base (167)..(167): a, c, t, g, unknown or other
  misc_feature (167)..(167): n is a, c, g, or t
tcagatagagtactcacgaccggtgctcgatttagtgtgagtagtttgggtttggggtccgagccatggtgcagactccccagagctctcctcctcctccactgcacagggtctctctcccagcctgtgctgactcaatcgccctctcgcctctcgcctccgtgggngcctcggtcgaacggtccacctgtactcgtgacgcgaggtggacacagcagcgtaccgaccactcgcgttggctatcgagccaggacggccacggaccgaccggtccttacggttacttggattgactacgtaacaaactaagtgtaagtcggacgacgtaccgaacgacgggaacggggaacggggggtaaccggtacgttacccggtacggtacgtaccggtacctttcgtaccgtaccggtttaccgtcccgtaagttccgttaccggttccggggtcctcgggtaacgtcccgttaacctaaccttacccgaacgttaaccgtcccggtccccggtacccgttacgtaccggtgtaacgggtcggtaagttacgggacggtacgtccgttaaacgtttacttaacgtccggtaacgtacgtaccggagggtaccgtacgtacgggtacttaggttaccgtacggggttcccggtaaccgggtaaccgggtaaccgccggttacccgggtaccggttccgggtcccgttaaacggccccggaaaccggtaaccccggtccctaaccccggttaaccgtcggttaacccctacccttacccgtacccgtttaaccccccg

SEQ ID NO: 54657 - DNA, 636 bp, Homo sapiens
  misc_feature: GYAE6OF02HF1TE.29.78.H01.1.454.CMB.1.raw
  modified_base (634)..(634): a, c, t, g, unknown or other
  misc_feature (634)..(634): n is a, c, g, or t
tcagatagagtactcacgaccggtgctcgatttagtgtgagtagtttgggtttgggggcgcctgggtacggccgggggggtcgctgagactctcctgtgcggcctctggatttaagttttaggagtcatgccatgaactgggtccgccaggctccgagggaaggggctggagtgggtctcggctattagtggcagtggtggcgctatatattatgcagacgccctgaagggccggttcacctatttccagagacaattcgaaagaacacgctgtatctgacaaagtggagagcctgaagactcggaacgaccgacgggtcccgtacttatttagttgtagttaaaggcgagtcgtaggaacgtaacggggacccgggccgtacgttcgaccacgtgggggaccagggggacgcgtcggtcaccgttcctcctcgcgtccctaccaccgaacggcccgactccggtccctttccccgtcggccctaccctcctaccgaagcgtaccaccgtcggtcggggccaacgcgccgacggcccggtcggccgtcgccgttcggacgtaacggtacctaccgttcctacgttactactactcgtaggacggtccgggagtcggacgacggacgctagtagncg

SEQ ID NO: 54658 - DNA, 584 bp, Homo sapiens
  misc_feature: GYAE6OF02JCSLJ.29.78.H01.1.454.CMB.1.raw
  modified_base (379)..(379): a, c, t, g, unknown or other
  misc_feature (379)..(379): n is a, c, g, or t
  modified_base (393)..(393): a, c, t, g, unknown or other
  misc_feature (393)..(393): n is a, c, g, or t
  modified_base (581)..(581): a, c, t, g, unknown or other
  misc_feature (581)..(581): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagacacgctgtatctgacaaatggagagcctagagactcgacgacacggccgtactattatgtagttaaaggcagctaggaatacgggaccgggccattgaccacgtcggggccaggggacncgtcggcaccgtcncctcacgcctcaaccgaggcccacgtcgtccttcccctcgccaccctcctccacgacgccaccgtccgtcgggcacgacgcacgcccgtcggcctcgccgtcggtacgaacggtaccttaccgttccgtacgtaccgtctaacgttcgtcggtacgccggtccgtggtacgacggcgacgtagtacgnacg

SEQ ID NO: 54659 - DNA, 716 bp, Homo sapiens
  misc_feature: GYAE6OF02JJ21E.29.78.H01.1.454.CMB.1.raw
  modified_base (650)..(650): a, c, t, g, unknown or other
  misc_feature (650)..(650): n is a, c, g, or t
tcagatagagtactcacgaccggtgctcgatttagtgtgagtagtttggggtttggggagagctctggggagtctgcaccatggctcggaccccactcctcttcctcaccctcctcctccactgcacaggtctctctcccagcctgtgctgactcaatccgccctctcgcctctcgccctccgtgggacgctcggtcaacggtccaccgtgtactcgtgacgcaggtacggacacgacgcaacggcctaccgccatcggcttggctactacgacggcaggacggaccaacgacgaccggtcctacgttactgatcgactacgtacaacgtaatggacgtacgctaacgtaccacgacggtacgggaaacgggggtacgtaaccgtccgttagaccgttcgtccttaccgtcgtacgttaccgtaccgtaccgtccgttccggtcgggtccgtacggccggtaaccgttaccctaaccctacgtaacccgaccgttcccggtcccggtcctaaccgtcgttccggtaagggaaaccggtgttaccgggacggttctaggaccttttagtaccgtaccgtacgtacggtaccggtcggaactcgtacgcttacgtacgtccgggttccggaaccggggaacccgggttaacncgggttaaccggcccggttcggaccgttaccggaacccgtcccggaaccggtacccacccgttcgg

SEQ ID NO: 54660 - DNA, 650 bp, Homo sapiens
  misc_feature: GYAE6OF02HOLRD.29.78.H01.1.454.CMB.1.raw
  modified_base (260)..(260): a, c, t, g, unknown or other
  misc_feature (260)..(260): n is a, c, g, or t
  modified_base (648)..(648): a, c, t, g, unknown or other
  misc_feature (648)..(648): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccaggggaaggggctggagtgggtctcggctattagtggcagtggtggcgctatatattatgcagacgccctgaaggccggttcaccatttccagagacaattcgaanaacacgctgtatctgacaaagtggagacgcctagagactcgacgacaccggccgtctatttagttgtagttaaaggcgagctaggaacgtacggggacccggggcccgagttcgaccgacgtcggggccgaggggaccgcgtggtccaccgtctccgtcacgtccctccaaccgacggccccacgtccggttcccttcccccgtcgcccacccctccctaccaacgtacgccctaccgtccggtacggggccaacgacgaccgaccgtcccggtcgggtccgtcgtccggttacggtacgaacgggtaaccttaaccgttaccgacgttacctccttaacgttcgtcggacggtcgggtcgtacggacgacgggccgtacacgtacgncg

SEQ ID NO: 54661 - DNA, 726 bp, Homo sapiens
  misc_feature: GYAE6OF02JRC2R.29.78.H01.1.454.CMB.1.raw
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccgagggaaggggctggagtgggtctcggctattagtggcagtggtggcgctatatattatgcagacgcctgaagggccgttcaccatttccagagacaattcgaagaacacgctgtatctgacaaatggagacgctgagacctcgacgaacgccggaccgtctattattgtaggttaaggcgagtcgtaggaagtaccggggaacccggggccccgtaacgttacgaacccgacggttcggggacccggaagggggaccgtcgttcgggacccaccggttcctcccgtcgacgtcccgtcccgaacccgacgggcccctagttccggttaccccttcccccgtacggtcccacccttacccgtacccgaacgaccgtccacccgttcgggccggggtaacaccgaacgccggaccgtccccggtcgggtcctaccggtccggttaccggtaacgtaaaccgggtaccctttaccgttacccgagttaccctttaacgtaccgttccggtacggacgggtaccgggtaccggttggaccgggttaacggaccgttacggaacgttagccgtaac

SEQ ID NO: 54662 - DNA, 789 bp, Homo sapiens
  misc_feature: GYAE6OF02J2U1K.29.78.H01.1.454.CMB.1.raw
  modified_base (279)..(279): a, c, t, g, unknown or other
  misc_feature (279)..(279): n is a, c, g, or t
  modified_base (290)..(290): a, c, t, g, unknown or other
  misc_feature (290)..(290): n is a, c, g, or t
  modified_base (787)..(787): a, c, t, g, unknown or other
  misc_feature (787)..(787): n is a, c, g, or t
tcagatagagtactcacgaccggtgctcgatttagtgtgagtagtttgggtttgggggcgcctgggtacggccggggggtcgctgagactctcctgtgcggcctctggattaagtttaggagtcatgccatgaactgggtccgcaggctccaggagggctggagtggtctcggctatagtggcagtggtgcgctatagtattatgcagacgccctagaacgggccggttcaccatttccagacgacaattcgaagacacgctagtactctgacaagtgngacgcctgacncgtcgacgacaccggtcctctattacgttagttagtaaaggcgacgtcgtaggaacgttaaccgggggaccccgggtaccccggtaccgtttacggaaccctacggtacccgggggtacccgaacgggggggtaccctacggttacgggttcccgaacccgggttcctacccgtttacccgaccggtaccccgttacccgaacccggtaaccggggtacccctacgttcccggttccccgtttacccccgtacgggtaccccctaccccgggtaccccttaacccgtaaccggaccggtaccctacccgtaccgggttacggggacccaaccgtaaccggttccgaacccggtccccgggttacggtcccggttaccggttacccggttaccgggtaccgtaaaccgggtaccttaccgttacccgtaacggttaccctcgtacgttacgtcgaaccgggcgttccggacggtaaccgaggtccgacgtacgtcgancg

SEQ ID NO: 54663 - DNA, 751 bp, Homo sapiens
  misc_feature: GYAE6OF02H1K94.29.78.H01.1.454.CMB.1.raw
tcagatagagtactcacgaccggtgctcgatttagtgtgagtagtttgggtttggtggtctctctcccagcctgtgctgactcaatcgccctctgcctctgcctcccgtgggaggctcggtcaaggtcacctgtactctgagcagtggacacagcagctacgccatcgcttggcatcagcagaggccagacacgggccctcgttacttgatgacagtacaaacaatgagtggcagtcacgaggcgaaaggggggacggactcccgtagacgtcgctttcgtcacgttcctccgagtccttcggtcgggtacctggacgccgtcctacctcgaacctacgttccgtcccggcccttaccgagttccgtaggacggtagtcgggagtaccttagtaacctttacgtttacgtcgtaccggtacggtacccgggttcgggggtacctaccggttgggtaccttaagggttttccgggaaccgggttttcccgggttaccgggggaaaccccggggtacgttaaaccggggttcccttaacccgggttcggggttacccggtaccgaacccggaccccgtaaaccggtaccccccgaaaccccgtacggttccgttcccttaacccgggtttcccttacccgggtttcccccgaccccgtttcacccgttaacgttaccctttctacggtccgtacgggtccgggtccgggaccgttcgggacgtaccgggtccgtaccgtagtacggcgtcacg

SEQ ID NO: 54664 - DNA, 566 bp, Homo sapiens
  misc_feature: GYAE6OF02GCZJ7.29.78.H01.1.454.CMB.1.raw
  modified_base (384)..(384): a, c, t, g, unknown or other
  misc_feature (384)..(384): n is a, c, g, or t
  modified_base (401)..(401): a, c, t, g, unknown or other
  misc_feature (401)..(401): n is a, c, g, or t
  modified_base (446)..(446): a, c, t, g, unknown or other
  misc_feature (446)..(446): n is a, c, g, or t
  modified_base (558)..(558): a, c, t, g, unknown or other
  misc_feature (558)..(558): n is a, c, g, or t
  modified_base (565)..(565): a, c, t, g, unknown or other
  misc_feature (565)..(565): n is a, c, g, or t
tcagatagagtactcacgaccggtgctcgatttagtgtgagtagttttgggtttggggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccgttcaccatttccagagacaattcgaagaacacgctgtatctgcaaaatggagagcctgagactcgacgacacggccgtctattattgtagttaaaggcgagctggaacgtacgggaccggggccacttgaccacgtggggccgaggggcncgtggtcaccgtctccncacgcctccaccgacggccacgtcgtcctcccctcgccgtacccncctaccaacgagccactcgtacggggccacgacgccacgcccgtggcctcgccgtcgtacgaacggacttacctccgagtactctatcgtcgacggcggtcgaggcaggccngactganc

SEQ ID NO: 54665 - DNA, 581 bp, Homo sapiens
  misc_feature: GYAE6OF02HSNM4.29.78.H01.1.454.CMB.1.raw
  modified_base (270)..(270): a, c, t, g, unknown or other
  misc_feature (270)..(270): n is a, c, g, or t
  modified_base (313)..(313): a, c, t, g, unknown or other
  misc_feature (313)..(313): n is a, c, g, or t
tcagatagagtactcacgaccggtgctcgatttagtgtgagtagtttgggtttggtggtctctctcccagcctgtgctgactcaatcgccctctgcctctgcctccctgggaggctcggtcaaggtcacctgtactctgagcagtggacacagcagctacgccatcgcttggcatcagcagaggccagacacgggccctgttacttgatgacagtcaaacaatgatggcagtcacaggacgaaggggggacggatcccgtgatcgcttcncagtctccagctcgtgggcctggacgcgctacctcacaatccnccggcctccagtcctgaggatggacgctgacttattactgtacacggtaccgtggggacacgtcgactagttcgacggttcgttaccgggaaccgggaccgaacggtccgaccggttcgtccggacgaccgacccgaacggccccaacccgtacgtcgtacctcctccgttaccgttccccacccttcctaccgtacgttcccttacgttacgttccgtggtaccggccgggtcgtacggaccgacggtccgtacacgtacgctatcg

SEQ ID NO: 54666 - DNA, 831 bp, Homo sapiens
  misc_feature: GYAE6OF02IIQT9.29.78.H01.1.454.CMB.1.raw
  modified_base (245)..(245): a, c, t, g, unknown or other
  misc_feature (245)..(245): n is a, c, g, or t
tcagatagagtactcacgaccggtgctcgatttagtgtgagtagtttgggtttggggggagagaggagtccacccctgggatcttcaggtgttttcatttggtgatcaggacggaacagagagaactcaccatggagtttgggctgagctggtctttttctgtggcttaatttaaaaggtgtccagtgtgacgtgcagttggtaggagtcgtgggggcgccgtggggtaccgggccggggggtcncgtgagactctcctgtcgcggcctctggtagttaacgtttaggacgtcatcgcctagtcgtaacgtcgggtcccgccgaggtcctccggaaggggaacgggtcgtaggggtagtcggggttctcggagttacgttaggtggcgtaaggttgggtcggtccgtacgttaactaagttattaagtcggactaacggtaccccggtccccgtaagggtaaccgggggtaccccggtttaccaacccgtttaagttttaaccccggaaggttaaccggtaaacgtaacgtttaaccggaaacggaaacccgtaacggtacttacggtaacgttacgtaccggtaacgtaaagtacgggaacgaacgtccgtaggaaccgtacgaccggaaaccgacgtaccggtaccgttacgttaacgtttagtttacggtaacggttaaagggtacggtaacgtacggttacggtaaacggggttacccggggtacccggggtaacccgttacgttaccgggtaacccggtacggttaccgggggacccggtaacggggtacccgtacgggtaacccggttacccgtaccccgttccg

SEQ ID NO: 54667 - DNA, 564 bp, Homo sapiens
  misc_feature: GYAE6OF02GH9R6.29.78.H01.1.454.CMB.1.raw
  modified_base (378)..(378): a, c, t, g, unknown or other
  misc_feature (378)..(378): n is a, c, g, or t
  modified_base (560)..(560): a, c, t, g, unknown or other
  misc_feature (560)..(560): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgacaaatggagagcctagagactcgacgacacggccgtctattattgtgttaaaggcgagctggaatacgggaccgggccgactgaccacgtggggccaggggcnctggcacgtctctcacgcctccacaaggccatcgtctcccctggccaccctctccaagtacgcacctcgtggggccacacgcacgccgtcgggactcgccgtcggtacaacggtactaccgttacgtacgtactcgtatcctagacggtccgggtcgtacggacaacgggcgactactaggntacg

SEQ ID NO: 54668 - DNA, 805 bp, Homo sapiens
  misc_feature: GYAE6OF02JX59C.29.78.H01.1.454.CMB.1.raw
  modified_base (251)..(251): a, c, t, g, unknown or other
  misc_feature (251)..(251): n is a, c, g, or t
tcagatagagtactcacgaccggtgctcgatttagtgtgagtagtttgggtttgggggcgccgtgggtacggccggggggtcggcgtgagactctcctgtgcggcctctggattaagtttaggagtcatgccatgaactgggtccgccaggctccagggaagggctggagtgggtctcggctattagtggcagtggtggcgtctatatattatgcagacgccctgaagggccggttcaccgatttccaganacaattcgaagaacacgctgtatctgacaatggagagcctgagactacgacgacacgggcctacgtattacttgtagttaaaggcgagtcgtggtaaagtaccgggaccggggacccgtacgttcggacccacggtgggggtaccgaaggggggccgacgttcgggtccgaacccgttcgtacccgttccgaacggtcccccttaccgaaccccgtaacggggcccctaacgttccccgggtcccctttcccccccggtcgggtacccctacccccgttacccccgttaccccgaaaccggtaccggtaccccgtaaccccgtttcccgggttaaccgggggccccgttaaaccggacccggacccgttaaccgggcccccggttttaccgggggaccccgttaccgggttccccgttacggggtttacccgaaaccggggtaacccttaacccgttacccgtaaccgggttacccttaccgttacgtcccggtttaggaccggtaccgggtaccgtacggtaccgacgggttaccgcgtaacgttacggatcg

SEQ ID NO: 54669 - DNA, 741 bp, Homo sapiens
  misc_feature: GYAE6OF02IO7VA.29.78.H01.1.454.CMB.1.raw
tcagatagagtactcacgaccggtgctcgatttagtgtgagtagtttgggtttgggggcgcctgggtacggccgggggggtcgctgagactctcctgtgcggcctctggattaagtttaggagtcatgccatgactgggtccgcagctccagggaagggctggagtgggtctcggctattagtggcagtggtggcgcttatatattatgcagaccgccctaggaaacgggtccggttcaacccgtattttcccgaagaacggaacctaatttccgaaagaacacgctgtatctagactaaacgtggagtaacgccgtagacgacgtcgacgaactaccggcgttactattacgttgtaggttaaacggcgaacgtcgtagggtaacgtaccggggacccgggtccgtacgttacgaccctacggttcgggggaccgtagggggaccgtcggtttcggtacctacccggttctccgtaccacggtccccttacccgaaccgtaccgggacccgtacgttcccggttaccccgttcccccgtacggtacccctacccgttacccgtacccgtaaacggccgtaccgtaccgtccggttacggggacctacgcgacgtacgtcccgtgggcctcggtcccgttggaacgtaacggtacttaccgtccgtaagtaccgtacgttacgtcggttaggaccggtcggggtacctcggaaccggtacggccgtagtacctagcgtacg

SEQ ID NO: 54670 - DNA, 609 bp, Homo sapiens
  misc_feature: GYAE6OF02F1X0A.29.78.H01.1.454.CMB.1.raw
  modified_base (388)..(388): a, c, t, g, unknown or other
  misc_feature (388)..(388): n is a, c, g, or t
  modified_base (607)..(607): a, c, t, g, unknown or other
  misc_feature (607)..(607): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccgttcaccatttccagagacaattcgaagaacacgctgtatctgcaaatggagagcctgacgactcgacgacacggccgtctattattgtagttaaaggcgagtcgtaggaataccgggaccgggcccgtagttcgaccacgtcggggccaggggacnctggtcaccgtctcctcacgccctccaccgaaggcccagtccggtcccttcccccgtggccaccctccctaccaaacgacgcctaccgtcggtcggggaccacgacgtcgacgtcccgtgggcctcggccgtacgggtaccgaacggtacctaccgttacctagttacctctagtccgtggacggccggtcgtacggacgtaacggccgtacacgtcgnag

SEQ ID NO: 54671 - DNA, 806 bp, Homo sapiens
  misc_feature: GYAE6OF02G0NUM.29.78.H01.1.454.CMB.1.raw
  modified_base (806)..(806): a, c, t, g, unknown or other
  misc_feature (806)..(806): n is a, c, g, or t
tcagatagagtactcacgaccggtgctcgatttagtgtgagtagtttgggtttgggagcgcctgggtacggccggggggggtcgctgagactctcctgtgcggcctctggattaagttttaggagtcatgccatgaactgggtccgccaggcctccgagggaaggggctggagtgggtctcggctattagtggcagtggtggcgctatatattatgcagacgccctggaacgggccggttccacctatttccagagacaattcgaaagaacacgctgtatctgacaaatggagagcctgagactacgacgacgaccggccgtcttatttagttgttaggtttaaagggcgtacgacgtaggaagtaccgggggaccccgggggtacccgtaccgttcggaaccctaccgggtcgggggggacccggtaacgggggggaccgccggttcgggtacccgtaccccgttccgtcccctaccgacggtacccccttacccgaaccccgtaaccggggccccctaaccggttccccgggtttccccctttcccccccggtacgggtcccctaaccccccgttcccgtaccccgaaaccgaccgtccgtaccccggttccgggtccggggggaccctaaccggacggacccgacccggtccccgggttccgggtacccggttccggtcccgttacggtaaccgggtaacgggtaacccttaaccgtttcccgaaccgtttaccctacgtactttccggaggtaccggggtcccggtggtaccggaccggtaagggcccgtaggtacgacgtn

SEQ ID NO: 54672 - DNA, 681 bp, Homo sapiens
  misc_feature: GYAE6OF02GE50A.29.78.H01.1.454.CMB.1.raw
  modified_base (194)..(194): a, c, t, g, unknown or other
  misc_feature (194)..(194): n is a, c, g, or t
  modified_base (276)..(276): a, c, t, g, unknown or other
  misc_feature (276)..(276): n is a, c, g, or t
  modified_base (321)..(321): a, c, t, g, unknown or other
  misc_feature (321)..(321): n is a, c, g, or t
tcagatagagtactcacgaccggtgctcgatttagtgtgagtagtttgggtttggggtccgagccatggtgcagactccccagagctctcctcctcctccactgcacagggtctctctcccagcctgtgctgactcaatcgccctctgcctctgcctccctggggaggctcggtcaaggtcacctgtactctgngcagtggacacagcagcctacgccatcgcttggcatcagcagacggccagacgaccgggcctcgttactgatgacagtcaanaatgatggacagtcacgaggacggaaggggggacggtactcccgngacgtccgcttcgtcagtcctcacgtctacgtcgggcctggacgcgtaccttaccctacaacaacgtcccgtaccccggtcccttccgacggtcgtaggtaggactcggaggtccttacggaactttagtttaccgtacgttaccgacggtaccccgggttaggggcctacgttcggaccttaacgtttaccggtacgggtttacccgttacccggggggtaacccgggacccgtaacggggttcccgaaccggttccgggtacccgggtaaccctacccgggaaccccggaacccggtacccccgtaaaccccgtcggttaacccgccgtaaccgtttcccgttacccggttccccccg

SEQ ID NO: 54673 - DNA, 724 bp, Homo sapiens
  misc_feature: GYAE6OF02GDVLW.29.78.H01.1.454.CMB.1.raw
tcagatagagtactcacgaccggtgctcgatttagtgtgagtagtttgggtttggggtccgagccatggtgcagactccccagagctctcctcctcctccactgcacaggggtctctctcccagcctgtgctgactcaatcgccctctgcctctgccctccctgggagctcggtcaaggtcacctgtactctgagcagtggacacagcagctacgcatcgcttggcatcagcagcgcagcgacggtcctcgttactgatcgacagtacaaacatgagtcggacacgtaccagaggacgggaagggggacgtactcccgagtacgtccgtcttcgactacggtcctacgacgtccttcggcggtctagacgtcctaccgtacacgaactacgtccgtcccggtacctacgtacgttcgtacgggacggtagtcgggtaccggtcttaaggtaacctttaacgttaccgttacggtaccgaaccgggttccgggtacggggtaccttaccgggttcgtaaccttttacggttaacccgggttagggttaccccgggttaccggggggaaaccccggggtaacgttaccggggttacccgttaacccggggttccggtaccggttaaccggacccggttaaaccccggaaccggtaaccccccgtaaacccgtcggtttacccgaacccgtttacccggttccccggttacccggttacccccccgg

SEQ ID NO: 54674 - DNA, 623 bp, Homo sapiens
  misc_feature: GYAE6OF02IC59F.29.78.H01.1.454.CMB.1.raw
  modified_base (619)..(619): a, c, t, g, unknown or other
  misc_feature (619)..(619): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgacaaatggagagcctgagactcgacgacacggcctctattattgtgttaaaggcgagctggaagtacggggaccggggccgacgttgaccacgtcggggccaggggacgctggtcaccgtctacctcacgccctccacccgaacgggcccacgtccggtcccttccccctcggccctacccctccctaccaacgacgaccaccctcgtcggggccaacgacgacgacgcccgtgggcctcgcccgtgggtaccaacggtacctaccgttaccaacgttacctaccgttactccgttaggtacgggcccgggtcgtacgggtacgacggaccggacctagtacgntacg

SEQ ID NO: 54675 - DNA, 622 bp, Homo sapiens
  misc_feature: GYAE6OF02FU3X0.29.78.H01.1.454.CMB.1.raw
  modified_base (620)..(620): a, c, t, g, unknown or other
  misc_feature (620)..(620): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagcgtagggaatacggggaccggggcccgtacgttcgacctacgtggggccgagggggaccgcgtggtccaccggtctccgtcacgcctaccaccgaacgggccctagtccgggttcccttcccccgtcggtccctacccctccctaccaacgtacgcctaccgtcggtcggggccacgacgccacgcccgtgggcctcgccgtcggtacaacggtacctacgttcctacgtacctacttacgtcgtacggtacggccggtccgtggacgtacgggacgaccgagtacgncg

SEQ ID NO: 54676 - DNA, 602 bp, Homo sapiens
  misc_feature: GYAE6OF02JD7EO.29.78.H01.1.454.CMB.1.raw
  modified_base (396)..(396): a, c, t, g, unknown or other
  misc_feature (396)..(396): n is a, c, g, or t
tcagatagagtactcacgaccggtgctcgatttagtgtgagtagtttgggtttgggggcgcctgggtacggccgggggggtcggcgtgagactctcctgtgcggcctctggattaagttttaggagtcatgccatgaactgggtccgccaggctccagggaaggggctggagtgggtctcggctattagtggcagtggtggcgctatatattatgtcagacgccctggaagggccggttcaccatttccagtagaccaattcgaaagaacacgctgtatctgcaaatggagagcctgagactcgacgacacggccgtctattattgtagttaaaggcagtctaggaatacggggaccggggcccgaacttcgaccacgtcggggaccagggggacncgtggcaccggtctcccgtacacgccctccacgtaccggccacgtcgtccttccccgtcgccctaccctcctccaacgacgcacctaccgtggggaccacgtacgcacgcccgtggccgtcgccgtgtcaacggctacgtcctacgtctactacgtcgtcgacggcggccgtacggacgtacggaccgtacgaacgttacgctacg

SEQ ID NO: 54677 - DNA, 563 bp, Homo sapiens
  misc_feature: GYAE6OF02GU712.29.78.H01.1.454.CMB.1.raw
  modified_base (267)..(267): a, c, t, g, unknown or other
  misc_feature (267)..(267): n is a, c, g, or t
  modified_base (326)..(326): a, c, t, g, unknown or other
  misc_feature (326)..(326): n is a, c, g, or t
  modified_base (351)..(351): a, c, t, g, unknown or other
  misc_feature (351)..(351): n is a, c, g, or t
  modified_base (383)..(383): a, c, t, g, unknown or other
  misc_feature (383)..(383): n is a, c, g, or t
  modified_base (453)..(453): a, c, t, g, unknown or other
  misc_feature (453)..(453): n is a, c, g, or t
  modified_base (559)..(559): a, c, t, g, unknown or other
  misc_feature (559)..(559): n is a, c, g, or t
  modified_base (563)..(563): a, c, t, g, unknown or other
  misc_feature (563)..(563): n is a, c, g, or t
tcagatagagtactcacgaccggtgctcgatttagtgtgagtagtttgggtttggtggtctctctcccagcctgtgctgactcaatcgccctctgcctctgcctccctgggaggctcggtcaaggtcacctgtactctgagcagtggacacagcagctacgccatcgcttggcatcagcagaggccagacacgggccctcgttacttgatgacagtcaacaatgatggcagtcacagcgaagggggacggatccctgactcgcttcncagtctccagctcgtggcctgacgcgctaccctcacaactcctccggcctccaggttcngaggatgacggtctgactatttacngtacacgaccgtgggcacgtggactatttcgnggttacgttaccggggaccgggtaccaaggtccaccggtcgtacggtcaccgaccgacggcccaaacccncgtacgtccacttcctccttaccccgacccttcctaccgtacgtaccttcgtacctcggtacggaacggtccgggtacgtacggacggacggtcgacctagtacgncgtn

SEQ ID NO: 54678 - DNA, 588 bp, Homo sapiens
  misc_feature: GYAE6OF02FYS5C.29.78.H01.1.454.CMB.1.raw
  modified_base (311)..(311): a, c, t, g, unknown or other
  misc_feature (311)..(311): n is a, c, g, or t
  modified_base (463)..(463): a, c, t, g, unknown or other
  misc_feature (463)..(463): n is a, c, g, or t
  modified_base (481)..(481): a, c, t, g, unknown or other
  misc_feature (481)..(481): n is a, c, g, or t
  modified_base (501)..(501): a, c, t, g, unknown or other
  misc_feature (501)..(501): n is a, c, g, or t
  modified_base (514)..(514): a, c, t, g, unknown or other
  misc_feature (514)..(514): n is a, c, g, or t
  modified_base (567)..(567): a, c, t, g, unknown or other
  misc_feature (567)..(567): n is a, c, g, or t
  modified_base (582)..(582): a, c, t, g, unknown or other
  misc_feature (582)..(582): n is a, c, g, or t
  modified_base (588)..(588): a, c, t, g, unknown or other
  misc_feature (588)..(588): n is a, c, g, or t
tcagatagagtactcacgaccggtgctcgatttagtgtgagtagtttgggtttgggggcgcctgggtacggccggggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctggaacgggccggttcacctatttcccagagacaattcgaaagaacacgctgtatctgacaaatggagacgcctgagactcgacgacncggccgtcttattattgtaggttaaaggcgagtcgtaggaagtaccggggaccggggcccgactcgacctacggtcggggccgaggggacgtcgtggtccgaccgtctcctcgacgccctcccaccgaacggcccagtccgtccctccccgngcccaccctcctacagcnccgacctcggtcgggcacgngcacgccgtggcncgtcgtcgtacgaacgccttactaccgtatactcctactcgtacgcggcggtntacggacgacgccgntagcgn

SEQ ID NO: 54679 - DNA, 764 bp, Homo sapiens
  misc_feature: GYAE6OF02F7RN3.29.78.H01.1.454.CMB.1.raw
tcagatagagtactcacgaccggtgctcgatttagtgtgagtagtttgggtttggggggagagaggagtccacccctgggatcttcaggtgttttcatttggtgatcaggacggaacagagagaactcaccatggagtttgggctgagcgtgtcgttttctagtggctaatttaaaggtgtccagtgtgacgtgcagttggtggagtcgtgggggccgccgtggggtacgggccgggggggtcgctgagactctccgtgtgcggcctctggtatttaagtttaggagtcagtgccagtcgaacgtcgggtcccgccgacggtctccgagggtaacgggcgtggacggtgggtcgtccggcttagttacggtggcgtaggttgggtaggcgtacgttaagttaattatttacgtcgacgaacggaccgtcccgtagggaacgggtcccggttaccaaccttacgtttcccgaagtaacaaccgttaacgttacggaaagaacccgtacggtccgttaggtaaccttacgtacgaactaaagtgggaacggacgtcccgtaaggaccggtaaccgtaccggaaccggaaccggtacccggtaccgtttacgttaacttttaacggtttggttaaaggttaacgggcgtaagtccgtaacgggtaacggtaccgggggaacccgggtcccggtacggttaccgaaccggtacggtacggggaccggtacggggaccgtacggttccggtaccccgtaccggttcccg

SEQ ID NO: 54680 - DNA, 820 bp, Homo sapiens
  misc_feature: GYAE6OF02IA8YJ.29.78.H01.1.454.CMB.1.raw
  modified_base (256)..(256): a, c, t, g, unknown or other
  misc_feature (256)..(256): n is a, c, g, or t
tcagatagagtactcacgaccggtgctcgatttagtgtgagtagtttgggtttgggtctgagagaggagtccacccctgggatcttcaggtgttttcatttggtgatcaggacggaacagagagaactcaccatggagtttgggctgagcgtggtctttttcgttgtggtacttaattttaaaaggtgtccagtgtgacgtgctagttggtggagtcggtgggggccgccgtcggggtaccggggccggggggtcncgtggacgaccttctcctgtcgccggtccttcgtaggtaacttttaaaggtttttagggacgttacaagttcgaccagtacggaacgttcggggtcccgaccgaggtccgtacccggaagggggaacggggtcgtaggggtagggttcggggtccgtcgggtacttaagttagggtggacgtagggttgggtcggccgtacttaattaattagtttaagtcgacgtaacggacccgtcccgtagggtaaccgggggtcccgttaccaaccttaccgtttccgaaaggtacgtaacgttaaacgtttaaccggaaaacgaaaccgtacgtacttagttaactacgtagtaacgtaaaggtggtaacgacgtccgtagaacgaccgtaccgaacgtaaccgccggtacccgttacgttagtttagtttaggtaacggttaaaggcgaaggtacgttaacgggtaacggtacccgggggaccccgggtacccgtaaccggtttacccgaacccggttacgggtaccggggaacccggtacgggggtccgtacccggtcggtaccccg

SEQ ID NO: 54681 - DNA, 686 bp, Homo sapiens
  misc_feature: GYAE6OF02FJ1WM.29.78.H01.1.454.CMB.1.raw
  modified_base (684)..(685): a, c, t, g, unknown or other
  misc_feature (684)..(685): n is a, c, g, or t
tcagatagagtactcacgaccggtgctcgatttagtgtgagtagtttgggtttgggggcgcctgggtacggccgggggggtcgctgagactctcctgtgcggcctctggattaagtttaggagtcatgccatgaactgggtccgccaggctccagggaagggctggagtgggtctcggctattagtggcagtggtggcgctatatattatgcagacgccctgaagggccggttcaccatttccagagacaattcgaagaacacgctgtatctgcaaagtggagagcctgagactcgacgacacggccgtctattattgtagttaaaggcgagctaggaaacgtaccggggacccggggacccgtacttcggaacccaacggtcgggggacccgaggggggaccgtccgttacgggtccacccggttcctcccctcgaacggcccctacccaacccgaacggggcccctagtccgggttcccctttaccccccgtcggaccctacccccgttccctacccgaacggaccgaccgtacccgttccggtcgggggaccaaccgacggccgacggccccgtggggacctcgtccgttcggttaccgaacggtaccttaccgttacccgacgttacctactacgttccgtacgacggccgggtcgtacgggcgaacggccgacacgtgnng

SEQ ID NO: 54682 - DNA, 857 bp, Homo sapiens
  misc_feature: GYAE6OF02I5U5O.29.78.H01.1.454.CMB.1.raw
  modified_base (241)..(241): a, c, t, g, unknown or other
  misc_feature (241)..(241): n is a, c, g, or t
tcagatagagtactcacgaccggtgctcgatttagtgtgagtagtttgggtttgggggtctgagagaggagtccacccctgggatcttcaggtgttttcatttggtgatcaggacggaacagagagaactcaccatggagtttggctgagctggctttttcttgtggctattttaaaaggtgtccagtgtgacgtgcagttggtggagtcgtggggcgccgtgggtacggccggggggtcncgtgagctctccgtgtgcggcctcgtggtattaagtttggagttcagtgccatcgaacgtcgggtccgccgaggcctccgaaggggaacggggcgtgggtaggtgggtccgtcggtactagttaggtggactaggtgggtgccgtacgttagtaatattagtcggactacggaccggcccgtagggaacggggtcccgttacacccgttagttttcccgaaggttaacgaaccgttaacgttaaccggaaagtaaaaccgaccgtacgttacggtaacttcgtacggaacgtaaacggttacgggaaaggtaccggtaccgttaggaaccgggtaccgttacccgggaaaccggacccggttacccggggtacccgtttaaccgttaacgtttttaacgtttaacgggttttaaacgggttaaaacgggggtaccggtaacggttacggttaacggggtaaaacggggttaacccccggggggggaccccggggttaacccccgggtaaggttttaccccgggaaacccccggttaacccgggggttaccgggggggtacccccgggtaaacgggggggtacccggttacccgggttaaccggggtttccccccgg

SEQ ID NO: 54683 - DNA, 688 bp, Homo sapiens
  misc_feature: GYAE6OF02HNVH6.29.78.H01.1.454.CMB.1.raw
  modified_base (146)..(146): a, c, t, g, unknown or other
  misc_feature (146)..(146): n is a, c, g, or t
  modified_base (150)..(150): a, c, t, g, unknown or other
  misc_feature (150)..(150): n is a, c, g, or t
  modified_base (185)..(185): a, c, t, g, unknown or other
  misc_feature (185)..(185): n is a, c, g, or t
  modified_base (190)..(190): a, c, t, g, unknown or other
  misc_feature (190)..(190): n is a, c, g, or t
  modified_base (199)..(199): a, c, t, g, unknown or other
  misc_feature (199)..(199): n is a, c, g, or t
  modified_base (205)..(205): a, c, t, g, unknown or other
  misc_feature (205)..(205): n is a, c, g, or t
  modified_base (221)..(221): a, c, t, g, unknown or other
  misc_feature (221)..(221): n is a, c, g, or t
  modified_base (224)..(224): a, c, t, g, unknown or other
  misc_feature (224)..(224): n is a, c, g, or t
  modified_base (368)..(368): a, c, t, g, unknown or other
  misc_feature (368)..(368): n is a, c, g, or t
tcagatagagtactcacgaccggtgctcgatttagtgtgagtagtttgggtttggggggagagaggagtccacccctgggatcttcaggtgttttcatttggtgatcaggacggaacagagagatctaccactgtggttggttggntagngtcggctttgtcgaggcgtattaaagtgcagtgtncgtgnagtgtgatntgggcnctgggcgcgggggtcntgntctctctgtgcgtctgtagtattagttaggatcatgctagtgtacgtggccacgaggtcctacggaggggacggtcgtgggaagttcgggtcgtacggtacttagtaggtggaccgtaggtcggtgaccgtattagtatacgtntgacctcgacgtccgtacggtacggtacgtaccgtactacgttacgacgacgtaacgtaacgtaacgaacgaacgacgtacgtagtactacgtacgtaagtaagtagacgtacgtacgtacgtacgtacgtaccggtaaccgtaaccggtaccggtaccgttacgttaacgttacgttagttaacgttaacggtacggtaacggtacgtaacgggtaaccggtaaccgggtacccgggtaacccggtaccgtacgtaccggtaccggtacgggtacggtacgggtaccggtaccggtaccggtacccggtacccgtccgg

SEQ ID NO: 54684 - DNA, 717 bp, Homo sapiens
  misc_feature: GYAE6OF02I8KXZ.29.78.H01.1.454.CMB.1.raw
  modified_base (264)..(264): a, c, t, g, unknown or other
  misc_feature (264)..(264): n is a, c, g, or t
  modified_base (336)..(336): a, c, t, g, unknown or other
  misc_feature (336)..(336): n is a, c, g, or t
tcagatagagtactcacgaccggtgctcgatttagtgtgagtagtttgggtttgggggcgcctgggtacggccgggggggtcgctgagactctcctgtgcggcctctggatttaagttttaggagtcatgccatgaactgggtccgccaggctccagggaagggctggagtgggtctcggctattagtggcagtggtggcgctatatagttatgcagaccgccctgaacgggccgttcacctatttccagtagacaattcgaanacacgctgtatctgacaaagtggagacgcctgagactcgacgacacggccgtctattatgtagttaagcganctaggaacgtaccggggaccgggaccctacgttcgaaccgacggtcgggggaccgaggggactcggtcggtaccgtaccgtcctaccgtcaccgtccctaccgaaccgaacgggtcccagttcccgggtacccttcccccggtacgggccctaccccgttcccgtaccgtaaacggccgtacccgtaacccgtttccgggacgggggtacccaaccggaccgtccgaacccggttcccggtacgggttcccgtcccggtaccggttaccggttaccgaaacgggttacccttaccgttaaccgtacgttacctaccgttacgtcggtaccggtacggccgggtaccgtcggaaccgtacggccacgtaacgtcggctacgg

SEQ ID NO: 54685 - DNA, 739 bp, Homo sapiens
  misc_feature: GYAE6OF02IITEF.29.78.H01.1.454.CMB.1.raw
tcagatagagtactcacgaccggtgctcgatttagtgtgagtagtttgggtttggggtccgagccatggtgcagactccccagagctctcctcctcctccactgcacagggtctctctcccagcctgtgctgactcaatcgccctctgcctctgcctccctgggagctcggtcaaggtcacctgtactctgagcagtggacacagcagctacgccatcgcttggcatcagcagagccagacgaccgggcccttcgttacttgatgacagtacaactaatgagtggcagtcacgaggacggaagggggacgactcccgagtacgtcgtcttcgtctacgtctccagtcctcgtacggccttaggacgtccgactacccgtactaacgtaacttcccgtacccggtccttaccgacggttccgtaggtaacgggtacgtacggacggtacgtacggttaacctttacgtttaccgttgtacccggtaaaccggtaccgggttcgggggtacctaaccgggttcggtaaccgttaacggtttccggtaaccgggtttacccggttaaccccgggggaaaccccgggtaaccgttaaccggggtttacccgtacccgggtttaaccgggttacccgggtaaccgtacccgggtaacccccgtaaaccgggacccccgttaaaccccgtacggtttcccgtaaccccgtacccgtttacccggttacccgtttaaccccccccg

SEQ ID NO: 54686 - DNA, 650 bp, Homo sapiens
  misc_feature: GYAE6OF02GFLM3.29.78.H01.1.454.CMB.1.raw
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctagtatctgcaaatggagagcctgagactcgacgacacggcgtctattattgtagttaaaggcgagctggaataccgggaccgggccgacttgaccacgtggggccaggggacgcgtggtcaccggtctcctcacgccctcccaccgaacgggcccaagtccggtcccttcccccgtggtcccaccccgtccctccctaacgaccgacctaacccgttcggtcgggggccaccgacggaccgacggtccccgtcggggccgtcggtcccgttcgggtaccgaaacggtaccttaaccttcccgtaacggttacctcgtagttccgtacggtaacggtcccgggtcgttacgggtaccgaagggccgacgaaggttacggatcg

SEQ ID NO: 54687 - DNA, 584 bp, Homo sapiens
  misc_feature: GYAE6OF02F3KSI.29.78.H01.1.454.CMB.1.raw
tcagatagagtactcacgaccggtgctcgatttagtgtgagtagtttgggtttggggtctgagagaggagtccacccctgggatcttcaggtgttttcatttggtgatcaggacggaacagagagaactcaccatggagtttgggctgagctggctttttcttgtggctattttaaaaggtgtccagtgtgacgtgcagttggtggagtctgggggcgcctgggtacggccgggggggtcgcgtgagactctcctgtgcggcctctggatttaagttttaggagtcatgccatgaactgggtccgccaggctccgaggggaaggggctggagtgggtctcggctagttagtggcaggtggtggcgctatatattatgcagacgccctggaagggccgttcaccatttccagacgacaattcgaaagaacacgctagtactctcgacaaagtggagagcctagacgactcgacgaccgacggtccgtactattagttgtagttaaggcgagcgtaggaacgtacgggacccgggacccgtacgttcgaccgtacgtcggggaccgaggggaccgcgtggtacccg

SEQ ID NO: 54688 - DNA, 787 bp, Homo sapiens
  misc_feature: GYAE6OF02HPCQB.29.78.H01.1.454.CMB.1.raw
  modified_base (221)..(221): a, c, t, g, unknown or other
  misc_feature (221)..(221): n is a, c, g, or t
  modified_base (408)..(408): a, c, t, g, unknown or other
  misc_feature (408)..(408): n is a, c, g, or t
tcagatagagtactcacgaccggtgctcgatttagtgtgagtagtttgggtttggtggtctctctcccagcctgtgctgactcaatcgccctctgcctctcgccctcccgtgggacgctcggtcaaggtcacctgtactctgagcagtggacacagcagctacgccatcgcttagcatcagcagagccagacacgggtcctgttactgatgacagtcaaanatgatcggcacgtcacgaggaccggtaaggggggaccggtatcccgtagactcggtcttaccgtcgaacgtcctaccgagtccgttcggttaaccggggccctaggtaacgtcccgacccttaacctccaaacgttaacgtccccgttcccgggccttaaccgtggttacctaggggacgttaaccnggttaaccggcttacggaacctttacgtttacgttcgaccggaaccgttaccgggtcggggtacctaacggttcgggctttaaacgggttccgttaaccgggtccggttaaaccgggggacccgggtaacctacggggtcccttaaccgggtccgggtttaccggcgttaacccggaacccgggaaaccgaccccgtaaaacccccgtcgttacgggtacccctaacccggtttccggtttacccccgttacccgggtccccctttaacggtaccgttaaaccggttccttcccgtttaacccgcgggtaacggacgggtccccgggtaaacgttcgggaacccggtaacgggtccaccggttaaagcggatcccggag

SEQ ID NO: 54689 - DNA, 592 bp, Homo sapiens
  misc_feature: GYAE6OF02JIM0K.29.78.H01.1.454.CMB.1.raw
  modified_base (589)..(589): a, c, t, g, unknown or other
  misc_feature (589)..(589): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtaatctgcaaatggagagctgagactcgacgacacggccgtactattattgtgttaaaggcgagctggaatacggggaccggggcccgacttcgaccacgtcggggccaggggacgctcggtcaccgtctcctcgacgcctccaccgaacgggcccacgtacggtccttccccctggcccaccctccctccaacgcgaccacctcgtcggggcacacgccacgcccgtcgggcctgcccgtcggtacgaacgggaccttacgttccacgttacctcttaatcctcggacggtccgggtcgtccggacacgggcgcacgtgntcg

SEQ ID NO: 54690 - DNA, 823 bp, Homo sapiens
  misc_feature: GYAE6OF02HO0Q9.29.78.H01.1.454.CMB.1.raw
  modified_base (310)..(310): a, c, t, g, unknown or other
  misc_feature (310)..(310): n is a, c, g, or t
tcagatagagtactcacgaccggtgctcgatttagtgtgagtagtttgggtttgggggcgcctgggtacggccggggggtcggctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacagctgtatctgcaaatggagagcctgagactcgacgacacggccgtnttattattggtagttaaaggcgagtcgtagggaaataccgggggacccggggccccgtaacgttgacccaacggtcgggggcccaaggggggtaccgcgttcgggtccaacccggttcctcccgtaccacggtccccttacccaacccggaaacggggcccccgtacgtacccgggttccctttccccccgtccgggtaccctacccccgttccccgtaccccgaaacgaccggtaccctaaccccgttccggtaccggggggtcccaaccgtaaccggaccgaacccgggtcccccggttacggggggaccccgttccgggacccggtttacggggttaaccgaaaaccggggttacccgttaaacccgtttaccctaaccgggttaccctttaacccgtttacgtttaccggtttacccgggtaacgggggtccccgggggtacccggtttccggggaacccggtaaccgggggtacccgggtaacccgtaaccgggttacggaccgtacg

SEQ ID NO: 54691 - DNA, 704 bp, Homo sapiens
  misc_feature: GYAE6OF02GMSG4.29.78.H01.1.454.CMB.1.raw
  modified_base (300)..(300): a, c, t, g, unknown or other
  misc_feature (300)..(300): n is a, c, g, or t
  modified_base (405)..(405): a, c, t, g, unknown or other
  misc_feature (405)..(405): n is a, c, g, or t
  modified_base (422)..(422): a, c, t, g, unknown or other
  misc_feature (422)..(422): n is a, c, g, or t
  modified_base (703)..(703): a, c, t, g, unknown or other
  misc_feature (703)..(703): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagaccgccctggaacgggccggttcaccatttccagagacaattcgaaagaacacgctgtatctgactaaagtggagagcctgganactcgacgacacggcctcgtattattggtagttaaacggcgagctaggaagtaccggggaccggggtcccgacttcggaacctcggtgggggaccgagggggccncgtcggtcaccggttcncccttcacggccctacccaaccggaaccggggcccacgttcccggttcccttcccccgtcggacccctacccctccccgtaccgaaaccggtacgtccctacccgttcgggtccgggggaccacggacgtccgaccggtcccggtacggggtcctcggtacccgttgggtaccgaaacggttacccttaccgtacccgtaacgtttaccctcgttaccgttaccgtagggtacccggccgggttacgcgggtacgtaccgggacccgtacgtacgcgtacng

SEQ ID NO: 54692 - DNA, 876 bp, Homo sapiens
  misc_feature: GYAE6OF02GU5PB.29.78.H01.1.454.CMB.1.raw
  modified_base (873)..(873): a, c, t, g, unknown or other
  misc_feature (873)..(873): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagaccgcccgtaggaagggccggttcacctatttcccagagaccaagttcgaaagaacacgctgtatctgacaaagtggagagcctagagacctacgaccgaacgaccggtccgtacttaattacgttggttaaggttaaaacgggcgacggcgttaagggaaacggtaaccgggggacccccgggggtaccccgtaacgttaccgaacccgaacggtcggggggacccgaacggggggaccgtacggttacgggtacccgtaacccggttccctttacccgtaccaccgggtacccccttaccccgaaacccgggtaaacccgggggaccccctaaaccggtttccccgggtttacccccgtttccccccccggtcggggtacccccttaaccccccttccccgttaaccccgaaacgggaaccccggtacccgtaaccccggttccggggttaccgggggacccaaccggacgtacccggaacccggtccccgggtacgggtcccgtcgggtaccccgttacgggtaaccgtaaaccggtaacccgtttaaccgtacccgtaaccggttaccttaccgttaaccgttccgtacgggtaccgggtcccggggtccgttacgggacccggaaccgggacccgtaggtaacggttacganacg

SEQ ID NO: 54693 - DNA, 782 bp, Homo sapiens
  misc_feature: GYAE6OF02HW6T2.29.78.H01.1.454.CMB.1.raw
tcagatagagtactcacgaccggtgctcgatttagtgtgagtagtttgggtttggggggaagaggaagactgacggtccacccctgggatcttcaggtgttttcatttggtgatcaggacggaacagagagaactcaccatggagtttgggctgagctggctttttcttgtggctaattttaaaaggtgtccagtgtgacgtgcagttggtggagtcgtgggggcgcctgggtacgggccgggggggtcgctgagactctcctgtgcggcctctggattaagttttaggagtcatgccatgacgtgggtccgccaggctccgaggggaagggctgggaggtggggtctcggtcttagttaggtcgggctaggtgggtcggccgtacttaagttaattactttaagtcgacgacggtacccgacccgttagggaaaccggggtcccgtttaccaacccgtacttttacccgaaggtaacgtaacgtaacgtttaccgaaaacgtaaacgaccggtacgttagttactaccgttacggtaacctaaaaggttcgggaacgtacggtacccgtagggaaccggtacctacgggaaacccgaaccggaacccgggtacccgttacttaacgtttagtttacggttaaggttaaacgggcgtacggtacgttaacgggaaccgggttaaccgggggacccccggggacccgtacggttaccggtaaccccgaccgggtaccggggggtacccgacgggggggtacccgtacggtccgggttaccccg

SEQ ID NO: 54694 - DNA, 607 bp, Homo sapiens
  misc_feature: GYAE6OF02FRUGV.29.78.H01.1.454.CMB.1.raw
  modified_base (605)..(605): a, c, t, g, unknown or other
  misc_feature (605)..(605): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctaggaataccggggaccggggcccgacgttgaccacgtgggggccagggggaccgcgtggtccaccgtctccctcgacgccctccgaaccgaacgggcccaagtccggttccttccccccgtggccctacccctcctaccaacgacgcctaccgtcgtcggggaccacgacgccacgcccgtgggcctcgccttgggtccaacggtaccttaccgttccagtacctctacgtcgtggacggcgggcgtcggacgtacggccgtacagtacgncg

SEQ ID NO: 54695 - DNA, 638 bp, Homo sapiens
  misc_feature: GYAE6OF02FQZ5F.29.78.H01.1.454.CMB.1.raw
tcagatagagtactcacgaccggtgctcgatttagtgtgagtagtttggggtttggggagagctctggggagtctgcaccatggctcggaccccactcctcttcctcaccctcctcctccactgcacagggtctctctcccagcctgtgctgactcaatcgccctctgcctctgcctccctgggaggctcggtcaaggtcacctgtactctgagcagtggacacagcagctacgccatcgcttggcatcagcagaggccagacacgggcccttcgttactgatgacagtacaacaatgagtggacagtacaacgaggacggaacgggggacggactccgtagactcgtcttcacgtacgtctcgacgtcctcggtcgggcctaggacgccgtcctaacctcgaaactacgtcccgtcccggacccttaccgacggtcgtaggaaggtagtcgggacggtcttacggtaacctttagtttacgtcgtacgaacggtaccggttacggggaccttacgtggactacgtttaccgtaggttcccgggttaccggggaaccggggtaccaaccgggttccgtacccgggttcgttacgggacccgaaccggaccccggtaaacggaccccctaacccggtcg

SEQ ID NO: 54696 - DNA, 776 bp, Homo sapiens
  misc_feature: GYAE6OF02JG8NL.29.78.H01.1.454.CMB.1.raw
  modified_base (224)..(224): a, c, t, g, unknown or other
  misc_feature (224)..(224): n is a, c, g, or t
tcagatagagtactcacgaccggtgctcgatttagtgtgagtagtttgggtttggggtccgagccatggtgcagactccccagagctctcctcctcctccactgcacagggtctctctcccagcctgtgctgactcaatcgccctctgcctctcgcctcccgtgggaggctcggtcaaggtcacctgtactctgagcagtggacacagcagctacgccatccgnttggcatcagcgagacggccagaccgaccgggcccttgttacttgatcgacagtacaactaatgagtggacagtcacaggacggaagggggacggactcccgtgtactcgtccttcgtactacgtcctaccgacgtccgttaccggtcgggtcccgtaaggaccggtaccgtacccgttaaccctaccgaaccgtaacggttccccgtacccccgggtccctaccgtaacggttccgttagggtacggaaggttccgggaacgggtcccttaacggaacctttaaacgtttaccgtccgggtaacgtacccggttacccggggtagggggtacctaaccgggtttcgggacctttaacggtttaccggaccgggggtttaccgggtttaccccgggggaaaaccccggggtaccggtaacggggtttacccgtaacccgggtccggggttacccgggttaaccaacccgggtcccgaaacccgggtaccccctaaaccccggttcgttacccggtaccttacccgtttcccggttccccttaacccccccgg

SEQ ID NO: 54697 - DNA, 642 bp, Homo sapiens
  misc_feature: GYAE6OF02IHQAM.29.78.H01.1.454.CMB.1.raw
  modified_base (189)..(189): a, c, t, g, unknown or other
  misc_feature (189)..(189): n is a, c, g, or t
  modified_base (292)..(292): a, c, t, g, unknown or other
  misc_feature (292)..(292): n is a, c, g, or t
  modified_base (311)..(311): a, c, t, g, unknown or other
  misc_feature (311)..(311): n is a, c, g, or t
  modified_base (355)..(355): a, c, t, g, unknown or other
  misc_feature (355)..(355): n is a, c, g, or t
  modified_base (383)..(383): a, c, t, g, unknown or other
  misc_feature (383)..(383): n is a, c, g, or t
  modified_base (396)..(396): a, c, t, g, unknown or other
  misc_feature (396)..(396): n is a, c, g, or t
  modified_base (440)..(440): a, c, t, g, unknown or other
  misc_feature (440)..(440): n is a, c, g, or t
  modified_base (470)..(470): a, c, t, g, unknown or other
  misc_feature (470)..(470): n is a, c, g, or t
  modified_base (474)..(474): a, c, t, g, unknown or other
  misc_feature (474)..(474): n is a, c, g, or t
  modified_base (482)..(482): a, c, t, g, unknown or other
  misc_feature (482)..(482): n is a, c, g, or t
tcagatagagtactcacgaccggtgctcgatttagtgtgagtagtttgggtttgggggaagaggaagactgacggtccacccctgggatcttcaggtgttttcatttggtgatcaggacggaacagagagaactcaccatggagtttgggctgagctggtctttttcttgtggtctattttaaaaggtntccagtgtgacgtgcagttggtggagtcgtggggcgcgtgggtacgggccgggggtcggctgagactctctgtgcgctctgtaattagtttagagtcatgccntgacgtggtccgccaggcnccgagggagggcgtggaggtgggctccggatgttaagtggacgnggttaggtggcggtctaattatagttangtacacggacccnccgtagggacgggtcccggttaccaccgtactttccgaagtaanaacgtattaacgaacgaaacacgtctgtancgtnaactaagngagagcctagcgacgtcgaccgagaccggaccgtatttaacttgtttaggtataacgggtcgacgtagtacggtaaccgggaacggggtaccccgggtccgtaacgttacgacccgtcggggaaccggtcccggaacggggccgtaggtccggtacccgg

SEQ ID NO: 54698 - DNA, 586 bp, Homo sapiens
  misc_feature: GYAE6OF02I04OF.29.78.H01.1.454.CMB.1.raw
  modified_base (381)..(381): a, c, t, g, unknown or other
  misc_feature (381)..(381): n is a, c, g, or t
  modified_base (398)..(398): a, c, t, g, unknown or other
  misc_feature (398)..(398): n is a, c, g, or t
  modified_base (582)..(582): a, c, t, g, unknown or other
  misc_feature (582)..(582): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacggggaccggggcccacttgaccacgtggggccaggggacncgtggtcaccgtctccncagcctccaccacggccactcggtccttcccccgtggccaccctcctccaacgacgccacctcgtcggggaccacgcgcacgcccgtcgggcctcgcctcgggtacaacggaacctaccgttaccgacgttacctctacgtccgtgacggtcgggcgtggaccgaacgggccgaccgaagtagntacg

SEQ ID NO: 54699 - DNA, 695 bp, Homo sapiens
  misc_feature: GYAE6OF02FIIWG.29.78.H01.1.454.CMB.1.raw
  modified_base (386)..(386): a, c, t, g, unknown or other
  misc_feature (386)..(386): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaaggggccggttcacctatttccagagacaattcgaagaacacgctgatctgcaaatggagagcctgagactcgacgacacggccgtctattattgtagttaaggcgagctggaagtacgggaccggggccccgacttgacccacgtggggccagggggacnctggtcaccggtctcctcagccctccaaccgacgggcccagtccggtccttccccccgtggccctaccctcccctccgaaacgacgccaccgttccggtcgggggaccaacacggtacccacggtcccccgtggggcctccggtcccgttccggggttacgaaaccgggtaacctttcccgtttaacccgtaacggtttaccccttacgttaaccgttcccgttaacgggtaccggggtaacccgggggtccctaccgggggtaacccgtaaaccggggtcccggaacccgtaaagttacggactacgg

SEQ ID NO: 54700 - DNA, 640 bp, Homo sapiens
  misc_feature: GYAE6OF02IXX2K.29.78.H01.1.454.CMB.1.raw
  modified_base (258)..(258): a, c, t, g, unknown or other
  misc_feature (258)..(258): n is a, c, g, or t
  modified_base (400)..(400): a, c, t, g, unknown or other
  misc_feature (400)..(400): n is a, c, g, or t
  modified_base (410)..(410): a, c, t, g, unknown or other
  misc_feature (410)..(410): n is a, c, g, or t
tcagatagagtactcacgaccggtgctcgatttagtgtgagtagtttggggtttggggagagctctggggagtctgcaccatggctcggaccccactcctcttcctcaccctcctcctccactgcacagggtctctctccagcctgtgctgactcaactccgccctctcgcctctcgcctccgtgggacgctcggacaaggtccacctgtactcgtgagcagtcggacacagctagctacgcagtcgcgttggacacncgagacgaggacggaccgaacggtaccgaccgggtcccttacgttacgtaggactcgaacgaactacaaactaagtcgagtacggaccaagtacacgaacggacgggaacgggggtacgtactccgtagacgtcgtctactnaacgttcacncgtcgtacgcggctaggtcgctacctaccgtacacgtacgttcgccgacctcgaagttccagggctagcgacggtctgtaaccttgttcgtgtaccggaacgtcgggacgtactaccggtacgttcgtaaggtaccgtcggggttaccgtacggggaacccggtaaggtacggtaccccgtaccgtcgggtacggtaccaaccgggttacccaaccggtcccaacctcgg

SEQ ID NO: 54701 - DNA, 604 bp, Homo sapiens
  misc_feature: GYAE6OF02HNWD4.29.78.H01.1.454.CMB.1.raw
  modified_base (375)..(375): a, c, t, g, unknown or other
  misc_feature (375)..(375): n is a, c, g, or t
tcagatagagtactcacgaccggtgctcgatttagtgtgagtagtttgggtttggggtccgagccatggtgcagactccccagagctctcctcctcctccactgcacagggtctctctcccagcctgtgctgactcaatccgccctctgcctctcgccctccctgggaggctcgggtcaaggtcacctgtactctgagcagtgacacagcagctacgccatcgcttggcatcagcaggagccagcacgggcctgttactgatgacagtcaaacaatgaatggcagtcaacgagccgaaagggggcgactcccgtagacttcgcttcctcaacggtctaccgagcgtcgtacgggcctggacgtcgaccgtacctnaacctaagtcctacccgggccttaccgagtcgtacggaagtatcggacggtctagtaactttattactcgtacacggtaccgtgggacctagtcggacttagttccgagggttacgtaccgggaaccgggtaactaagggtccacggttccggtggtaccaaccgtacccgaaacggttccccaacccggttagtaccggttccaaccgtttccgttccgtaccccccg

SEQ ID NO: 54702 - DNA, 757 bp, Homo sapiens
  misc_feature: GYAE6OF02IAPEN.29.78.H01.1.454.CMB.1.raw
  modified_base (183)..(183): a, c, t, g, unknown or other
  misc_feature (183)..(183): n is a, c, g, or t
  modified_base (244)..(244): a, c, t, g, unknown or other
  misc_feature (244)..(244): n is a, c, g, or t
tcagatagagtactcacgaccggtgctcgatttagtgtgagtagtttgggtttggggtctgagagaggagtccacccctgggatcttcaggtgttttcatttggtgatcaggacggaacagagagaactcaccatggagtttgggctgagcgtggtcgtttctagtggcttaattttaaaggngtccagtgtgacgtgcagttggtggagtcgtgggggcgccgtggggacggccggggggtcnctgagacctctccgtgtcgccggtcctcgtaggtaatttaaggttttaggagtacatcgaccagtacgaacgtcgggtcccgccgtaggcctaccggagggggaacggtcgtagggacggttcgggtctacgggtcttaaggttcgggtggtacgtagggttggggtcgccggtactaagttaattagtttaacgcgtacgaacggtacccgtaccggtacgggtaaccggggtcccgttacctaacccgttactttaccggaaagtaaccgtaaacgtaaacgtttaccggaaaacgtaaccgaccgtacgttaagttactaccggtagaacgtaaaggtacggacgtaacgtccgtaggactacgccgaaaccgtaaccggacggtccgttaattagtttagtcgttaaggtaacgtgtacgagttaacggacgggtacccggggacccggtcgtaccggttaacgcccgttagggacccgggccggaagggtccgtacggtcgtacccgg

SEQ ID NO: 54703 - DNA, 688 bp, Homo sapiens
  misc_feature: GYAE6OF02GIB44.29.78.H01.1.454.CMB.1.raw
tcagatagagtactcacgaccggtgctcgatttagtgtgagtagtttggggtttggggagagctctggggagtctgcaccatggctcggaccccactcctcttcctcaccctcctcctccactgcacagggtctctctcccagcctgtgctgactcaatcgccctctgcctctcgcctcccgtgggacggctcggtacaaggtccactgtactcgtgagcagtcggacacacgcacgctacgccatcgcttcggctatcgagcgagacgcagacgaccgggccttcgttatgactgacagtacaacgatgagtggacagtacgacgacggacgggaaggggacggtactcccgtagacgtcgtcttaccgtcgtaccggtctaccgacggtccgttccggtacggggtacctacggacggccttaccctaaaccctcgaacgtaaccgtccgtcccggtacctccgtagtcgtaggaaggttactaggacggtcttaactacgttaacgttacgccgtttaccgaacggttccgggtaacggccttaacgtcgggtacctaagggtttcccggacggtttccggtaacccgggggaacccgggtaccgttaacggtcccgtaaccggtttcccgggtcggtaacccgaaccggtaccccggtaaccggtcccccgtaacccgttacgg

SEQ ID NO: 54704 - DNA, 884 bp, Homo sapiens
  misc_feature: GYAE6OF02JVMG7.29.78.H01.1.454.CMB.1.raw
  modified_base (259)..(259): a, c, t, g, unknown or other
  misc_feature (259)..(259): n is a, c, g, or t
tcagatagagtactcacgaccggtgctcgatttagtgtgagtagtttgggtttggggtctgagagaggagtccacccctgggatcttcaggtgttttcatttggtgatcaggacggaacagagagaactcaccatggagtttggctgagctggtctttttcttgtggtacttaagttttaaaaggtcgttccgagttggtcgacgtgctaggttggtcggagtcgtggggcgccgtgggggtaccgggccggggggtcncgtggacgtacctctccgtgtcggccggccttcgtggtaatttaaggtttaggtagtcgtatcgcctagtacgtaaccggtcgggtcccgaccgacgggtccgtacccggtaaaggggacgggggtcctggggtaaggttccgggtcgttcggacctttagttacgggtcggtacggtagggttgggtacgggccgttaacgttaacgttaaagtttaactttacgggtcggaaccgtaacccgggtaacccccgggtaccccgtaaggggtaaaccggggttccccggggttaccctaaaccccgttagttttaaaccccggaaggtaaccgttaaccggttaaacggttaaaccccggaaaagggttaaaccccgaacccggtacggttaataaccggttaccgtaacgtaaccggtaaaggttaggaaccgtacggtaccggtaggtaaacgaccggttaccggaacggtaaccgtaccgggtacccgttacgttacgtttaacgtttagggtacggttaaacggtaggacgtcgtaaggtaaccggtaccggggaccggtacccggtaccgttcgaaccggtcgggacgggaccggtagggacccgtcggtacggtacccg

SEQ ID NO: 54705 - DNA, 625 bp, Homo sapiens
  misc_feature: GYAE6OF02FQPTZ.29.78.H01.1.454.CMB.1.raw
  modified_base (621)..(621): a, c, t, g, unknown or other
  misc_feature (621)..(621): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccgggcccgacttgaccacgtggggccaggggaccgctggtcaccgtctccctcagccctcaccaagggcccatcggtcttcccccgtcggccaccctcctcccaagacgccgtacctcgtcgggggccacgacgccgacgcccgtacggggcgtcggccgttacggtccgtaacggaaccgttaaccgttaccgaacgttaccttaccgtaacgttcctacggtacggccggggtaccgttcggggaccgtaacggggccggaccgtaacgtcgngtcg

SEQ ID NO: 54706 - DNA, 582 bp, Homo sapiens
  misc_feature: GYAE6OF02FTTN6.29.78.H01.1.454.CMB.1.raw
  modified_base (379)..(379): a, c, t, g, unknown or other
  misc_feature (379)..(379): n is a, c, g, or t
  modified_base (579)..(579): a, c, t, g, unknown or other
  misc_feature (579)..(579): n is a, c, g, or t
tcagatagagtactcacgaccggtgctcgatttagtgtgagtagtttgggtttgggggcgcctgggtacggccggggggtcgctgagactctcctgtgcggcctctggattaagtttaggagtcatgccatgaactgggtccgccaggctccagggaaggggctggagtgggtctcggctattagtggcagtggtggcgctagtatattatgcagacgccctgaagggccggttcaccatttccagagacaattcgaagaacacgctgtatctgcaaatggagagcctgagactcgacgacacggccgtctattattgtgttaaaggcgagctggaatacgggaccgggcccgacttgaccacgtggggccaggggacncgtggtcaccgtctcctcagcctccacacgggcccatcggtccttccccgtggccaccctccctaccaacgacgcaccgtcgtcggggcacgagcacgcccgtagggctcgcctgggtacgaacggtactacgttccagttacctctacgtccgtaggacggtcccggtcgtgggtaccgaacgggccgacgacttacgntcg

SEQ ID NO: 54707 - DNA, 678 bp, Homo sapiens
  misc_feature: GYAE6OF02I3Y57.29.78.H01.1.454.CMB.1.raw
  modified_base (547)..(547): a, c, t, g, unknown or other
  misc_feature (547)..(547): n is a, c, g, or t
  modified_base (675)..(675): a, c, t, g, unknown or other
  misc_feature (675)..(675): n is a, c, g, or t
tcagatagagtactcacgaccggtgctcgatttagtgtgagtagtttgggtttgggggcgcctgggtacggccggggggtcgctgagactctcctgtgcggcctctggatttaagttttaggagtcatgccatgaactgggtccgccaggctccagggaaggggctggagtgggtctcggctattagtggcagtggtggcgctatatattatgcagacgccctgaagggccgttcacctatttccagagacaattcgaaagaacacgctgtatctgacaaagtggagagcctagacgactcgacgacacggtccgtactattattgtaggttaaaggcgtagtcgtaggaacgtacggggcccggggtacccgtacgttcgaacccgtaacggttcgggggacccgtaagggggacccgtcgtcgggtcctacccgtcctcccgtacaccggtcctacccgaaccgaacgggtccccagttcccggttcccttcccccggtcggcctaccccgtcctaccaacgcgacctaccgtcgtcggggaccncgacgaccacggcccgtacgggctcggtcgttcggaccgtaacggtaccgttactaccgtagtaccttcgtaagtccgttaggacggtccggtcgttacgggaccctaagggcccgtacgagttacgnacg

SEQ ID NO: 54708 - DNA, 817 bp, Homo sapiens
  misc_feature: GYAE6OF02GE4XQ.29.78.H01.1.454.CMB.1.raw
  modified_base (141)..(141): a, c, t, g, unknown or other
  misc_feature (141)..(141): n is a, c, g, or t
tcagatagagtactcacgaccggtgctcgatttagtgtgagtagtttgggtttggggcgcctgggtacggccggggggtcgctgagactctcctgtgcggcctctggattaagtttaggagtcatgccatgaactggtccncaggctccagggaagggctggagtgggtctcggctattagtggcagtggtggcgctatatattatgcagacgccctgaaggccggttcaccatttccagagaccaattcgaagaacacgctggtatctgacaaatggaagacgcctgagcctcggacgaacacggccgtcgtaatttcttggtacggtttaaaaggccgtaagccgtaggaaacgttacccgggggaacccggggtcccgtaacgtttcggaacccgtaacgtcggggggtacccaagggggtacctccgttcgggttaccgaacccggttcctacccgtacgaccggtacccttcccgaaaccccggttaaacgggtccccgtaaacgtttcccgggttaaccccgtttccccccgttaacgggcccccgttaaccccgttaccccgttaacccgtaaaccggtaaccgtacccgttaacccggtttaaccgggtccggggggtaaccctaaccggaccgggttaaccaacccgggttccccgttaccggggaccttaccgggtacccggttacgggtaccgtaaaccgggtaaccttacccgttaccgtaacgttacgtacgttaacgttccggtacgaccgggtaccgggtccgtacgggacctaacgggccgtaaccgtaggttcggatcgg

SEQ ID NO: 54709 - DNA, 723 bp, Homo sapiens
  misc_feature: GYAE6OF02HM8PH.29.78.H01.1.454.CMB.1.raw
  modified_base (325)..(325): a, c, t, g, unknown or other
  misc_feature (325)..(325): n is a, c, g, or t
  modified_base (508)..(508): a, c, t, g, unknown or other
  misc_feature (508)..(508): n is a, c, g, or t
  modified_base (517)..(517): a, c, t, g, unknown or other
  misc_feature (517)..(517): n is a, c, g, or t
  modified_base (576)..(576): a, c, t, g, unknown or other
  misc_feature (576)..(576): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgccaggctccagggaaggggctggagtgggtctcggctattagtggcaggtggtggcgctatatattatgcagacgcccgtgaagggtccggttcacctatttccagagacaattcgaaagacacgctgtatctagacaaagtggagagcctagagactcggaacgaccgtaacggcccgtnttattagttgtaagttaaaggccgtaagcgttaggaacggttacccgggggacccggggtccctaagttcgaacccgtaacggcgggggacccagggggtaccgctcggtcctacggtccttccgacacggccctaccgaaccgaacggggaccctacgggttccgttaccccgtttcccccngggtacccncccctttaaccgccgaaaacggccctaccgtacccgtttcgggacggggtacccaacgngaacccgtacgccccggttacggcgtacgtccgttcgggaacgttaaccggttactaacccgttttccgaacgttaccttacttaacggtcgttacggacgggtcggtaacgttcgggacggtaaccggctacctaagttacggagc

SEQ ID NO: 54710 - DNA, 834 bp, Homo sapiens
  misc_feature: GYAE6OF02G0BED.29.78.H01.1.454.CMB.1.raw
  modified_base (830)..(830): a, c, t, g, unknown or other
  misc_feature (830)..(830): n is a, c, g, or t
tcagatagagtactcacgaccggtgctcgatttagtgtgagtagtttgggtttgggggcgcctgggtacggccgggggggtcgctgagactctccgtgtgcgggcctctggattaacgttttaggagtcatgccatgaactgggtccgccaggctccagggaagggctggagtgggtctcggctattacgtgcagtggtggcgctatatattatgcagacgcctgaagggtccgttcaacctatttccagacgacaattcgaagaacacgctagtatctgactaagtggagagcctgagactcgacgacacggtccgtactagttacttggtaggttaaaacggcgtaacgtcgtagggaaccgttaaccgggggacccgggggacccccgtacgtttaccggacccgtaaccggttcgggggggacccgtaacgggggggtaccgccgtttacggggtaccctaaccccggttccttaccccgttacgaaccgggttccccttaccccgaacccggtaaaccgggggtcccctaaacggttccccggggtttacccctttcccccccggttacgggtacccctaacccccgttaccccgttaaacccggaaacggtaccgtacccgttaaccccgtttaccggggtacccggggggtaccctaaccggccggaacccggtaacccgcccccggttccggggtaccctcgggtacccggttacgggttacccgaaacgggtaccctttaaccgttacccgtaacgttacccttacgttaccgtcgtacggtacggtcggcgtacgggacgtacgggaccgtagtacgtgntacg

SEQ ID NO: 54711 - DNA, 671 bp, Homo sapiens
  misc_feature: GYAE6OF02IVWOF.29.78.H01.1.454.CMB.1.raw
  modified_base (238)..(238): a, c, t, g, unknown or other
  misc_feature (238)..(238): n is a, c, g, or t
  modified_base (346)..(346): a, c, t, g, unknown or other
  misc_feature (346)..(346): n is a, c, g, or t
  modified_base (466)..(466): a, c, t, g, unknown or other
  misc_feature (466)..(466): n is a, c, g, or t
tcagatagagtactcacgaccggtgctcgatttagtgtgagtagtttgggtttgggggggagagaggagtccacccctgggatcttcaggtgttttcatttggtgatcaggacggaacagagagaactcaccatggagtttgggctgagctggctttttctgtggctatttaaaaggtgtccagtgtgacgtgcagttggtgagtctgggggcgcctggggtacggccgggggggtcncgtgagactctcctgtgcggcctctggattaagttttaggagtcatgccatgaacgtgggtccgccaggctcgagggaagggctggaggtgggtctcggctagttagnggcagtggtggcgctatatattatgacagacgccctaggaacgggtccggttacaccctatttccaagtacgtaacaagttacgaaacgaaacgaacgcttagttatctagactaaaagngggaagacgtcccgttagaacgtaacctcgggaaccgaccggtacggtccccgttacgtttaagtttacgtttagggttacgtttaaaagggccggtaagtacgttagggaacgttacgggggaacccgggggcccgttaaccgttacgacccgtacgggtcggggacccgagggggaccgtcggtcggttacccgacccgtccg

SEQ ID NO: 54712 - DNA, 694 bp, Homo sapiens
  misc_feature: GYAE6OF02GIQBL.29.78.H01.1.454.CMB.1.raw
  modified_base (687)..(687): a, c, t, g, unknown or other
  misc_feature (687)..(687): n is a, c, g, or t
tcagatagagtactcacgaccggtgctcgatttagtgtgagtagtttgggtttggtggtctctctcccagcctgtgctgactcaatcgccctctgcctctgcctccctgggaggctcggtcaaggtcacctgtactctgagcagtggacacagcagctacgccatcgcttggcatcagcagagccagacacgggccctcgttacttgatgacagtcaacaatgatggcagtcacaggcgaaagggggcggactcccgtgatcgccttctcgagttcctccgagcctcgtcgggcctggacgcgtcctaccgtacactaacgttcctcccggaccctccgacgtcgtacggacggtatcgggacggtactacgtaacttacttaacgttcgtaccgaacggtacccggtacgggggtccaacggttggtacctacgtttacgacgggttcccgttaccggggaacccgggggtaacctaaacgggtcccgtaacccggttcggttacccggtacgaccggtaccccgaacggacccctaaccccgtcgtccgtacctaccgttcccgttaccgttacccccgtacccttcccgtaccgtaccggttacccttacgttacgtaccgttcgggtaccgggtaccgggtaccgtaccggacggtaacccgggtccgtacgtaacggtacgngccgtag

SEQ ID NO: 54713 - DNA, 629 bp, Homo sapiens
  misc_feature: GYAE6OF02FUXIZ.29.78.H01.1.454.CMB.1.raw
  modified_base (627)..(627): a, c, t, g, unknown or other
  misc_feature (627)..(627): n is a, c, g, or t
tcagatagagtactcacgaccggtgctcgatttagtgtgagtagtttgggtttgggggcgcctgggtacggccgggggggtcgctgtagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattggtgttaaaggcgagctaggaataccggggaccggggcccgacgttcgacccgacgtcgggggaccagggggaccgcgtcgggtccaccggtcctccctcgacggccctcccgaaccgaacgggccccagtccggttccctttccccccgtggccctacccctccctacccgaacgacgccaccgtcgtcggggccacgcgcgacgcccgtgggcctcgcccgtcggtacgaacgtacctacgttcccgagtaccttcgtactcgtggacggccgggtcgtacgggcgaacgggccgacgacgtaggncg

SEQ ID NO: 54714 - DNA, 730 bp, Homo sapiens
  misc_feature: GYAE6OF02I7H5X.29.78.H01.1.454.CMB.1.raw
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaagggctggagtgggtctcggctattagtggcagtggtggcgctatatattatgcagacgccctgaagggccggttcaccatttccagagacaattcgaagaacacgctgtatctgcaaatggagacgcctgagactcgacgacacggccgtctattacttgtagttaaaggcgagctaggaataccggggaccgggcccgacttcgacctacgtcgggggccaggggaccgcgtcggtacaccgtcctcccgtcacgtcccctccaaccgaacgggccccagtcccgggtcctttacccccccgtggccctaaccccctcccgttacccgaacggaccgcccgtaacccttcccgggttcggggggcccaacccgacggacccgtaacccgggccccggtttccgggggtaccttccgggtccccggttaacgggttacccgaaacgggggttaacccctttaaccgttaccccgttaagggtttcccctttacgtaaccgttccgtacgggaaccggggtcccgggtacgttacggggacccgaagggttccccgacctaaggtacgcgc

SEQ ID NO: 54715 - DNA, 592 bp, Homo sapiens
  misc_feature: GYAE6OF02G3M8N.29.78.H01.1.454.CMB.1.raw
  modified_base (592)..(592): a, c, t, g, unknown or other
  misc_feature (592)..(592): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccaggggaaggggctggagtggggtctcggctattagtggcagtggtggcgctatatattatgcagacgccctgaagggccggttcaccatttccagagacaattcgaagaacacgctgtatctgcaaatggagagcctgagactcgacgacacggccgtctattattgtagttaaaggcgagctaggaagtacggggaccggggcccgacgttgaccacgtggggccgaggggacgcgtggtcaccggtctccgtcacgcctcccgacgaacggcccactccggtccttcccccgtcgcctaccctccctaccaacgaccgccacctcgtcggggcacgcgacgacgcccgtacgggctcgccgtcggtacgaacggtacctaccttccacgtactactagtctggacggtcgggtctcggacgacggcgacgatacgn

SEQ ID NO: 54716 - DNA, 670 bp, Homo sapiens
  misc_feature: GYAE6OF02HIDFH.29.78.H01.1.454.CMB.1.raw
  modified_base (666)..(666): a, c, t, g, unknown or other
  misc_feature (666)..(666): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcacctatttccagagacaattcgaagaacacgctgtatctgacaaatggagagcctgagactcgacgacacggccgtctattattgtagttaaaggcgagtctaggaagtacggggaccggggccctacgttcgaccgtacgtcgggggccgaggggaccgtcgtggtccaccggtctcccgtacacgccctaccgaaccgaacgggccctaacgtcccggttcctttccccccgtggaccctacccgttccctacccgaacgaccgcctacccgtccggtcggggtaccacgtacgccgtacggcccgtcgggcctaccgtccgttacgggtaccgtaacggtaccttaaccgttaccgacgttaccgtaccttacgttcgtacggacggtccgggtacgacgggtacgtaacgggccgacgtacgtagntacg

SEQ ID NO: 54717 - DNA, 634 bp, Homo sapiens
  misc_feature: GYAE6OF02GXN1N.29.78.H01.1.454.CMB.1.raw
  modified_base (218)..(218): a, c, t, g, unknown or other
  misc_feature (218)..(218): n is a, c, g, or t
  modified_base (243)..(243): a, c, t, g, unknown or other
  misc_feature (243)..(243): n is a, c, g, or t
  modified_base (457)..(457): a, c, t, g, unknown or other
  misc_feature (457)..(457): n is a, c, g, or t
tcagatagagtactcacgaccggtgctcgatttagtgtgagtagtttgggtttggggtctgagagaggagtccacccctgggatcttcaggtgttttcatttggtgatcaggacggaacagagagaactcaccatggagtttgggctgagctggctttttcttgtggctattttaaaaggtgtccagtgtgacgtgcagttggtggagtctgggggcncctggggtacgggccgggggggtcnctgagactctcctgtgcggcctctggatttaagttttaggagtcatgccatgaactgggtcccgccgaggctcccgaggggaaggggctgggaggtgggtcgtcggctagttaggtggctaggtgggtggcgtctatatattatgcagacgccctaggaacgggtccggttacacctatttccgaagagaactaagttcgaaagaacacgcgtntatctagactaaagtggggacacgtgacgctacggacgaccgacggtccgtacttagttagttgtaagttaaacggcgtaggtcgtagggaacggtacccgggggacccgggtacccgtacgttcggacccgtacggtcggggaccgagggggaccctcggttcggtacctacccgg

SEQ ID NO: 54718 - DNA, 731 bp, Homo sapiens
  misc_feature: GYAE6OF02IY3KQ.29.78.H01.1.454.CMB.1.raw
  modified_base (243)..(243): a, c, t, g, unknown or other
  misc_feature (243)..(243): n is a, c, g, or t
  modified_base (265)..(265): a, c, t, g, unknown or other
  misc_feature (265)..(265): n is a, c, g, or t
  modified_base (278)..(278): a, c, t, g, unknown or other
  misc_feature (278)..(278): n is a, c, g, or t
  modified_base (281)..(281): a, c, t, g, unknown or other
  misc_feature (281)..(281): n is a, c, g, or t
  modified_base (342)..(342): a, c, t, g, unknown or other
  misc_feature (342)..(342): n is a, c, g, or t
tcagatagagtactcacgaccggtgctcgatttagtgtgagtagtttgggtttggggtctgagagaggagtccacccctgggatcttcaggtgttttcatttggtgatcaggacggaacagagagaactcaccatggagtttgggctgagctggtcttttctgtggctaattttaaaaggtgtccagtgtgacgtgcagttggtggagtcgtggggcgccgtggggtacgggccggggggtcnctggagctctcgtgtgcgctcnggtattagtttgngtnatgcatgactcggtcgcaggctccgagggagggctggagtggtctcggctagttgtggacnggtggtggcgtactagttattaattctgacgacgacccgtacccggtaggaacggggtccgtttacctacccgtaacgttttaccgaaggaacgtaaaccgtaagttaaccggaaacgtaaacccgaacgtccgtaacggttactacgttacgtaacgaaaagttcgggaagtaccgtcgtaggaacgtaccggtaaccgaaccggaccggtaccggtacccgtttacgtttaacgtttagttttacggtaaacggttaaacgggacgtacggtaccgttaacggggtaaaccgggtacccgggggaacccgggtcccggttaaccgtaccgtaaccggtaccgggtacggggtaaccgacgggggtacctcgggtcccgtaacccggg

SEQ ID NO: 54719 - DNA, 611 bp, Homo sapiens
  misc_feature: GYAE6OF02I49HC.29.78.H01.1.454.CMB.1.raw
  modified_base (315)..(315): a, c, t, g, unknown or other
  misc_feature (315)..(315): n is a, c, g, or t
  modified_base (392)..(392): a, c, t, g, unknown or other
  misc_feature (392)..(392): n is a, c, g, or t
tcagatagagtactcacgaccggtgctcgatttagtgtgagtagtttgggtttggggtccgagccatggtgcagactccccagagctctcctcctcctccactgcacagggtctctctcccagcctgtgctgactcaatcgccctctgcctctgcctccctgggaggctcggtcaaggtcacctgtactctgagcagtggacacagcagctacgccatcgcttggcatcagcagaggccagacacggcctgttactgatgacagtcaacaatgatggcagtcacgagcgaaggggacggatccgtgatcgcttcngtacgtcctacacgtctcgtggcctgacgccgtcctacgtccaacagtccctccggcctcgacggttctggaacggntggacgtcctaggtaactttaattaccgtgtacgtacggtaccggtggggtactaacgttggacgttaacgtttcggaacgggtttccgtacccggggaccggggaacctaagggtcccgtaaccggttcggtcccggtacgaaccggtaccccggtaacggtacccccaaacccgttggttacccgaccctaacgtttcccgtccgtttaaccccccg

SEQ ID NO: 54720 - DNA, 617 bp, Homo sapiens
  misc_feature: GYAE6OF02IXTS9.29.78.H01.1.454.CMB.1.raw
  modified_base (505)..(505): a, c, t, g, unknown or other
  misc_feature (505)..(505): n is a, c, g, or t
  modified_base (537)..(537): a, c, t, g, unknown or other
  misc_feature (537)..(537): n is a, c, g, or t
  modified_base (544)..(544): a, c, t, g, unknown or other
  misc_feature (544)..(544): n is a, c, g, or t
tcagatagagtactcacgaccggtgctcgatttagtgtgagtagttttgggtttgggggcgcctgggtacggccggggggggtcgctgagactctcctgtgtggcctctggattaagttttaggagtcatgccatgaactgggtccgccaggctccaggggaaggggctgggagtgggtctcggctattagtggcagtggtggcgctatatattatgcagacgccctggaacgggccgttcacctatttccagagacaattacgaaagaaacgctgtatctgcaaatggagagcctgacgactcggacgacgaccggtccgtacttaagtttatttggttaggtttaaaacgggcggaggtccgtaggggaaagtaacccggggggacccggggcccgtaacttcggaccacggtcgggaccgacgggggacgcgtggtaccaccgtctcctacacgcctaccaccacgggccctagtccggtcctccccgtcgcctaccctccnccaagccgcgacctcggtcggggcacgacgcncgcccgnggctcgctggacacggtactctaccagtctctatctggaccggcggtgcggacgtacggccacgagtacgagc

SEQ ID NO: 54721 - DNA, 769 bp, Homo sapiens
  misc_feature: GYAE6OF02GIKYN.29.78.H01.1.454.CMB.1.raw
  modified_base (765)..(765): a, c, t, g, unknown or other
  misc_feature (765)..(765): n is a, c, g, or t
tcagatagagtactcacgaccggtgctcgatttagtgtgagtagtttgggtttggggggcgcctgggtacggccggggggggtcgctcgaggactctcctgtgccggcctctggattaagttttaggagtcatgccatgaactgggtccgccaggcctccagggaagggctggagtgggtctcggctattagtggcagtggtggcgctagtatatatgcagacgtcctgaagggccggttcaccatttccagtagacaattcgaagaacacgtctgtatctagacaagtggagacgcctagacgtactacgacgtacgacggtcgtacgtattacgttacggtaggtaacggcggtagtcgtacggtaacggtaaccggggacccgggtacccgtacgttacgaccgtacggtacggggaccggacggggaccgtaccggtacggtaccgtacccggttaccgtcccgtacgaccgtaccctacccgaacccggaaccgggtacccgtacgttcccggttccccgtttaccccggtacggtacccgtacccgttaccgtaaccgtaacggaccgaccgtaccggttccgggtacggggtaccacgacggtaccgtaccggtcccggtaccgggtaccgtaccgtaccggttacgggaccgtaaaccggtaccttaaccgttacccgtaacgttaccttacgtacgttacggtaccggtaacggtaccggtaccgtacggtaccgtacggtccgacgtacgtacgngtcg

SEQ ID NO: 54722 - DNA, 674 bp, Homo sapiens
  misc_feature: GYAE6OF02HV8OS.29.78.H01.1.454.CMB.1.raw
  modified_base (413)..(413): a, c, t, g, unknown or other
  misc_feature (413)..(413): n is a, c, g, or t
  modified_base (670)..(670): a, c, t, g, unknown or other
  misc_feature (670)..(670): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctggaagggccggttcacctatttccagagaacaattacgaagaacacgctgtatctgacaaaatggagacgccttagagactacgacgacaccggccgtcttatttatgtagttaaagcgagctggaagtacgggaccggggcctacgttcgaccacgtggggccgagggggacgcgtcggtccaccgtcncctacacgccctccaccgaacgggccctacgtccggttcccttcccccgtcggccctaccctccctaccgaacggacacccgtacccgtccggtcggggaccaacgacgccgacggcccgtcgggtccgtcgccgttacgggtaccgaaacggtaacccgttacccgttaccgtacgttacccgttccgtaaccgttccgtaacggtacggtaccgggaccgtaggaaccggaaccggtaccggacgtaacgtcggngtcg

SEQ ID NO: 54723 - DNA, 764 bp, Homo sapiens
  misc_feature: GYAE6OF02G9J2J.29.78.H01.1.454.CMB.1.raw
tcagatagagtactcacgaccggtgctcgatttagtgtgagtagtttgggtttggggtctgagagaggagtccacccctgggatcttcaggtgttttcatttggtgatcaggacggaacagagagaactcaccatggaggtttgggctgagctggtctttttcttgtggcttaagttttaaaaggtgtaccagtgtgacgtgcagttgggtggagtcgtggggggccgccgtgggggtaccgggccggggggtcgcgtgagactctccgtgtgccgcctctggattaagtttggagtcatgcatgaactgggtccgcgagctccgagggaagggcgtggaggtgggtctcggctagttaggtgcgagtggtggcgtctattattattagtgcgagaccgtcccgtaggaacggggtcccggttcctaaccctacgtttaccgaagacgaactaaacgtttaccggaaaagaacctacgtacttagttacttaccagtaacaaaggttacgggaaggaacgtcccgtaggaacggacctaacggaaccggaccgtacccggtacccggttaacttaacgttttaagttacggttaaacgggtttaaaacgggaccgtacgggtaaccgttaagggtaaacccggggttaacccggggggaacccccggggtacccgtaaccggtttaaccggacccggtaacccggggttcgggggaccccgggtaaacgggggacccgttacccgggtacgggttaacccccgg

SEQ ID NO: 54724 - DNA, 745 bp, Homo sapiens
  misc_feature: GYAE6OF02IZE16.29.78.H01.1.454.CMB.1.raw
  modified_base (741)..(741): a, c, t, g, unknown or other
  misc_feature (741)..(741): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgccaggctccgagggaagggctggagtgggtctcggctattagtggcagtggtggcgctattatattatgcagacgccctggaacgggccggttcacctatttccagagacaattacgaagaacacgctgtatctgacaaagtggagacgcctgagactcgacgaccgaccggtccgtattaatttagttagtaggttaaagggcgtaagtcgtaggaacgtaccggggacccgggtcccgacgttcggacccgtaacggtcggggccgaacgggggaccgtcgtacggtaccgtaacccggttcctccctccgacggtccccctacccgaaccgaccgggacccctacggttacccggttcccctttccccccgtcgggacccctaccccgtaccctacccgtaacgtccgacccgtaaccgttccggtcgggggccaaccgtacggaccgaccggccccggtacgggtccgtccgggtccgttacggtaaccggtaaacggtacccgttaccttacccggtacgttaccttaccgttaacggttctacgggtacggtccgggtacgtaccggaccgtaacgggccgtacacgtagntacg

SEQ ID NO: 54725 - DNA, 669 bp, Homo sapiens
  misc_feature: GYAE6OF02FRBEX.29.78.H01.1.454.CMB.1.raw
tcagatagagtactcacgaccggtgctcgatttagtgtgagtagtttgggtttggggtctgagagaggagtccacccctgggatcttcaggtgttttcatttggtgatcaggacggaacagagagaactcaccatggagtttgggctgagctggctttttcttgtggctattttaaaaggtgtccagtgtgacgtgcagttggtggagtcgtgggggcgccgtggggtacgggccgggggggtcgcgtgagactctcctgtgcggcctcgtggatttaagtttaggagtcatgccatgaactcgggtcccgccgaggctccgaggggaggggctggaggtgggtcgtcggctagttaggtggcaggtgggtcggcgtcgtaatattaatttagtggccaagggacccgtcccgttagggaaccggggttcccggttaccaacccgttacgttttacccgaaggtaacgtaacctaaagttaccgaaaacggtaacccgacgtcgtagtatacgtagactaaagttggaagtacgcgtagacgacgtacgacgacgaccggtctacgttattagttacgtaggttaaggcgtagtcgtaggaacgtaccggggaccgggacccgtacgttcgaccgtcggtcgggaccggagggaccgtcgtcggtcccg

SEQ ID NO: 54726 - DNA, 757 bp, Homo sapiens
  misc_feature: GYAE6OF02G1V4G.29.78.H01.1.454.CMB.1.raw
  modified_base (754)..(754): a, c, t, g, unknown or other
  misc_feature (754)..(754): n is a, c, g, or t
tcagatagagtactcacgaccggtgctcgatttagtgtgagtagtttgggtttggtggtctctctcccagcctgtgctgactcaatcgccctctgcctctgcctccctgggaggctcggtcaaggtcacctgtactctgagcagtggacacagcagctacgccatcgcttggcatcagcagaggccagacacgggcccttcgttacttgatgacagtcaaacaatgatggcagtcacaggacggaaggggggacggactcccgtagacgtccgcttctcacgtcctccgagcctcgtgggcctggacgccgtcctaccctacaacaacttcccgtccccgggccctaccgacggttcgtaggaacgggtactaggaacggtccttagtaactttacgttaaccgtggtacccgaacggtacccggtacgggggacctacggttcgaccgtttaacgttttccgggacggggtttacccggttaccggggggaaccccgggggtaaccgtaaaccggggttccccgtaacccggggtttccggttacccgggtacccggaaccggaacccccggaaaacgggtaccccccctaaaaccccggtacttccggaccctaccgtttcccgtttaccccggtttaaccccctaccctttccctaaccgttaaccgttacccttacgttaacgttcccggttagggaccggtacccggggtctccgggggactaacggggcccgtacgttaaggacgctnacg

SEQ ID NO: 54727 - DNA, 593 bp, Homo sapiens
  misc_feature: GYAE6OF02G0HF6.29.78.H01.1.454.CMB.1.raw
  modified_base (378)..(378): a, c, t, g, unknown or other
  misc_feature (378)..(378): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacacacggccgtctattattgtgttaagcgagctggaactacgggaccggggcccgacttgaccacgtggggccaggggcncgtggtcgaccgtctccctcacgccctccaccgaacgggccctagtccggtccttcccccgtggcccgccctcgcctcccgacggcgaccgtaccctaccggagacgccaccgacgcccggcccgtagggctcggccgtcgggtacaacggaccttaccttccgacgttacctctactcttaggcgcgggtctcggacgaacggcgacagtagcg

SEQ ID NO: 54728 - DNA, 897 bp, Homo sapiens
  misc_feature: GYAE6OF02I83P0.29.78.H01.1.454.CMB.1.raw
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgccaggctccgaggggaagggctggagtgggtctcggctattagtggcagtggtggcgctatatattatgcagaccgcccgtaggaacgggccgttacacctatttcccgagaagactaattcgaaacgaacacgctagtactctgacaagtggagacgctgacgactcgaacacgaccggctactattagttgtagtaaaggcgacgtgtacggaaacggtaccggggacccgggtaccccgtattacgaacccgacgggttccgggggaccggaagggggtaacccgccgtttcgggtcccgtaacccgttcgtccctacgaccggttaccccctacccgaacccgggtaaccgggaccccgttacggtaccccgggtttccccctttccccccgggtaccggttaccccttacccccgttacccggttaacccggtaaaacggtcccgaacccgttaacccggtttccggggtaccgggggaaccctaacccgaaccgggaaccgtaccccgggtccccggggttaacccgggtcccggttaaccggggtccccgggttaaccggggtttaaaccgtaaaccccggggggttaaccccttttaaaccccggttaccggttaaacccccgggtttaccctttaacccggttaacccggtttcggtaacccgggttaaccgggggccggggtttaacccggacgggtaacccggtaacggggacccggttaggaacccgtttaggactaccgg

SEQ ID NO: 54729 - DNA, 792 bp, Homo sapiens
  misc_feature: GYAE6OF02IBAXJ.29.78.H01.1.454.CMB.1.raw
  modified_base (468)..(468): a, c, t, g, unknown or other
  misc_feature (468)..(468): n is a, c, g, or t
  modified_base (788)..(788): a, c, t, g, unknown or other
  misc_feature (788)..(788): n is a, c, g, or t
tcagatagagtactcacgaccggtgctcgatttagtgtgagtagttgggtttgggggcgcctgggtacggccgggggggtcgctgagactctcctgtgcggcctctggattaagttttaggagtcatgccatgaactgggtccgcaggctccgagggaagggctggagtgggtctcggctattagtggcaggtggtggcgctatatattatggcaggtaccgcccgtagggaacgggtcccggttacacctattttacccaggagtaacaattcggaaagactacggtcctagtactctcgactaaaatcgggaagacgccgtagaacgtaaccgtcggaacggacgacccggtcccgtacttactttagttagtaggttaaaggccgtagcggtaggtaaagtcccggggggaaccccgggcccggtagttcgaaacccgcggtacgggggacctaaggggggtccncggtcggtaccgacccgggttcccgtacctccgtaacgcccccgtacccgaaccgggtaacccgggacccgtacgttacccggttccccgttcccccggtccgtccgtaccccctacccgtacccgtaacgaccgtaccctaccggtacccggttcggggaccaaccgtacggaccggaccggtccccggtacgggtacctcgggtcccgtacggttaccggaaccggtaccttaccgttacccgtaccttaccgtaccgttacgtccgtacggtacgggtcggtccggtagggaccggtacgggccgaacgtcgtacgngacg

SEQ ID NO: 54730 - DNA, 708 bp, Homo sapiens
  misc_feature: GYAE6OF02I5F9M.29.78.H01.1.454.CMB.1.raw
tcagatagagtactcacgaccggtgctcgatttagtgtgagtagtttggggtttggggagagctctggggagtctgcaccatggctcggaccccactcctcttcctcaccctcctcctccactgcacagggtctctctcccagcctgtgctgactcaatcgccctctcgcctctcgccctcccgtgggaggtccgtcggtcaaggtccacctgtactctgagcagtggacacgagacagcctacggccctagtccgtcttggcatccgagcaggacggccgaagaccggacccgggtccccttcgtttacgttagatagaacgagtaccgaaacaagtggtacgtcgggctaacgtacgtaacgacggacggtaacggggggaacgtacctcccgtagtacgtccggtccttaccgtaccgtacgttcctaccgtacgtaccgttcggtccgggtaccttacggacgtcccgtaccttacctacgaacctcctacccgtcccgggttacctccgtacgttccgaggtaggtatcggtacgtcgtcgtaaccttacgtttacgtggtaaccgtacggtaccggtcggtactacggttacgcgttaaccgttccggacggtttccgggtaccgggaacccgggtaccgtaacggtcccgtaccggttcggtaccggtacacccggtacccgacgtaccccgtacctaccg

SEQ ID NO: 54731 - DNA, 748 bp, Homo sapiens
  misc_feature: GYAE6OF02H829L.29.78.H01.1.454.CMB.1.raw
tcagatagagtactcacgaccggtgctcgatttagtgtgagtagtttgggtttggggggcgcctgggtacgggccggggggggtcgctgagactctcctgtgcggcctctggattaagttttaggagtcatgccatgaactgggtccgcaggctccagggaaggggctggagtgggtctcggctattagtggcaggtggtggcgctatatattatgcagaccgccctaggaacgggccggttcacctactttccagacgactaattacgaagaacacgctgtatctgacaaagtggaagtcgcctagagtactcgaccgaacacggcccgttacttaagtttatttgtaaggttaaacggcggagcgtagggtaacgtacggggaccgggtccccgtacgttacgaccacggtcggggccgaagggggcgctacgggttccaccggttcacccgtcgacgtcccctaccgaacccggaacgggacccctacggtcccggtttccccgtttcccccggtcggtaccccctaccccgtccctaaacccgaacgtaccggacctacccggttcggaccggggggacctacccgaacgccggtacccggtaccggtccgggtccgtaccggtcccgttacggggtacccaaacggggtaccttaacccgttaccgaccttacccgttcttacgtcgtcgggacgggtcgggtaccgtacgggaccgtaccgggacgtcccgaagtacgtcgc

SEQ ID NO: 54732 - DNA, 679 bp, Homo sapiens
  misc_feature: GYAE6OF02HK9CA.29.78.H01.1.454.CMB.1.raw
tcagatagagtactcacgaccggtgctcgatttagtgtgagtagtttggggtttgggggaggagctctggggagtctgcaccatggctcggaccccactcctcttcctcaccctcctcctccactgcacagggtctctctcccagcctggtgctgactcaatcgccctctgccctcgtcgcccttcccgtggggacgtccgtcggtcaaacgggtccaaccgtgtaacctctggagcagtcggacacagcagcctaacgccgatcgcttggcatcagacagacggccaaggaccgccggtccctcgttacgttcgagtacgaacgtacgtacaaactaacgtagactgggacctacgtacgaacgtacggaacggaaacgggggtacgtacgtcccgtagtacgtcgtaccttctacgtacgtctaccgagtccgtcggtacggtacctggaacgtcctacccgtaacctcgtaaacctcgtcccgtcccgggaccctcgtaacggtcctaggtaacggtactacgggtaccgttactacgttacgtaacgttcgtacgtacgacgtaacggtcggtacctagtcgacgttagtccggtaggtaccgtaccgggtaacggaaccgtacgtacccgacggttcgtacgaccgaccgcccgtaacggtacccctaacctcg

SEQ ID NO: 54733 - DNA, 682 bp, Homo sapiens
  misc_feature: GYAE6OF02GIYDC.29.78.H01.1.454.CMB.1.raw
  modified_base (679)..(679): a, c, t, g, unknown or other
  misc_feature (679)..(679): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaacgggccggttcacctatttccagagacaattcgaagaacacgctgtatctgacaaatggagacgctgagactcgacgacacggccgtctattattgtagttaaaggcgagctaggaagtacgggaccggggcccgtacttgaccacgtggggccgaggggacgcgtcggtcaccgtcgtcctcgacgtccctacccaccgaacgggcccgtacgtccggtttcccttcccccgtccggtaccctacccctcccttacccgaaacgacgaccgtaacccgttcggtcgggggtccaaccgacgacccgacgccccgtcggggtaccgtcggtcccgttcggtaccgtaacggtaaccgttacccttacccgtacgttacccgttaccgttacgttccggtaggtaccggccgggtaccgtcgggaacggtaacggggccaccggtacgtacgtnacg

SEQ ID NO: 54734 - DNA, 701 bp, Homo sapiens
  misc_feature: GYAE6OF02J2HBD.29.78.H01.1.454.CMB.1.raw
  modified_base (397)..(397): a, c, t, g, unknown or other
  misc_feature (397)..(397): n is a, c, g, or t
  modified_base (538)..(538): a, c, t, g, unknown or other
  misc_feature (538)..(538): n is a, c, g, or t
  modified_base (675)..(675): a, c, t, g, unknown or other
  misc_feature (675)..(675): n is a, c, g, or t
tcagatagagtactcacgaccggtgctcgatttagtgtgagtagtttgggtttgggtccgagccatggtgcagactccccagagatctcctcctcctccactgcacaggtctctctcccagcctgtcgctgacctacaagtccgcccttctcgtcctctcggcctccgtgggcgcctcggtacaacggtcaccttgtacctctaggcgcgtaaggtcgaaccagacggcctagtccgtaccgcccgtagttcccgtcgttcggactaccgtcgacgcgaacggcggccaaacggtccgaccggtcccttagtaccgtgagtcgactagacaaacagtgagtgacagcaggagtaccggtaaagggggcctactcccgtaatccgtcggtactaccgngtaccgtaccgtccacggttcgtaaccggtcggcctaacggggctcccgttacccttaacacccgtaacttacccggtaacccgtttccccggacctttaccgtacgtacgttagggacgacgtcgtaacggccggttaanaccgtttagtacgtccgtagtccgggtaccgtcgggacctacgtcggtactacggtcgttaaccgggtccggtaaccggaccgacgtacggtaccgcggttcggcgttaccgacgttaccgaccgacctacccgtcnccgtaacctctacccgtccttacccg

SEQ ID NO: 54735 - DNA, 756 bp, Homo sapiens
  misc_feature: GYAE6OF02IXQUR.29.78.H01.1.454.CMB.1.raw
tcagatagagtactcacgaccggtgctcgatttagtgtgagtagtttgggtttggggtccgagccatggtgcagactccccagagctctcctcctcctccactgcacagggtctctctcccagcctgtgctgactcaatcgccctctgcctctgccctcccgtgggaggctcggtcaaggtcacctgtactctgagcagtggacacagcagcctacgccatcgcttggcatcagcaggacgccagaccaccgggcccttcggttacttgatcgacagtacaactaataggatcgggacagtaccacgaacgggacgggtaaacggggggaccggtactaccccgttggaacttccggtacctttccggtactacggtacctcccgagtccttcggtcgggtacctagacgtcccgacgttaaccctcctaacgtaacgtcccgtaccccggtccccgttaccgacgtttcgacggtaaggtaacggtcggtaaccgggtctttacgtaacgttttacgttaccgttacggaccgtaccggtaccggggtcggggacccttacgggtacggtcttaaggtttccgttaaccggggtttcggttaaccccggggtaaccggggaacccgttaaccggggtccgtaccggtttacccgggtcggtaacccgaccggtaaaccccgaacccgggtaccccctaacccccggttgtttaacccggtcctacccgtttacccggttccctttacccccccgg

SEQ ID NO: 54736 - DNA, 586 bp, Homo sapiens
  misc_feature: GYAE6OF02GHPET.29.78.H01.1.454.CMB.1.raw
  modified_base (584)..(584): a, c, t, g, unknown or other
  misc_feature (584)..(584): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctaggaatacggggaccggggcccgacttgaccacgtggggccagggggacgctggtcaccgtctcctcacgcctccaccgaacgggcccagtcggtcttcccccgtggccaccctccctaccaacgacgcctaaccgtcgtcgggggaccacgacgccacgcccgtcgggctcgccgtggttccgaaaggaccgtactcctagtacctctactctcggacggcgggtctcggacgacgggccgacacgtgncg

SEQ ID NO: 54737 - DNA, 666 bp, Homo sapiens
  misc_feature: GYAE6OF02HZ21R.29.78.H01.1.454.CMB.1.raw
  modified_base (399)..(399): a, c, t, g, unknown or other
  misc_feature (399)..(399): n is a, c, g, or t
tcagatagagtactcacgaccggtgctcgatttagtgtgagtagtttgggtttgggggcgccgtgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccgttcaccatttccagagacaattcgaaagaacacgctgtatctagcaaaagtggagagcctgagactcgacgacacggccgtctattattgtagttaaaggcgagcgtggaagttaccggggaccgggccccgtacgttacgaccacgtcggggaccagggggaccncgtggtccaccggtctccgtcacgccctacaccgaacggcccactccggtccttcccccgtcggcctaccctccctaccgaacgacgcctaacccgtcgtacggggtccaacgacgaccgacgtacccgtcgggacctcggtacccgttacgggtaccgaacggtaaccgttaccgttacccgtaacgttacccgttacgttacgtccgtacggacggtaccgggtccgtacggtacggaacgggccggtacgtacgtacgtagacg

SEQ ID NO: 54738 - DNA, 661 bp, Homo sapiens
  misc_feature: GYAE6OF02G92C1.29.78.H01.1.454.CMB.1.raw
  modified_base (659)..(659): a, c, t, g, unknown or other
  misc_feature (659)..(659): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtagttaaaggcgagctggaatacgggaccggggcccgacttgaccacgtcgggggccagggggaccgcgtcggtcacccggttcctcctcgacgtccctcccaaccgaacggggcccacgtccggttccctttccccccgtggccctaccccgtccctacccgaacgtaccgccacccgtccggtacgggggccaaccgacggccacggtccccggtcgggccttacggcccgtggtaccgaaccgggtaccttacccgttaccgtacgttaccttactacgttcgttacggacgggtccgggtacgttcgggaccggaacggtccggacgtacgttagncg

SEQ ID NO: 54739 - DNA, 678 bp, Homo sapiens
  misc_feature: GYAE6OF02H3178.29.78.H01.1.454.CMB.1.raw
tcagatagagtactcacgaccggtgctcgatttagtgtgagtagtttgggtttggggtctgagagaggagtccacccctgggatcttcaggtgttttcatttggtgatcaggacggaacagagagaactcaccatggagtttgggctgagctggctttttcttgtggctattttaaaaggtgtccagtgtgacgtgcagttggtggagtcgtgggggcgccgtggggtaccgggccggggggtcgcgtgagactctcctgtgcggctcgtggattagtttaggagtcatgccatgaacgtcgggtccgccgaggtcctccggaggggaacgggggtctgggaggtgggtccgtcgggtacttagtttacggtgggctagggttgggtaggccgtacttagttattaagttatcgacgacggacccgcccgtaggaaacggggtcccgttacacccttagtttcccaaggtacgaactaaagttacgaaagtaaccacgtcttaggtatccgtagaactaaagtggaacgacgcctaggactacgtacgacgaccgaccggtccttactatttacgttgtaggtaaacggcgtagtcgtagggaacggtccggggacccgggtccctaacgttcggacccgtacggtcggggaccgaggggaccgtcggtccggtaccg

SEQ ID NO: 54740 - DNA, 730 bp, Homo sapiens
  misc_feature: GYAE6OF02IWH46.29.78.H01.1.454.CMB.1.raw
  modified_base (728)..(728): a, c, t, g, unknown or other
  misc_feature (728)..(728): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctggaagggccggttcaacctatttccagacgacaattcgaagaacacgctgtatctgacaaatggagacgcctgagactcgacgacacggccgtactattattggtagttaaaggcgagcgtgggaaagtaccgggggacccggggtccccgacgttacggacccgacggtcgggggacccgacgggggacgtccgtacgggtccgaccggttcctccctccgacgtacccctcccgtaacccggaacggggcccctaacggttcccggttaccccgttcccccgtacggccctacccctacccgtaccgaacgccgaccgtaccgtccggtcgggggaccctaacgacggaccaccggtcccgtacggggccttccggtcccggttacgggtaaccgtaaacggacccgtttaacccgttacccgtaacgttacccgtacctaaacgttccggtacggaaccgggtcggtccggttacgggacgaacgggccgacggtatacggngc

SEQ ID NO: 54741 - DNA, 737 bp, Homo sapiens
  misc_feature: GYAE6OF02GO1HH.29.78.H01.1.454.CMB.1.raw
tcagatagagtactcacgaccggtgctcgatttagtgtgagtagtttgggtttggagtctgcaccatggctcggaccccactcctcttcctcaccctcctcctccactgcacagggtctctctcccagcctgtgctgactcaatcgccctctgcctctgcctcccgtgggagctcggtcaaggtcacctgtactctgagcaggtggacacgagcagctacgccatcgcttggcatcagcagacggccagacgacgggtccctagttactgatgacacgtacaaacaatggagtggacaagtcaacgaggacggaaagggggacggactcccgtaggaacgtccgtcttctacgtacgtcctaccgacgtaccgttcgtacggggtcctaggacgtccggtaccctaaccgtacgaacctaaccgttcccgtaccccggacccttaccgtacggttaccgtagggtaacggtacgttacgggaacggtacgtaacggttaacctttaacgtttaccgtacgtaacggtacgggtaccgggttacgggggacctaacgggtacggtacttaacgtttaccgttaacggggttacccggttaaccgggggaacccgggtaaccgtaaccggggtaccgttacccgggttaaccggtaccggtacccggtaaccggaaccccgtaaccggaacccctaaccccgtaccgttaccggaccttacccgttcccgttaccccgg

SEQ ID NO: 54742 - DNA, 714 bp, Homo sapiens
  misc_feature: GYAE6OF02HITI6.29.78.H01.1.454.CMB.1.raw
  modified_base (714)..(714): a, c, t, g, unknown or other
  misc_feature (714)..(714): n is a, c, g, or t
tcagatagagtactcacgaccggtgctcgatttagtgtgagtagtttgggtttgggggcgcctgggtacggccggggggtcgctgagactctcctgtgcggcctctggatttaagttttaggagtcatgccatgaacgtgggtccgccaggctccgagggaagggctggagtgggtctcggctattagtggcagtggtggcgctatatattatgcagaccgcctggaacgggtccggttcacctatttccgagagactaattacgaagaacacgctgtatctgacaaagtggagagcctagacgactcgacgacgacggccgtctatttattgtaggttaaaggcgacgcgtaggaacggtaccggggacccgggcccgtacgttacgaccgacggtcgggggaccgacgggggaccgcgtcggtccaccggttctcccgtacgacgtccctacccgaaccgaaccgggacccgaccgtcccggttccccgtttcccccgtcccggtacccgtacccctacccttacccgaaccgaccgacccgtacccgtccggtccggggaccgacgacgaccgaccgcccggtcggtccgtcgtccgtcgtacgtaacggtacgtaccttaccgggggggggggggggggggggggtactaccgttacttacgtcgtcgtacggcggtcgtacggtacgacggaccgacgtacgtacgagn

SEQ ID NO: 54743 - DNA, 884 bp, Homo sapiens
  misc_feature: GYAE6OF02HO0NG.29.78.H01.1.454.CMB.1.raw
  modified_base (264)..(264): a, c, t, g, unknown or other
  misc_feature (264)..(264): n is a, c, g, or t
tcagatagagtactcacgaccggtgctcgatttagtgtgagtagtttgggtttgggggcgcctgggtacggccggggggtcgctgagactctcctgtgcggcctctggatttaagttttaggagtcatgccatgaactgggtccgccaggctccagggaagggctggagtgggtctcggctattagtggcagtggtggcgctatatattatgcagacgccctgaagggccggttcaccgatttccagagacaattcgaagaacncgctgtatctgcaaaatggagaagcctagagactacgacgaacgacggcccgtctaactttagttagtagtttaaaaggccgagtccgtagggaaatacggggacccggggtacccgaacgtttcgaacccgtaacgtcgggggacccgaaaggggggaccgtccggttacgggttaccgtaaaccccggttcccgttaccccgttaccgtaaccgggtaccccctttaaccccgaaaaccccggtaaaccgggggtacccccctaaacggttttacccccggggtttaccccgttttccccccccccggttcggggtaccccctaaacccccgttacccccgttaccccgaaaacgggtaacccgtacccgtaaaccccgtttcccgggttaccgggggggtacctaaacccggtacggacccgtaacccggccccggttaccggggtccgttccggtccccggttacggggttacccgtaaaaccgggtaccgttaaacccgtttcccgttaacgttaccccgttacgttaccgtttaccggtacggtaacgggtcccggggtaccgtaccgggtaacccggaacgggtacccggtaccgtaaacgttacggagtacg

SEQ ID NO: 54744 - DNA, 584 bp, Homo sapiens
  misc_feature: GYAE6OF02GDJKN.29.78.H01.1.454.CMB.1.raw
  modified_base (261)..(261): a, c, t, g, unknown or other
  misc_feature (261)..(261): n is a, c, g, or t
  modified_base (409)..(409): a, c, t, g, unknown or other
  misc_feature (409)..(409): n is a, c, g, or t
  modified_base (583)..(584): a, c, t, g, unknown or other
  misc_feature (583)..(584): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaaanaacacgctgtatctgacaaatggagagcctgagactcgacgacacggcgtctattatgtagttaaaggcgagctaggaacgtacgggaccggggcccgacgttgacccgacgtgggggaccaggggaccgcgtggtccaccgtctccncacgccctccaaccgaacggcccacgtccggtccttcccccgtcggcctaccctcctacccaacgacgccaccgtcgtcggggccacgacgcacgcccgtgggcgtcgccgtggtaccaaggactacttacacgtactctatctagacgcggcgtggacgaggccgacatacgnn

SEQ ID NO: 54745 - DNA, 668 bp, Homo sapiens
  misc_feature: GYAE6OF02HTR2Y.29.78.H01.1.454.CMB.1.raw
  modified_base (406)..(406): a, c, t, g, unknown or other
  misc_feature (406)..(406): n is a, c, g, or t
  modified_base (666)..(667): a, c, t, g, unknown or other
  misc_feature (666)..(667): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactggggtccgccaggctccgaggggaaggggctgggagtgggtctcggctattagtggcaggtggtggcgctatatattatgcagacgccctggaagggccggttcacctatttccagagacaattcgaagaacacgctgtatctgacaaatggagagcctgagactcgacgacacggcctatatttattggtagttaaaggcgagcgtaggaacggtaccggggaccggggccctagttcgaaccgacgtcgggggaccagggggaccncgtcgggtccaccggtcctcccgtacaccgtccctacccgaaccgaacgggccctacgtcccggtttccccttcccccgtcggccctaccccttaccctacccgaacggtaccgaccgacccgtttacggtcgggggaccaacgacgccgaccggcccgtcgggcctcgccgtcgtacgaacggtacctaccgttccgtacgtacccttctacgtcctacggcggtaccggtcggtaggaccgaacggcgagacgtacgnng

SEQ ID NO: 54746 - DNA, 605 bp, Homo sapiens
  misc_feature: GYAE6OF02F89TS.29.78.H01.1.454.CMB.1.raw
  modified_base (418)..(418): a, c, t, g, unknown or other
  misc_feature (418)..(418): n is a, c, g, or t
  modified_base (604)..(604): a, c, t, g, unknown or other
  misc_feature (604)..(604): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaacgggccgttcaccatttccagagacaattacgaagaacacgctgtatctgacaaagtggaagacgcctggacgtactcgaccgacgaccggccgtctattattgtagttaaaggcgagctaggaagtaccggggacccgggccgacttgaccacggtcggggccgaggggcgcgtcggtcaccgtctcctcncgccctccaccgacggcccagtccgtcctccccgtcgccctaccctcctacaacgacgaccaccgtcggtcggggaccacacgcacgtcccgtgggcctcgccgtggtaaccgtaacgtaccttacctaccgtacgtcctctactcgtcggacggccggtcgtacggacgtacggcgactagagtnc

SEQ ID NO: 54747 - DNA, 668 bp, Homo sapiens
  misc_feature: GYAE6OF02IVGMY.29.78.H01.1.454.CMB.1.raw
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagaccgccctgaagggccgttcacctatttccagagacaattcgaagaacacgctgtatctgcaaatggagagcctgagactcgacgacacggcccgtctattagttgtaggttaaaggcgagtcgtaggtaaacgtacggggacccggggcccgtacgttcgaacctacgtcgggggaccaacgggggcgctggtacaccgttctacctcacgccctacccaaccgaacgggtccccaacgttccggtcccttcccccgtcgggcctaacccctcccgtacccaaacgcgtccaccgtcgttccgggggaccaccgcgaccacggtccccgtacggggctccggtccgtcggttaccgtaaaccgggacctttaaccgttcccgaacggtttcctacgttacgttcgtaggtacggtcgggtctcggggacaacgggtccgacacgtagatcg

SEQ ID NO: 54748 - DNA, 642 bp, Homo sapiens
  misc_feature: GYAE6OF02I5JN6.29.78.H01.1.454.CMB.1.raw
tcagatagagtactcacgaccggtgctcgatttagtgtgagtagtttgggtttggggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccactttccagagacaattcgaagaacacgctgtatctgctaaatggagagcctgaagactacggacgacacggccgtctattattgtagttaaaggcgagctaggaagtacggggaccgggaccgtacgttcgaccacgtcggggaccgagggggacgacgtggtcgaccgttctcctcgacgcctccaaccgacggcccacgtcggtcccttcccctggcccaccctcctaccaacgacgaccactccgtcggggaccacgacgaccacgtcccgtcggtcgtcgtccgtacggtaccgtaacggaccttacgttaccgtacgtaccttacgtacttaccgttaggacggtccggggtaccgtacgggtaccggaacgggtaccgacgtacgttacgctacg

SEQ ID NO: 54749 - DNA, 614 bp, Homo sapiens
  misc_feature: GYAE6OF02GOIDT.29.78.H01.1.454.CMB.1.raw
  modified_base (457)..(457): a, c, t, g, unknown or other
  misc_feature (457)..(457): n is a, c, g, or t
  modified_base (480)..(480): a, c, t, g, unknown or other
  misc_feature (480)..(480): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtgcagtggtggcgctatatattatgcagacgccctggaagggccggttcacctatttccagagacaattacgaagaacacgctgtatctgcaaagtggagagcctgagactcgacgacacggccgtcttattattgtaggttaaaggcgagctagggaaagtacggggaccgggcccgacgttcgaccgacggtggggaccgacggggacgcgtggtccaccgtctcctcacgcctccgaaccacgggccctatccggtcccttccccgngcccgacccttccgtaccaagcncctacccgtcggtcgggcctacgagccgacgtcccggtggccgttcgccgttacgggtcaacgtaccttaccgtccgagttacctgtactcgtacggacgcgggttgccggacggacggtccggatagtacgtc

SEQ ID NO: 54750 - DNA, 777 bp, Homo sapiens
  misc_feature: GYAE6OF02IE7MB.29.78.H01.1.454.CMB.1.raw
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctggaagggccggttcaccatttccagagacaattcgaagaacacgctgtatctgacaaatggagagcctgacgactcgacgacacggcccgtcttaattattgtaggttaaaggcgagctagggaacgtacggggacccggggacccgtacgttcggaacccgtaccggtcgggggaccgtaacggggggaccgtccgtacgggtaccgtacccggttccgtcccgtaccgacgacccccgttacccgaacccggaaacggggacccctacggttacccgggtttcccctttaccccccgtcgggacccctaaccccgttccccgtaacccgaaacggtaaccgacccgttaacccggttccggtacggggggcctaacccggacggaccgaacccgggtccccgttaggggcccgttcgtacccggttacgggttacccggaaacggtacccgtaacccgtttacccgaacgttaccttccgttaacgttcggtacggtaccgggccgggtaccgttcgggaccggtaacggcccgtacgaagttacggatacg

SEQ ID NO: 54751 - DNA, 605 bp, Homo sapiens
  misc_feature: GYAE6OF02H7KDZ.29.78.H01.1.454.CMB.1.raw
  modified_base (390)..(390): a, c, t, g, unknown or other
  misc_feature (390)..(390): n is a, c, g, or t
  modified_base (602)..(602): a, c, t, g, unknown or other
  misc_feature (602)..(602): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttcccagagacaattcgaagaacacgctgtatctgcaaatggagagcctgagactcgacgaacacggaccgtctaattattgtgttaaaggcgagctaggaagtacgggaccggggcccgtacttcgaccgactggggccaggggtacncgtggtcaccgtctccctcacgccctccaaccgaacgggccctagtccgggtcctttcccccgtaggtcccaccctcctcccaagacgacctaccgtcgtcgggggacctacgacgacaaccgcccgtacgggcgtacgccctggtacaacggacttaccttaccatacctctagtcttagcggcggcgtggacgacgggcgacgtagtagnacg

SEQ ID NO: 54752 - DNA, 623 bp, Homo sapiens
  misc_feature: GYAE6OF02GWLCD.29.78.H01.1.454.CMB.1.raw
  modified_base (218)..(218): a, c, t, g, unknown or other
  misc_feature (218)..(218): n is a, c, g, or t
  modified_base (242)..(242): a, c, t, g, unknown or other
  misc_feature (242)..(242): n is a, c, g, or t
tcagatagagtactcacgaccggtgctcgatttagtgtgagtagtttgggtttggggtctgagagaggagtccacccctgggatcttcaggtgttttcatttggtgatcaggacggaacagagagaactcaccatggagtttgggctgagctggctttttcttgtggctattttaaaaggtgtccagtgtgacgtgcagttggtggagtctgggggcncctggggtacggccgggggggtcnctgagactctcctgtgcggcctctggattaagtttaggagtcatgcatgaactgggtccgcaggctccgaggggaaggggctggagtgggtctcgggctagttaggtggcaggtggtggcgctatatattatgcagccgcctggaagggtcccgttcacctatttccaagagaactaattacgaaagaacacgctgtatcgtagacaaagtggagacgccgtgacgacctcgaaccgacgcggtcctatatttattggtaagttaaacgggcgaaggtcgtaagggaacgttaccggggggaacccggggtcccgtaaggttaccggaacccgtacggttcggggggaaccctaggggggaccctcggttacgggtacccg

SEQ ID NO: 54753 - DNA, 623 bp, Homo sapiens
  misc_feature: GYAE6OF02GBDQ5.29.78.H01.1.454.CMB.1.raw
  modified_base (381)..(381): a, c, t, g, unknown or other
  misc_feature (381)..(381): n is a, c, g, or t
  modified_base (618)..(618): a, c, t, g, unknown or other
  misc_feature (618)..(618): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggcgtctattattgtgttaaggcgagctggaagtacggggaccgggcccgactgaccgacgtggggccgaggggacncgtgggtcaccgtcctcctcacgtcctcccaccgaacgggccctagtccggtccttcccccgtcggccacccctcctacccgaacgacgcctacctcggtcggggccacgacgccacgccccgtgggtccgtcgtccgtcggttacgaaccggtacttacccgttacgacgttacctactacgtcgtggcgggtccgggtcgtcgggaccgaaccgggtcgtaccggacgttacggntacgg

SEQ ID NO: 54754 - DNA, 714 bp, Homo sapiens
  misc_feature: GYAE6OF02ITW49.29.78.H01.1.454.CMB.1.raw
  modified_base (291)..(291): a, c, t, g, unknown or other
  misc_feature (291)..(291): n is a, c, g, or t
  modified_base (712)..(712): a, c, t, g, unknown or other
  misc_feature (712)..(712): n is a, c, g, or t
tcagatagagtactcacgaccggtgctcgatttagtgtgagtagtttgggtttgggggcgcctgggtacggccgggggggtcgctgagactctcctgtgcggcctctggatttaagttttaggagtcatgccatgaactgggtccgccaggctccagggaaggggctggagtgggtctcggctattagtggcagtggtggcgctatatattatgcagacgccctgaacgggccgttcacctattccagagacaattcgaagaacacgctagtatctgactaaatggaacgngtcctgacgacgtcgaacgacgaccggcccttactagtttacttggttaagttaaacgggcggtaagtcgtagggaaacgtaccggggacccggggtaccccgtattcggaacccgtacggtcggggccggaaggggaccgtcgtacggtccgaccgttccgtcctacgcgtacccctcccgaaccgaaccggtacccgacgttaccggttaccccgttcccccgtccggtaccctaccccgtaccctaccgtaacgacctaccgtacccgtaccggtccggggacctacgaccgacgaccgtcccggtcggacgtccgccggttacgaccgtaacgtaccgtaccgttaccgttacgtaccttcgttacgtcgtacggtacggccggtaccgtcggtacgtacggcgacgtagtacgtcncg

SEQ ID NO: 54755 - DNA, 783 bp, Homo sapiens
  misc_feature: GYAE6OF02HFP08.29.78.H01.1.454.CMB.1.raw
  modified_base (279)..(279): a, c, t, g, unknown or other
  misc_feature (279)..(279): n is a, c, g, or t
  modified_base (781)..(781): a, c, t, g, unknown or other
  misc_feature (781)..(781): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccgagggaaggggctggaggtgggtctcggctattagtggcaggtggtggcgctatatattatgcacgaccgccgtaggaacgggtccgttcacctatttccagacgactaattacgaagaacacgntgtatctgacaagtggagagcctgagaccgtacgaccgaccgaccggtcccgttacttaatttagttggttagttaaacgggcgagtcgtaggaacggtaccggggcccgggtacccgtacgttcgaccgacggtcggggaccggacggggacgtcgtcggtaccgtacccgttcctccctacgaccgtccccgtacccgaacccgtaacccggggtcccctaaccggtttcccggttaccccccgttccccccggtccgggtacccccttacccccgtaccccttaacccgaaccggtacccgtaccccgtacccgttccgggtaccggggacccaaccgtacggacccgtacccggtccccgggtccggtcccgtcgggtacccggttcgggtaaccgtaaccggtacccttaccgttacccgtacgttacccttaccgttacgtccggtacggacgggtccgggtcggtacggaccggaacgggccaacgtacgacgtncg

SEQ ID NO: 54756 - DNA, 614 bp, Homo sapiens
  misc_feature: GYAE6OF02HX9XP.29.78.H01.1.454.CMB.1.raw
  modified_base (564)..(564): a, c, t, g, unknown or other
  misc_feature (564)..(564): n is a, c, g, or t
  modified_base (612)..(612): a, c, t, g, unknown or other
  misc_feature (612)..(612): n is a, c, g, or t
tcagatagagtactcacgaccggtgctcgatttagtgtgagtagtttgggtttgggggcgcctgggtacggccgggggggtcgctgagactctcctgtgcggcctctggatttaagttttaggagtcatgccatgaactgggtccgccaggctccaggggaaggggctggagtgggtctcggctattagtggcagtggtggcgctatatattatgcagacgcctgaaggccggttcacatttccagagacaattcgaagaacacgctgtatctgcaaatggagagcctgagactcgacgacacggccgtctattagttgtaggttaaaggcgagctaggaacgtacggggaccggggcccgacgttcgacctacgtcggggccgagggggacgcgtggtccaccgtctcctcacgccctaccaccgaacgggcccacgtccggttccctttcccccgtcggccctaccctcctacccgaacgacgccacctccggtcgggggccacacgcgaccgcccgtcgggcctcgtccgtcggtaccgaacgggtacctaccgttacccngttccttctatcctaggacggcgggtcgtggacgacggcgacgatagnac

SEQ ID NO: 54757 - DNA, 1015 bp, Homo sapiens
  misc_feature: GYAE6OF02I3XNT.29.78.H01.1.454.CMB.1.raw
tcagatagagtactcacgaccggtgctcgatttagtgtgagtagtttgggtttgggggcggcctgggtacggccgggggggtcgctgaggactactcctgtgcggcctctggattaacgttttaggagtcatgccatgacgtggtccgcaggctccagggagggctggagtgggtctcggctattagtggcagtggtggcgtctatactaagttagtgcacggaaccgtcccgtggtaaacggggcccgggtttaccaacccgtagttttacccgaagggtaacgaaactaaacgtttaccggaaaacggaaaaccaaccggtccgtttaggttaacgttaccgttaggaaccctaaaaagttacggggaaacggacggtacccgttagggtaaacgtaaccgttaccggaaccggtaaacccggaaccgggtacccgggtttacttaacgttttaacgtttacggtttaaacggggttaaaaacgggcccggtaaggtacccgttaacggggtaaaacccggttaaccgggggacccccgggggaccccgttaacggtttaccgggaaacccggtaaccgggttaccgggggggacccggaaccgggggggtaccggtacccggtttcggggtaacccgaacccggtttacccgttcccgtaaccggtaaccggtacccctacccggtaaacccggtaaccggggtacccgtaacgtttcccggtttccccttcccccggtacggtccccgtacccgtacccgtaaccaaccggtacgtacccgttaaccggttcggtcgggggtacctaaaccgggtacgtaccggtaaccgggtcccggttacggggttcctacccgggttaccgttaccgggtaaccgtaaaccggggttaacctttaaaccgttacccgggttaacgttaccgtaaccggtttaacgtaacgggttacggaacgggtaccggtcgggtacggtacggtaaccggtaccgacgtaaaccggtgtaacgtcg

SEQ ID NO: 54758 - DNA, 618 bp, Homo sapiens
  misc_feature: GYAE6OF02I9LFZ.29.78.H01.1.454.CMB.1.raw
  modified_base (514)..(514): a, c, t, g, unknown or other
  misc_feature (514)..(514): n is a, c, g, or t
  modified_base (591)..(591): a, c, t, g, unknown or other
  misc_feature (591)..(591): n is a, c, g, or t
  modified_base (616)..(616): a, c, t, g, unknown or other
  misc_feature (616)..(616): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatagttatgcagaccgccctggaagggcccggttcacctatttcccagagacaattcgaagaacacgctgtatctgcaaagtggagacgcctgacgactacgacgacacggccgtctattattgtagttaaaggcgagcgtaggaaagtaccggggacccggggcccacgttcgacccacgtcgggggaccgagggggaccgcgtcggtccaccgttcctccctacgaccgtccctcccgaaccgtaacgggcccctacgttcccggtccccttcccccgtcggccctacccctccctaccgaacgacnccaccgtcggtcggggccacgacgcgacgcccgtggcctcgcgtcgacgacgtcctaactcgagtctctactctagnggcggtctggcgacggcgacatagncg

SEQ ID NO: 54759 - DNA, 687 bp, Homo sapiens
  misc_feature: GYAE6OF02IKIKI.29.78.H01.1.454.CMB.1.raw
  modified_base (685)..(685): a, c, t, g, unknown or other
  misc_feature (685)..(685): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccgagggaagggctggagtgggtctcggctagttagtggcagtggtggcgctatatattatggcagaccgcccgtggaacgggccggttcacctatttccagagacaattcgaagaactacgctagtatctgacaagtggagacgcctgagacgtcgacgacacggccgtactattagtcgtagtaaggcgagctaggaacgtacgggaccgggtacccgagttcgacctacgtcggggaccgaggggacgcgtacggtccgtaaccgttcctccgtacgaccgtcccgtacccgaaccggaaccggggtaccctacgtcccggttacccgttttccccccgtcggacccctaccccgtcctacccgaaacggccgaccgtaacccgtccggtcgggggacccacgacggtaccgaccgtcccgtcgggccgtccggcgttcgggtaaccgaacggtaccttaccgtaccgaacgttaccgtactagtcgtaggacggtcggttcgtacgggacgaacggcgacgtacgtagntg

SEQ ID NO: 54760 - DNA, 576 bp, Homo sapiens
  misc_feature: GYAE6OF02FMB39.29.78.H01.1.454.CMB.1.raw
  modified_base (386)..(386): a, c, t, g, unknown or other
  misc_feature (386)..(386): n is a, c, g, or t
  modified_base (575)..(576): a, c, t, g, unknown or other
  misc_feature (575)..(576): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggggacccggggcccgacttgaccacgtgggggccagggggacncgtggtcaccgtctcctcacgcctaccacgaacgggcccactccggtccttccccctcggccaccctcctcccaacgacgccacctccgtcgggggccacgacgcacgcccgtgggcctcgccgtcggtaccaaggtacctacttccacgttactctagtcctgacggcggcgtggacgaggcgcatgnn

SEQ ID NO: 54761 - DNA, 632 bp, Homo sapiens
  misc_feature: GYAE6OF02HEN2K.29.78.H01.1.454.CMB.1.raw
  modified_base (630)..(630): a, c, t, g, unknown or other
  misc_feature (630)..(630): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccgttcaccatttccagagacaattcgaaagaacacgctgtatctgacaaatggagagcctgagactcgacgacgacggccgtactattattgtagttaaaggcgagctaggaacgtaccggggacccggggcccgacgttcgaccgaacgtcgggggccgaggggacgcgtggtccgtacccgtcctcctccacgccctccaacccgaacgggcccaacgtccggttccccttcccccgtcggccctacccctcccgtacccgaacgaccgccgtaaccctccggtacggggccacgacgccacgtcccgtggcctcgccgtcggtaccgaacggacctaccgttcctaacgtactctacttcgagacggtccggacgtggacgacggcgaccgatagancg

SEQ ID NO: 54762 - DNA, 670 bp, Homo sapiens
  misc_feature: GYAE6OF02IW1Y6.29.78.H01.1.454.CMB.1.raw
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccgttcaccatttccagagacaattcgaagaacacgctgtatctgacaaatggagagctgagactcgacgacaccggcccgtcgtattagttgtagttaaaggcgagctaggaataccggggaccggggccccgacgttgaccacgtcggggaccgaggggaccgcgttggtccaccgtctcccgtcacgccctccaccgaacggggcccaactccggttcccttcccccgtcggtaccccacccctccttacccaacgacgccgacccgtccgtcgggggaccacgacgccgaccgcccgtacgggcctcgtcccgtagggtaccaaacggtacccttaaccgttaccgtaacgtttaccgtacctttaacgtccgttaggtaaccgggtccgggacgttcgggaaccgtacggggaccgtacccgtaaggtacgagtcg

SEQ ID NO: 54763 - DNA, 656 bp, Homo sapiens
  misc_feature: GYAE6OF02FH7Q0.29.78.H01.1.454.CMB.1.raw
  modified_base (331)..(331): a, c, t, g, unknown or other
  misc_feature (331)..(331): n is a, c, g, or t
  modified_base (378)..(378): a, c, t, g, unknown or other
  misc_feature (378)..(378): n is a, c, g, or t
  modified_base (393)..(393): a, c, t, g, unknown or other
  misc_feature (393)..(393): n is a, c, g, or t
tcagatagagtactcacgaccggtgctcgatttagtgtgagtagtttgggtttggggtccgagccatggtgcagactccccagagctctcctcctcctccactgcacagggtctctctcccagcctgtgctgactcaatcgccctctgcctctgcctccctgggaggctcggtcaaggtcacctgtactctgagcagtggacacagcagctacgccatcgctggcatcagcagaggccagacacgggtccctcgttacttgatgacagtcaacatgatggcagtcacgagcggaagggggccggatcccgtgactcgcttctcgacgtccncgagtccgtcgtcgggcctggacgtccgctacccgtcaacactcccnccggccctcgagtcnggagacgtaggacggctaggtacttacgttaacgtcgtacgaacggtacccggtgggggaccctaacggtcgggtactaggtttaccgtaacgggttcccgttaaccgggggtaccccgggtaaccgtaccgggttacccgacccgggttcggttacccgggtccgaaaccccggtaccccggtaacccggaacccccgtaaaccccccgtcggttcccggttaaccctacccggtttcccgtttacccgttaaccccccccg

SEQ ID NO: 54764 - DNA, 718 bp, Homo sapiens
  misc_feature: GYAE6OF02GUO2L.29.78.H01.1.454.CMB.1.raw
  modified_base (637)..(637): a, c, t, g, unknown or other
  misc_feature (637)..(637): n is a, c, g, or t
  modified_base (712)..(712): a, c, t, g, unknown or other
  misc_feature (712)..(712): n is a, c, g, or t
  modified_base (717)..(718): a, c, t, g, unknown or other
  misc_feature (717)..(718): n is a, c, g, or t
tcagatagagtactcacgaccggtgctcgatttagtgtgagtagtttgggtttgggtggtctctctcccagcctgtgctgactcaatccgccctctgcctctgcctccctgggaggctcggtcaaggtcacctgtactctgagcagtggacacagcacgctacgccatcgcttggcagtcagcagcgccagacacgggccctcgttacttgatgacagtacaacatggatggcagtcacgagacggaacgggggcgactcccgtagactcgtcttctcacgtctccagtccgtcgtcgggcctaggacgccgtacctacccgtcaacctacgttccgtaccccggtaccctccggtacggttccggtacgggaagggtaacgtttcgggaaccggttcgttaacggtaaaccttttagttaccgtaggtaccgtaaccgggttacccgggtagggggtaccctaacggtcggacttttaacggttccggtaggggttttacccggtacccggggtaacccggggtaacggtaaccgggtacccgttacgggttccgtaccgggttacctaacccggtaaccgaaccggttacccaacccgttcggtcctaccgtaccgttccgtcccgtttaccccncccttacgaacgtacctacgttcgtactccggtgacccggtcgggtctaccgggtaactacgggtctacgtacgnggtcnn

SEQ ID NO: 54765 - DNA, 644 bp, Homo sapiens
  misc_feature: GYAE6OF02FPR3Y.29.78.H01.1.454.CMB.1.raw
  modified_base (639)..(639): a, c, t, g, unknown or other
  misc_feature (639)..(639): n is a, c, g, or t
tcagatagagtactcacgaccggtgctcgatttagtgtgagtagtttgggtttggtggtctctctcccagcctgtgctgactcaatcgccctctgcctctgccctccctgggaggctcggtcaaggtcacctgtactctgagcagtggacacagcagctacgccatcgcttggcatcagcagaggccagacacgggccctcgttactgatgacagtcaacaatgatggcagtcacagcgaagggggacggatccctgatcgcttctcagtctccagcctacgtgggcctgacgccgctaccctcaactaatccgtcccggcctccgagtctagacggatggacggctagaccttattacgtgtacacggtacccgtgggggcctacgtggactacgttcgacgggttccgttaccggggacccggggtaacccaagggtacccgtacccgggttccgtccgggttccaacggaccccgaaacgggcccctaaaccccgtacgtacggttacctaaccgttccttacccggtttcccccaaccccgttccccttccgtaacgttaccttaccttacgtccgttacggaacggtccggggaccttacgggaccgaacgggtccgtaccgtaacggtacggntcgac

SEQ ID NO: 54766 - DNA, 634 bp, Homo sapiens
  misc_feature: GYAE6OF02GSL73.29.78.H01.1.454.CMB.1.raw
  modified_base (630)..(630): a, c, t, g, unknown or other
  misc_feature (630)..(630): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcacctatttccagagacaattcgaagaacacgctgtatctgcaaatggagagcctgagactcgacgacacggccgtctattattgtagttaaaggcgagctaggaagtacgggaccggggccgtacttcgaccacgtcggggaccaggggaccgcgtcggtccaccgtctccgtcgacgccctaccaaccgaacgggcccacgtccggttcccttcccccgtcggccctaccctccctaccaacgacgccaccgtcgtcggggccacgacgccgacgcccgtcgggcctcgccgtcggtaccaaacgggtacctaccgttccaagttaccttacctacgttccgtaggtacggccgggtacgttcgggaccgtaacgggccgacgacgttacggntacg

SEQ ID NO: 54767 - DNA, 682 bp, Homo sapiens
  misc_feature: GYAE6OF02ICZ9P.29.78.H01.1.454.CMB.1.raw
  modified_base (314)..(314): a, c, t, g, unknown or other
  misc_feature (314)..(314): n is a, c, g, or t
tcagatagagtactcacgaccggtgctcgatttagtgtgagtagtttgggtttgggggcgcctgggtacggccgggggggtcgctgagactctcctgtgcggccctctggattaagttttaggagtcatgccatgaactgggtccgccaggctccagggaaggggctggagtgggtctcggctattagtggcagtggtggcgctatatattatgcagacgccctgaagggccggttcacctatttccagagacaattcgaagaacacgctgtatctgacaaatggagagcctgagactcgacgacacggccgtntattattgtgttaaaggcgagccgtagaagtacgggaccggggcccgacgttcgaccaacgtcggggaccgtaacgggggacgcgtcggtcaacccgttctccctcgaccgccgtacccaccgaacggacccacgtcccggttcccgtttcccccgtcggacctaccctcccgtacccgaacggtacgccgaacccgttccgtacgggggccaacgtacgaccgacgtccccggtcgggtacctccggtcccgttccgggttaccgtaacggtaaccttaccgttacccgtacggttacctaccgttactcgtcggtacggtccgggtcgtcggaccgtaacggacccggtacgtacgttacgatccg

SEQ ID NO: 54768 - DNA, 770 bp, Homo sapiens
  misc_feature: GYAE6OF02G9NVB.29.78.H01.1.454.CMB.1.raw
  modified_base (265)..(265): a, c, t, g, unknown or other
  misc_feature (265)..(265): n is a, c, g, or t
  modified_base (432)..(432): a, c, t, g, unknown or other
  misc_feature (432)..(432): n is a, c, g, or t
  modified_base (732)..(732): a, c, t, g, unknown or other
  misc_feature (732)..(732): n is a, c, g, or t
tcagatagagtactcacgaccggtgctcgatttagtgtgagtagtttgggtttgggggtctgagagaggagtcccaccccctgggatcttcaggttgttttcatttggtgatcaggacggaacagagagaactcaccatggagtttgggctgagctggtctttttcttggtggtcttaagttttaaaggtcgtcctagtgtgacgtgctaggttgggtggagttcggtggggggccgccggtggggtaccggggccggggggtcnctaggagctctcctggtcgccggtcctgtaggtatttaacggttttaggagtcagtcgcctaagtgtaaccggtcgggtacccgccgtacggtccgtaccggaagggggaacgggggtcgtaggggtacggttcggggttcgtccggggatttaggttagggtcggngtacgggttggggtcgtccggtattagttaacgttgttaggtcgaccgacggtaccccgtaccggtacgggaaccgggtcccgtttaccaaccgttaccgtttaccgaagtaacgaacgttaattaaccggaaacgtaaccgtcgtacgttggtaacttcgaggtaactaaggttggacgtcgacgtacgaccgactccggaacgaccggtaccgtcgtacttagtttacgttggtaaacgtacggacgtcggtagtacgggaacgggtaaccccggggcggtacccgtagtaacccggngtaccgggcgggaccgtacggggcctcgggtctaccgg

SEQ ID NO: 54769 - DNA, 664 bp, Homo sapiens
  misc_feature: GYAE6OF02JQ3HZ.29.78.H01.1.454.CMB.1.raw
  modified_base (537)..(537): a, c, t, g, unknown or other
  misc_feature (537)..(537): n is a, c, g, or t
tcagatagagtactcacgaccggtgctcgatttagtgtgagtagtttgggtttggggtccgagccatggtgcagactccccagagctctcctcctcctccactgcacgagggtctctctcccagcctgtgctgactcaactccgccctctcgcctcgtcgcccttcccgtggggacggcctcgggtacaaggtccacctgtactcgtgagcgaggtggaacacagcgagcctaccgcctagtccgtgttacggacactcgaagcaggacgaccaagaccgaccgggtcccttagttaactgatcgaacactacgaaactaagtgagtcggacgaacgtcgaacgaacgggacgggaacgggggtacgtacctccgagtaccgtcgtctcactacgtccgtacgactcgtcggcgtacaggaccgtccgtactacactaacgtcctaccgtcccgtacctacgttcggtctaggacgtacgacggtcgtaccgtgttaacttagttacgtcgtacgaccggtaggttacggctacggngtacttcgtacggtacgttccgggaccgggtaccgacgtaccggtacgtccggtaccggtcggtaccgaccggacccgtaacccgaccgtaaccgtcgtaccgtacgtccttaccgtacccgtcccc

SEQ ID NO: 54770 - DNA, 918 bp, Homo sapiens
  misc_feature: GYAE6OF02H5I34.29.78.H01.1.454.CMB.1.raw
tcagatagagtactcacgaccggtgctcgatttagtgtgagtagtttgggtttgggggcgcctgggtacggccgggggggtcgctgagactctcctgtgcggcctctggattaagtttaggagtcatgccatgaactggtccgccaggctccagggaaggggctggagtgggtctcggctattagtggcagtggtggcgctatatattatgacagacgcccgtaggaagggccggtttcaaccatttccagagacaattcgaagaacagctgtatctgacaaatggagagacctgagactacgacgacacggcccgtacgttattagttcgtagttaaacggcgtaggaccgtagggtaaacgtaacgggggaaccccgggggtaccccgtaacgtttacggaacccgtaaccggttacgggggggaccccgtaaagggggggtaacccgtacccgggtttagggttacccgtaaaccccgggtttccgttacccccgttaccgtaaaccgggtaccccccgttaaccccgaaaccccggtaaaaccgggggtaccccccgtaaacggtttcccgggtttacccccttttacccccccccggtacggggtaccccttaacccccccgtcccgttaaacccccgaaaggttaaccggaccccgtaaccccgtttacgggtaccgggggggtacccaaacgtaaccggaacccgaaccggtaccccccggttaaggggtcccttccggggtaccccgttcggggttaaacccgaaaaccgggttaccgtaaacccgtttcccgtaaacggtttacccttacccggttacttaaccggttacggaaccggggtccggggttaccgttaaccggggacgttaaacccggggaccgtaaccggtaacggttacggtacgacgg

SEQ ID NO: 54771 - DNA, 641 bp, Homo sapiens
  misc_feature: GYAE6OF02GZLHT.29.78.H01.1.454.CMB.1.raw
tcagatagagtactcacgaccggtgctcgatttagtgtgagtagtttgggtttgggggaagaggaagactgacggtccacccctgggatcttcaggtgttttcatttggtgatcaggacggaacagagagaactcaccatggagtttgggctgagctggctttttcttgtggctattttaaaaggtgtccagtgtgacgtgcagttggtggagtctgggggcgcctgggtacggccgggggggtcgcgtgagactctcctgtgcggcctctggattaagttttaggagtcatgccatgaactggtccgccaggctccgagggaaggggctgggagtgggtctcggctagttaggtggcaggtggtggcgctagtatattatgcagacgccctggaagggtccgttcaccgtatttccgaagacgtacaagtttcggaaagaaccgacgtctagtatcgtgacaaatgggagagcctgacactcggacgaccgacggccgttactatttagttggtaggttaaaacgggcgtaggtccgttagggaacgtaacccggggggaacccggggcccgtaacgtttacggaacccgtaccggttcggggggacccgaggggggtacccggtcgtcggggtaacccg

SEQ ID NO: 54772 - DNA, 762 bp, Homo sapiens
  misc_feature: GYAE6OF02FKPP6.29.78.H01.1.454.CMB.1.raw
  modified_base (267)..(267): a, c, t, g, unknown or other
  misc_feature (267)..(267): n is a, c, g, or t
tcagatagagtactcacgaccggtgctcgatttagtgtgagtagtttgggtttggtggtctctctcccagcctgtgctgactcgaatcgccctctgcctcgtgcctcccgtggggaggctcggtcaaggtccacctgtactctgagcagtggacacagcagctacgcccatcgcttggcatcgagcagacggccagaccacgggcccttcggttacttgatgacagtacaacatgatggcagtcacgagcgaagggggcggactccngatcgcttctcagttcctccagtccgttcgcggggtccctaggacgtccgtaccttaaccctcaacctaaccttccgtaccccggcccttccgtacgtccgtaggaggtacgtaggacggtcttacgtaacttacgttaaccgtcgtaccaacggtaccgtacggggactaccggtggtacccgtagtttacccggtacgggtttcccggttaaccgggggaacccggggtaacccgtaaacggggtccccgttaaccgggttcggttaacccgggtaccgtaaccccggaaccccggtaaacccggtacccctaaacccgtacggttaccgttaccctaaccgtttcccttacccggtttcccccaacccgtttcccgtacgtaaccgttacccgttaccgttaccgttaccggtacggtccgggacccggggttacccgtacggggacccggtaacggggcccttaaaccggacggttaccgccgtacgtacg

SEQ ID NO: 54773 - DNA, 816 bp, Homo sapiens
  misc_feature: GYAE6OF02HEIZZ.29.78.H01.1.454.CMB.1.raw
  modified_base (238)..(238): a, c, t, g, unknown or other
  misc_feature (238)..(238): n is a, c, g, or t
  modified_base (810)..(810): a, c, t, g, unknown or other
  misc_feature (810)..(810): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtgcgctatatattatgcagacgccctgaagggccgttcaccntttccagagacaattcgaagaacacgctgtatctgcaaatggagagcctgagactcgacgacacggccgtactattattgtagttaaaggcgagtctggaacgtaccggggacccgggacccgtacgttcgaccaacgtcggggacccagggggaccgtcgtacgggtcacccggttcctcccgttaccgacgccccttaccaaccccggtaacggggccccctaacggttcccgggtttccccgtttaccccccccgtcggggtccccctaaaccccgtccccgttaaccccgaaaccggaaccgtaccccgtaccctttaccgggtccggggggtacccaaccggtacggtacccggtacgtaccccccgggttgggggtaccccgttccgggtcccgtttacggggtacccgtaaaaccgggttaaccccgtttaaccggtttaccccgttaaccggtttacccttacccggtttaacgtttccccgttaacggggtacccgggtacccggggtccgtaccgggggtaccggtaaaccggggtacccgaacccggtaaggttacgggtntaaccg

SEQ ID NO: 54774 - DNA, 727 bp, Homo sapiens
  misc_feature: GYAE6OF02FPCJS.29.78.H01.1.454.CMB.1.raw
tcagatagagtactcacgaccggtgctcgatttagtgtgagtagtttgggtttggggtccgagccatggtgcagactccccagagctctccctcctcctccactgcacgaggtctctcctcccacgcctgtgctcgactacaagtccgccctctcgcctctcgtcccttcccggtaggggacggtccgttccggtacgaacggtacctaccgttagttacctctaggacgacgtaggtacggaacaacgagacgagtaccgtaccgacctacgtccgtcgttggctactcgacgcaggacgccacgaccggaccggtcccttacgttactagactcgacgtagtaccaaactagtagacgtcggactacgtacacgaggacggggaacggggggaccggtaccttccgtagacgtcgtcttcgtactacgtccacgacgtctcggtcggctaggacgccgtaccttacccgtaccaacgtaccttcccggtacccggtaccctacgtacgttcgtagggaacggtacgtacgggaacggtcttaacggtaactttacgttacgtcgtaaccgacgtaccgggtcgggaacctacggtcgtacttacgtcggtacgttacccggtaccgggaaccggtaaccgtacggtccgaccggttccggtacggccaccggtaacccgaaccgtacccgaaccccgtgtcgaccgtacctcgttaccgtccccg

SEQ ID NO: 54775 - DNA, 759 bp, Homo sapiens
  misc_feature: GYAE6OF02HLN1D.29.78.H01.1.454.CMB.1.raw
  modified_base (391)..(391): a, c, t, g, unknown or other
  misc_feature (391)..(391): n is a, c, g, or t
  modified_base (456)..(456): a, c, t, g, unknown or other
  misc_feature (456)..(456): n is a, c, g, or t
tcagatagagtactcacgaccggtgctcgatttagtgtgagtagtttgggtttggggtccgagccatggtgcagactccccagagctctcctcctcctccactgcacagggtctctctccagcctgtgctgactcaactcgccctctcgcctctgcctcccgtgggagctcggtcaaggtccacctgtactcgtagagcaggtggaacacgtagcgacgcgtaccgaccgtactccggtcgttcggctactacgagacgaggaacggccgaacggaccggaccggggtcccttacggtttaactaggtagtacgacctacggaacctaaacgaagttgagttacggacgtcgaccacgaacggacgggaaacgggggacgtacgtaccgtnacgttccgtacgttcgtacgtaccgtacgttaccgacggtcccttacggtcggtccgttaacggngggtaccctaccggttaacctccgtaaacttacggttcccccgttccgacccgtttaccgaagtttccggagggtaaccgggagttacggacggtcgtaagtaccgttttaacgttacgtacgtaacgaccggtccgggttaacgggccttaccgttacgaccgtttacgtaccggtaggtttacccggggacggtaaacccggggtattacgggtccctacggttccgtaacggtccggaacgtacccccggtaacaaccccgtaccggtactcgtcccgtaacgttcccgtccggtacccc

SEQ ID NO: 54776 - DNA, 736 bp, Homo sapiens
  misc_feature: GYAE6OF02JY7HZ.29.78.H01.1.454.CMB.1.raw
  modified_base (242)..(242): a, c, t, g, unknown or other
  misc_feature (242)..(242): n is a, c, g, or t
  modified_base (255)..(255): a, c, t, g, unknown or other
  misc_feature (255)..(255): n is a, c, g, or t
  modified_base (323)..(323): a, c, t, g, unknown or other
  misc_feature (323)..(323): n is a, c, g, or t
tcagatagagtactcacgaccggtgctcgatttagtgtgagtagtttgggtttgggggcgcctgggtacggccggggggtcggcgtgagacgtctcctgtgcggcctctggattaagttttaggagtcatgccatgaactgggtccgccaggctccgagggaaggggctgggagtgggtctcggctatagtggcaggtggtggcgctatatattatgcagacgccctaggaagggccgttanaccatttccaganacaacttcgaagaacacgctgtactctgactaagtggacgagcctgagcgtcgacgacacggcccgtntacttattgtaagttaaacggcgagtcgtaggtaaagttaacccgggggcccggggtacccgtaccgtttacggaccctaacgggttaccgggggaccgtacgggggaaaccggccgtttaggggtccctaaaccgggtccctacccgtcgtaaccggccctttaccccgaaccgtaacgggaccccgtacgtacccgttacccgtttccccccgtcgggtccccaccccgtccctaaccgaaccgaccgcgacccgtccggtcgggtaccaccgacggtcgaccgaccggtccggtcgtaccgccggtaccggtcgaaacgtccgtaacgttcctacgtactccgtacgttcgtacggacgggtaccgggtacggtcggaaccggtacgggaccgtagaccggagtcggaac

SEQ ID NO: 54777 - DNA, 805 bp, Homo sapiens
  misc_feature: GYAE6OF02JEVOL.29.78.H01.1.454.CMB.1.raw
  modified_base (167)..(167): a, c, t, g, unknown or other
  misc_feature (167)..(167): n is a, c, g, or t
  modified_base (222)..(222): a, c, t, g, unknown or other
  misc_feature (222)..(222): n is a, c, g, or t
  modified_base (238)..(238): a, c, t, g, unknown or other
  misc_feature (238)..(238): n is a, c, g, or t
tcagatagagtactcacgaccggtgctcgatttagtgtgagtagtttgggtttggggagagctctggggagtctgcaccatggctcggaccccatcctcttcctcaccctcctcctccactgcacagggtctctactccaggcctgtgctgactcgaatccgccctntagcctacgtcgccctaccgtgggacgtcgtcggtcaacggtccactgtactcgngacgcaggtcggacancgtcaacgccttacggaccctagtccggtcttcggacctaacgttccaggtaccgtacggacgggtaccacggaaccccgccgggttccccgttacggttaacctaggtaacgttcggaacgtacgttaccaaaccgttaggtcgtacgtaccgggtactaacgtacccgtaacggacgaccgggggttaaccgggggcgtacccgtccgtaggtaccttacgtcctttaccacggtacctccgtaacctcggttaccgtccggtcggggtacctagggtaaccggtcccgacctaacccgtcgtaaaccctcgttaacccgtccggtaccctaccggttacgtcggtaaccggtagtacgtacgacgtacgttactagttaccgttagtcccgacgtaccgtaccgggtcgtacgacccgtagttacccgtacgttaccggttaccggtacgggtttacccgggaacccgggttacggtaaccgttccccgggaccggtttaccggtacccggtaaccggtcccgtaaccccgggtaacccggttaccccgtaacccggttcccgg

SEQ ID NO: 54778 - DNA, 681 bp, Homo sapiens
  misc_feature: GYAE6OF02GHTI8.29.78.H01.1.454.CMB.1.raw
  modified_base (679)..(679): a, c, t, g, unknown or other
  misc_feature (679)..(679): n is a, c, g, or t
tcagatagagtactcacgaccggtgctcgatttagtgtgagtagtttggggtttgggggcgcctgggtacggccggggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgacaaaagtgggaagagcctagacgactcggacgaacgaccggaccgttctaattagttgtagttaaaggcgagctagggaacgtaccggggacccgggaccccgtagttcgaccgacgtcggggaccgagggcgtacgtggccaccgttctcctacgacgccctaccaaccgacgggcccacgttccggtcccttcccccgtcggtaccctacccctccctacccaacgacgtaccacccgttccggtacggggaccaccgacggaccaccggtcccgtcgggaccgtcgtacccgttcggtaccgaacgtaaccgttacctaccgtacgtacctacttacgttaccgtacggcgggtaccgggtaccgtacgggacgaaccgggccgtacgtacgttacgncg

SEQ ID NO: 54779 - DNA, 706 bp, Homo sapiens
  misc_feature: GYAE6OF02ID5AG.29.78.H01.1.454.CMB.1.raw
  modified_base (206)..(206): a, c, t, g, unknown or other
  misc_feature (206)..(206): n is a, c, g, or t
  modified_base (221)..(221): a, c, t, g, unknown or other
  misc_feature (221)..(221): n is a, c, g, or t
  modified_base (324)..(324): a, c, t, g, unknown or other
  misc_feature (324)..(324): n is a, c, g, or t
  modified_base (530)..(530): a, c, t, g, unknown or other
  misc_feature (530)..(530): n is a, c, g, or t
tcagatagagtactcacgaccggtgctcgatttagtgtgagtagtttgggtttggggtccgagccatggtgcagactcccagagctctcctcctcctccactgcacagggtctctctccagcctgtgctgactcaatccgccttctcgcctctgcctccgtagggagctcggtcaaggtccactgtactctgagcagtggacacgngcagctacgcatcgnttggcatcagcaggacgcagacgacggtccttcgttactgatcgaactgtacaactaatgtagtcggacagtcaacgtacggacggaaacgggggaccgtacnccgtagtacgttccgtaccttcgtactcgtctacgacgtccgtcgtacggacctcggaacgtccgtaacctaccgtactacgtacgtcccggttacccggtaccctacggtagtcccggtaagggtacggtacggtcggaaccggttactaacggttaacttagttacgtcgtacggtacggtaccgggtgggtacctacgggttntacgttacgttacggtacggtaccggttaccgggaaccgtaactacggggttacccgtaccgggtttccgtaaccgggtaccaacccgggtaacccccgtaacgggtacccccttaacccgggttcgtttaacccgtacccggttacccgtttccccggttacccggttacccccc

SEQ ID NO: 54780 - DNA, 810 bp, Homo sapiens
  misc_feature: GYAE6OF02IDU8T.29.78.H01.1.454.CMB.1.raw
tcagatagagtactcacgaccggtgctcgatttagtgtgagtagtttgggtttggggtccgagccatggtgcagactccccagagctctcctcctcctccactgcacagggtctctctcccagcctgtgctgactcaatcgccctctgcctctgccctccgtgggagctcggtcaaggtcacctgtactctgagcagtggacacagcagctacgccatcgcttggctatcagcagagccagcgaccggccttgttacttgactgacagtacaactaagtgagttggacacgtcaaccgaggacgggaacggggggtcggaacgttcccgtagtacgttccgtccttaccgtacgtaccgttctaccgagttccgtcggtacgggcctaggtacgtccgtaccttaccctacgtaaccgtacgttcccgtccccgggtccctttacccggtacggtttccgtacgggtaacggtaacgtacggggtacggtacgtttaaccgtaaaccggtttttacgtttaaccggtacccgttaccggtaaaccggttaacccggggtccggggttaacccgtaccgggtttacggtaacccgttaacgtttacccgggtaaccgggttttaccccgggttaccggggggtaaacccgggttaacccggggttaacggttccccggtaaacccgggtttccgggttacccgggtaaccgttacccgggaaccccggtaaccccggtaccccggtaaaccccgtccggttaccggttaaccccgtacccgtttacccggttccccggttttaaccccccg

SEQ ID NO: 54781 - DNA, 795 bp, Homo sapiens
  misc_feature: GYAE6OF02IZHW4.29.78.H01.1.454.CMB.1.raw
  modified_base (792)..(792): a, c, t, g, unknown or other
  misc_feature (792)..(792): n is a, c, g, or t
tcagatagagtactcacgaccggtgctcgatttagtgtgagtagtttgggtttgggggcgcctgggtacggccgggggggtcgctgagactctcctgtgcggcctctggatttaagttttaggagtcatgccatgaactggtccgcaggctccgagggaagggctggagtgggtctcggctattagtggcagtggtgcgctatatattatgacagaccgccctaggaacgggtccgttacacctatttaccgagacgactaagttaccggaaagaacgaccgcttagtaacttcgtacgactaaagtcgggaaggacgaccgttagaacgtacgtaccggaaccgaccgaccgggtacccttacgttaacgtttagtttacggttaaggttaaacgggacgaacgtcggtaaggtaaacggtaccgggggaccccggggacccgtacgttcgaccgtacgtcggggaccgacgggggactcgtggaccgtaccgtcttcccgcgtaccgccctaccccgaaccgaaccgggtaccccgtacgttacccggtttccccgttacccccgttccggtacccgttaccccgtacccctaaccggtaaccgacccgtaccgtacccgttacggtaccgggaccgtaacgaccggaccaccgggtcccgtaccgggtccggtcgtccggttacgggaacgtaaccggtaaccgtttaaccgtaccgttaacgtaccttacgtacgttacgtaggccggtcggtacggtacggacggtacggaccgtacgaacgttagntcg

SEQ ID NO: 54782 - DNA, 757 bp, Homo sapiens
  misc_feature: GYAE6OF02HMAND.29.78.H01.1.454.CMB.1.raw
  modified_base (215)..(215): a, c, t, g, unknown or other
  misc_feature (215)..(215): n is a, c, g, or t
  modified_base (241)..(241): a, c, t, g, unknown or other
  misc_feature (241)..(241): n is a, c, g, or t
  modified_base (495)..(495): a, c, t, g, unknown or other
  misc_feature (495)..(495): n is a, c, g, or t
tcagatagagtactcacgaccggtgctcgatttagtgtgagtagtttgggtttggggtctgagagaggagtccacccctgggatcttcaggtgtttcatttggtgatcaggacggaacagagagaactcaccatggagtttgggctgagctggcttttctgtggctatttaaaaggtgtccagtgtgacgtgcagttggtggagtctgggggccnccgtggggtaccggccgggggggtcnctgacgactcctcctggtcgcggcctctggattaagttttaggagtcatgcctatgaacgtgggtccgcaggtctccgagggaagggctggaggtgggcctcggcttatacggtggcgtagtgggtacggcgtactagtaagttattagtcgacgacgtaacgtccctagggaacgggtcccgttcacctattccaggtacgactacgttacgaacgaacgactccttaggtactcgtacggtaactaaagggnggacgtacgtccgtaagggaaccgtccgtaaccggaaccggtaaccggtcccgggttaccttacgtttaagttttacgtttaacggggttaaacggttaaacgggaccggttacgtaccgggttaggggtaaacccgggttaaccccgggggggtaccccggggttaccccgtaaggttaaccccgggaacccgggttaccggggttccggggggaaaccccggtacggggggtaacccgttaccgggtaccggttaccccg

SEQ ID NO: 54783 - DNA, 847 bp, Homo sapiens
  misc_feature: GYAE6OF02HL1FH.29.78.H01.1.454.CMB.1.raw
  modified_base (278)..(278): a, c, t, g, unknown or other
  misc_feature (278)..(278): n is a, c, g, or t
  modified_base (845)..(845): a, c, t, g, unknown or other
  misc_feature (845)..(845): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagaccgccctaggaagggccggttcacctatttccagagacaattcgaagaacacgctgtatcngcaaagtggaagacgcctagagtacctacggacaacgaccggtccggttactatttacttaggtaggttaaacgggcgagtcgtaggggaaacgtaccgggggacccggggtaccccgtacgttaccggacccgtaacggtcggggggaaccccggacggggggtaaccgcccggttcgggtacccaacccgggttccctacccttcggaccgtccccgtacccaaaccccgggtaacggggtaccccctaacggttccccgggttaccccgtttacccccccggtaccggtcccccgtaacccccgtttaccccgtaaccctaaacgggtacccgtacccaaccccgggttaccgggttccgggggacccaacccggtacgtacccgacccgggtaccccggtacgggttcccggtccgccggttaaccgggttaaccgaaacggggttacccttacgttacccggtaccggttaccttaccgttacgttaccggttcggacggggtacccgggtcggtaccggggaaccgtaaccggggtaccgtacccgtaaagttccgggaancg

SEQ ID NO: 54784 - DNA, 750 bp, Homo sapiens
  misc_feature: GYAE6OF02HYTC6.29.78.H01.1.454.CMB.1.raw
  modified_base (307)..(307): a, c, t, g, unknown or other
  misc_feature (307)..(307): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccaggggaaggggctggagtgggtctcggctattagtggcagtggtggcgctatatattatgcagacgccctgaagggccgttcacctatttccagagacaattcgaagaacacgctgtactctgcaaatggagagcctgagactcgacggaacncggccgtctatttagttgtagttaaaggcgaggctaggaagtaccggggacccggggtcccgacgttcggaacctacggtcgggggacccgagggggaccgcgtgggtccaaccggtctccctcgacgtcccgtacccaacccggaacggggacccctaacgttcccgggttccccgtttaccccccgtacgggtaccctaccccgttacccctaccggaacggtaccgcccgtaaccccgttccgggtcggggggacccacgaccggaccgaaccggtccccgtacgggggcccttccggtcccggttacgggtaccgtaacgggttaaccttaacccgtttaccgtaaccgtttaccgttaccgttagttcccgtacgacggggtccgggtaccggttcggggaacccggaagggtcccgtaacggtacgtacggctacgg

SEQ ID NO: 54785 - DNA, 632 bp, Homo sapiens
  misc_feature: GYAE6OF02FYG3B.29.78.H01.1.454.CMB.1.raw
  modified_base (629)..(629): a, c, t, g, unknown or other
  misc_feature (629)..(629): n is a, c, g, or t
tcagatagagtactcacgaccggtgctcgatttagtgtgagtagtttgggtttggtggtctctctcccagcctgtgctgactcaatcgccctctgcctctgcctccctgggaggctcggtcaaggtcacctgtactctgagcagtggacacagcagctacgccatcgcttggcatcagcagaggccagacacgggccctcgttacttgatgacagtcaacaatgatggcagtcacagacgaaaggggggacggactccctgactcgacttctacagttcctccagcctcgtcgggcctaggacgccgcgtaccctcaacgtaactccgtcccggtacctccgtaagtcgttaggaggtatcggaacggcttacggacttacgttactcgtacacggtaccgtggggactacgtggactagtttcgaggttccgtaccggggaacgggacctaacgggtcctaccggttcgcggtacaccggtacccgaacggtacccaacccgtcgtacgtacctccgttccgttccggttacccccgcccttaccgtacgtaccgttaccttcgtacttccgtagggaccggtacgggtaccacgggaccgtaacgggtcccaactaaggtcgtacgnacg

SEQ ID NO: 54786 - DNA, 586 bp, Homo sapiens
  misc_feature: GYAE6OF02GXV88.29.78.H01.1.454.CMB.1.raw
  modified_base (456)..(456): a, c, t, g, unknown or other
  misc_feature (456)..(456): n is a, c, g, or t
tcagatagagtactcacgaccggtgctcgatttagtgtgagtagtttgggtttgggggcgccgtgggtacggccggggggtcgctgagactctcctgtgcggcctctggattaagttttaggagtcatgccatgaactgggtccgcaggctccagggaagggctggagtgggtctcggctattagtggcagtggtggcgctatatattatgcagacgccctgaagggccggttcaccatttccagagaccaattcgaaagaacacgctgtatctgcaaatggagagcctgagactcggacgactacggccgtcgtattattcgtagttaaaggcgagctggaatacgggaccgggccacgttgccactggggccaggggacgctggtcaccgtctcctcagcctccacgacgggcccagtcggtcttccccctggccacccgtcctccaacgtacnccaaccgtcgtcggggccacgtacgccacggccctgggccgttgccgttcggtcgaacggtacctaacttccgagttactcgtaactcgtagacggtccggtctcgggctacggccgtacacgtgcctag

SEQ ID NO: 54787 - DNA, 733 bp, Homo sapiens
  misc_feature: GYAE6OF02GYEFI.29.78.H01.1.454.CMB.1.raw
  modified_base (733)..(733): a, c, t, g, unknown or other
  misc_feature (733)..(733): n is a, c, g, or t
tcagatagagtactcacgaccggtgctcgatttagtgtgagtagtttgggtttgggggcgcctgggtacgggccgggggggtcgctgagactctcctgtgcggcctctggatttaagttttaggagtcatgccatgaactgggtcccgccaggctaccagggaaggggctggaggtgggtcgtcggctattagtggcaggtgggtggcgtctatatattatgcagacgccctggaagggccgttcaccatttccagagaccaatcgaagacacgctagtatctgacaaagtggagagccgtagacgacgtccgaacgacgaccggccgtcgttaattacgttgttaagtaaaggccgagtactagggaaacgtaacggggaccggggccccgtaagttacggacctaacggtcgggggaccgagggggaccgtccggtggtacccgtaccgtccgttacccgtcgaacgtccccgttacccgaacgtaacccggggaccctacggtttccggttaccccttcccccggttacggacccgtacccctttacccgaccgaaacgaccggtaccctaaccgttccggggtaccggggaccaaccgtacggccggtaccggcgttacccgggcgtcgtccgtacgggtactaacggtaccgttacctccgtaagttaccttcgtactacggtccgtacggtccgggcgtcgaaccggtacggcgaccgtagtacgcn

SEQ ID NO: 54788 - DNA, 742 bp, Homo sapiens
  misc_feature: GYAE6OF02IEDAG.29.78.H01.1.454.CMB.1.raw
  modified_base (742)..(742): a, c, t, g, unknown or other
  misc_feature (742)..(742): n is a, c, g, or t
tcagatagagtactcacgaccggtgctcgatttagtgtgagtagtttgggtttgggggcgcctgggtacggccgggggggtcgctgagactctcctgtgcggcctctggatttaagttttaggagtcatgccatgaactgggtccgccaggctccgagggaagggctggagtgggtctcggctagttagtggcagtggtggcgctaatatattatgcagacgccctaggaacgggtccggttcaacctatttaccagagacaattacggaagaacacgctgtatctagacaaagtggaagacgacgtgagacctacgacgacgaccgggacctattatttaagtgtaaggttaaacggcaggtcgtaggaaacgtacccggggaccgggtacccgacgttacggaccgacggtacgggggcccgaaggggtcgaccgtcgggtccaccgttctacccgttacaccggtaccccgaccgaaccggaaccgggacccgtacggttcccggtcccttcccccgtacggtccctaccccgttaccgtaacccgaaagtaccgacctacccgtttagggacccgggacaaacgccggtaccaaccgggtcccggtcgggtaccgtccggccgttacgggtaacgaaacggtacccttaaccgttcccgtaagttccctacgttacgtaacggttcggaaccggtcggttcccgacgggttacgaaccggacgacttaaacgcgagtn

SEQ ID NO: 54789 - DNA, 614 bp, Homo sapiens
  misc_feature: GYAE6OF02HINZU.29.78.H01.1.454.CMB.1.raw
  modified_base (279)..(279): a, c, t, g, unknown or other
  misc_feature (279)..(279): n is a, c, g, or t
  modified_base (411)..(411): a, c, t, g, unknown or other
  misc_feature (411)..(411): n is a, c, g, or t
  modified_base (471)..(471): a, c, t, g, unknown or other
  misc_feature (471)..(471): n is a, c, g, or t
  modified_base (610)..(610): a, c, t, g, unknown or other
  misc_feature (610)..(610): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgccaggctccagggaaggggctggagtgggtctcggctagttagtggcagtgggtggcgctatatattatgcagacgccctggagggccggttcacctatttccagacgacaattcgaagaacacgctgtatctgnaaatggagagcctgagactcgacacgacgcgtctattattgtagttaaaggcgagcgtggaagtaccggggaccggggcccgacgttgaccacgtcggggccgaggggaccgcgtaggccaccgtctcctcncgcctccgacaacgggcccactcggtccttccccgtcggccctacctccctccaacgacnccacccgtcgtaccggggctacgacgccgacgccccgtcgggtacctcggtcccgtacggtccgaacggtacctaccgtccgtacgtactctactccgtagacggtccggcgtggtaccgacgggtccgaggtacacgngtcg

SEQ ID NO: 54790 - DNA, 745 bp, Homo sapiens
  misc_feature: GYAE6OF02G7Q47.29.78.H01.1.454.CMB.1.raw
tcagatagagtactcacgaccggtgctcgatttagtgtgagtagtttggggtttggggagagctctggggagtctgcaccatggctcggaccccactcctcttcctcaccctcctcctccactgcacagggtctctctcccagcctgtgctgactcaatcgccctctgcctctgccctcccgtgggacggctcggtacaaggtcacctgtactctgagcagtggacacagcagcctacgccatcgcttggcatcgagcagacggccacgacgacgggcccttcgttactgactgacacgtacaacaatgatggcagtcacaggacgaagggggacgacgtccgagacgtcgtcttcctacgacgttcccgtacctaacgtccgtacggtcgggacccttaggaccggtccggtacccttaccgtaccgaaccgtaaccgtacccgttacccggtacccttaccgtaacgtcggtaacggtacggtactagggtacggtccgttacggtaacgtttaacgtttacgtaccggttaccgtaaacgggtacccgggttggggtaaccctaccggttacggtacccgttacggtttaccgtacggggtttaccccgggtttaaccggggggaaccccggggttaacccggtaacgggttccccggttaaccccggggtttacggtccccgggttaaccggacccggacccccggtaaacccgggtacccccgtaaccccgttaacccgg

SEQ ID NO: 54791 - DNA, 650 bp, Homo sapiens
  misc_feature: GYAE6OF02GI2CP.29.78.H01.1.454.CMB.1.raw
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattatgtgttaaaggcgagctggaatacgggaccgggcccgacttgaccacgtggggaccaggggaccgctggtcaccggtctcctcagccctaccaaccgaacgggcccacgtccggttccttcccccgtcggcctaccccgtccctacccgtaaacgacgccaacccgtccgtacgggggtaccacgacgccgaacgccccgtacgggcctacggcccgttcgggtaccgtaaacgggtaccctaaccgttacccgtaacgttacccttcgttaacgttccgtacgtacggtccgggtccgtacgggacgtaacggaccgacgacgtacgtagacg

SEQ ID NO: 54792 - DNA, 621 bp, Homo sapiens
  misc_feature: GYAE6OF02JAEG3.29.78.H01.1.454.CMB.1.raw
  modified_base (387)..(387): a, c, t, g, unknown or other
  misc_feature (387)..(387): n is a, c, g, or t
  modified_base (617)..(617): a, c, t, g, unknown or other
  misc_feature (617)..(617): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgcaggctccagggaaggggctggagtgggtctcggctattagtggcagtggtggcgctatatattatgcagacgccctgaagggccggttcaccatttccagagacaattcgaagacacgctgtatctgcaatggagagcctgagactcgacgacacggccgtctattattgtgtaaaggcgagctaggaactacggggaccgggcccgacgttgaccctacgtcggggaccgagggggaccncgtggtcacccgtctccgtcgacgtcctcccaccgaacgggcccacgtccggttccgtttcccccgtcggcctaccctccctaccgaacgacgccacctccggtacggggccacgacgcacgtcccgcggtccgtcgcccgtggtaccgaacggtaccttacgtccctacggttacctcgttactcgtaggacggtccggcgttcggacggacggccgtaccgagtacgngtcg

SEQ ID NO: 54793 - DNA, 695 bp, Homo sapiens
  misc_feature: GYAE6OF02HKQVF.29.78.H01.1.454.CMB.1.raw
  modified_base (259)..(259): a, c, t, g, unknown or other
  misc_feature (259)..(259): n is a, c, g, or t
  modified_base (335)..(335): a, c, t, g, unknown or other
  misc_feature (335)..(335): n is a, c, g, or t
  modified_base (692)..(692): a, c, t, g, unknown or other
  misc_feature (692)..(692): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaagggctggagtgggtctcggctattagtggcagtggtggcgctagtatattatgcagacgccctgaaggccggttcaccatttccagagacaattcgaanaacacgctgtatctgcaaatcggagagcctgagactcgacgtacacggcgtcgtattatgtagttaaaggcgacgntaggaactacgggacccgggccgtacgttcgaccacgtcggggcctaaggggacgctagggtccgaccgtcctccgtacacgtcccctaccaacccgaacgggccccacgttccggttcccttacccccgtgggacccctaccccgttcccgtaacccaacgtacgacccacccgttacggtacggggtaccaacgacgtaccgacggtcccggtacggtacgtcgtcccgttaggtaccggtaaaaggtaccccgttaaacgttacccgtacggttacctacccggttaacgtccgttacggaacgggtccgggtaccgttccgggacgtaaccgggtcgtaacgacgttacgganacg

SEQ ID NO: 54794 - DNA, 736 bp, Homo sapiens
  misc_feature: GYAE6OF02G163Y.29.78.H01.1.454.CMB.1.raw
  modified_base (146)..(146): a, c, t, g, unknown or other
  misc_feature (146)..(146): n is a, c, g, or t
  modified_base (205)..(205): a, c, t, g, unknown or other
  misc_feature (205)..(205): n is a, c, g, or t
  modified_base (271)..(271): a, c, t, g, unknown or other
  misc_feature (271)..(271): n is a, c, g, or t
  modified_base (729)..(729): a, c, t, g, unknown or other
  misc_feature (729)..(729): n is a, c, g, or t
tcagatagagtactcacgaccggtgctcgatttagtgtgagtagtttgggtttgggggcgcctgggtacggccggggggtcgcctgagactcgtcctgtgcggcctctggattaagtttaggagtcatgccaatgaactgggtccnccaggctccgagggtaagggctggagtgggtctcggctattacgtggacagtggtgcgntagtatattatgcagacgcccgtgaagggccgttcaccgtagtttccagagacaattcgaagaacncgctgatctgcaaatgagacaccgtgagactcgacgaacgtccggacccgtatacttagttaggtcggttaaaaggcgaacggcgttaggaaagttaaccggggtacccggggtacccgacgtttacggacccgtaaccggttcgggggacctacgggggaaccgtccgtaggacctacccggtactccgtaacggacgtcccttacccgaaccaaccgggtacccacgttacccggtcccttcccccgaagcccgtaacccttccctaaccaaccggtagacctaaccctacggtacgggccaaacgcgacgacggacccgtggccgtcgccgtacggtactaacgggaacctttacgttacccgtaggttacctacccgttaaggttccgtacggtaacgggtccgggtcgtaacccgggtcgttaaaccggggcccgttaacggacgtttacggngtaaccg

SEQ ID NO: 54795 - DNA, 675 bp, Homo sapiens
  misc_feature: GYAE6OF02I2J0M.29.78.H01.1.454.CMB.1.raw
  modified_base (204)..(204): a, c, t, g, unknown or other
  misc_feature (204)..(204): n is a, c, g, or t
tcagatagagtactcacgaccggtgctcgatttagtgtgagtagtttggggtttggggagagctctggggagtctgcaccatggctcggaccccactcctcttcctcaccctcctcctccactgcacagggtctctctcccagcctgtgctgactcaatccgcctctgcctctgcctcccgtgggacgcgtcggtcaaggtccnccgttgtactctgacgcgagtcggacacgagcaggtacaccggccagtccgcgtttaggccatcgagccgaggacggccacgacgaccgggtcccgttcgttacgttagattacgacgtagttaaccaacaacgttcgtaagtcgggactacgtaccacgacgggacggtaacggggggacggtacgtccctggactcgtacttcgtacgtacgtccggtcacgtcgtcgtggccgtagcgtcgtacctaccgactacgacgttccctccggacctccggtagttcgacggtacggtcgtacgggtaacgtccgtacgtctttaacgttcgttacgacgtacggtcggtcgggactacggtcgtacgttacgtcggacggtttaccggtccggggtaaccggtacggtaaccggtcgtaccgggttcggtccggtccgtaaccggaccgttaacccggcccctaacctcgg

SEQ ID NO: 54796 - DNA, 679 bp, Homo sapiens
  misc_feature: GYAE6OF02G2OQE.29.78.H01.1.454.CMB.1.raw
  modified_base (239)..(239): a, c, t, g, unknown or other
  misc_feature (239)..(239): n is a, c, g, or t
  modified_base (259)..(259): a, c, t, g, unknown or other
  misc_feature (259)..(259): n is a, c, g, or t
tcagatagagtactcacgaccggtgctcgatttagtgtgagtagtttgggtttgggggcagggtgtacacctgtggttctcgggctgccctttggctttggagatggttttctcgatgggggctgggagggctttgttggagaccttgcacttgtactccttgccattcagccagtcctggtgcaggacggtgaggacgctgaaccacacggtacgtgctgttgtactgctcctcccgngtctttgtcttggctattangccacctccgacgccgtcccacgtaccagttgaacttgacctcgaggtcttcgtggtctcgacgtccaccaccacgcatcgtgacctcgaggggtccggagactcatggaggtgttccgtttggggttttagggggaagtaaggtaacggacgtacggtaccggtccccccgtaagggacgtttccgagggtcgcggtcggggacgtaccggggtcgggcgtgtcggtggttaggtaggtttttgacgtaacgtaaggttagttttagggcctttaccttaacttttccgtttcgttcccgtaaccgttttgggttaccgtttcgtcgttcgggtctttggttacgtagtttccgtacggtttcgacgtaggtacgttggttacggtcgttcgggtcgaccgtaacgtcgtagtaccggg

SEQ ID NO: 54797 - DNA, 854 bp, Homo sapiens
  misc_feature: GYAE6OF02HGVJC.29.78.H01.1.454.CMB.1.raw
  modified_base (242)..(242): a, c, t, g, unknown or other
  misc_feature (242)..(242): n is a, c, g, or t
tcagatagagtactcacgaccggtgctcgatttagtgtgagtagtttgggtttggggggagagaggagtccacccctgggatcttcaggtgtttcatttggtgatcaggacggaacagagagaactcaccatggagtttgggctgagctggctttttctgtggcttaattttaaaaggtgtccagtgtgacgtgcaggttggtggaggtctgggggcgccgtgggtacgggccggggggtcnctgagctctcctgtgcggcctcgtggtattaaaggttttaggattcatcgccatgtaacgtcgggtccgccgaggcctccggaggggaaggggcgtgggaggtgggtcgtccgggctattaggtggcgtaggtgggtgcgtctaagttacttagttatcgcaacgaccgtcccgtaggaaccgggtccggttacctacccgtaacgttttaccgaacggtaacgtaaccgtaaacgttaccggaaaacgtaaaccgtaaccggtaccgtttacggttaacgttcgtaacggtaaccaaaaggttacggggtaaacggaaaccggttcccgtaacgggtaacggtaacccgtaacccggtaaaccgggaacccgtaacccggggttaacccgtttaccgttaaagttttacggtttaaggtttacgggtttaaaacggtcggtaaacggttacggttaacggggtaacggggttaaccccggggggtaaccccgggggtaccccggttaacccggttaaccgggtaacccgtaccggggttacccgggggacccggtaaccgggggggcccggtaccgggttacccgggttaccccggacccggttacccccg

SEQ ID NO: 54798 - DNA, 698 bp, Homo sapiens
  misc_feature: GYAE6OF02I25VQ.29.78.H01.1.454.CMB.1.raw
tcagatagagtactcacgaccggtgctcgatttagtgtgagtagtttggggtttggggagagctctggggagtctgcaccatggctcggaccccactcctcttcctcaccctcctcctccactgcacagggtctctctcccagcctgtgctgactcaatccgccctctgcctctcgcctcccgtgggaggctcggtcaacggtcaccgtgtactctgagcagtcggacacgagcacgctaccgccatcgcttaggcatcagcgaggacggccaggaccgaccgggtcccttacggttacttgtacgtagaacacgtacaaacaagtagacgtggacagcaagacggacggaacgggggacggtacgtccgtaggacgtccgtccttaccgtacgtacgttccgtaccgtacgtccgttaccggtcgggtacccgttgacggtcctaaccctaaccgtaccaaaccgtaaccgttcccgtacccggtcccttaccgtaggtccgtaacggacggtacgtcggtaacggtcgtaacgtaccgtttaacgttacggtcgtaacgtaccgggtacggtcgggtactacgggtcgtaccgtagttccggtacggttccggtaccgggaacccgggtacctaacgggtccgtaccggtcgtccggtacgaaccggtacccgaaccgtacccgtaacccgtacgg

SEQ ID NO: 54799 - DNA, 670 bp, Homo sapiens
  misc_feature: GYAE6OF02G3ZTE.29.78.H01.1.454.CMB.1.raw
tcagatagagtactcacgaccggtgctcgatttagtgtgagtagtttgggtttggggtctgagagaggagtccacccctgggatcttcaggtgttttcatttggtgatcaggacggaacagagagaactcaccatggagtttgggctgagcgtgcgttttctaggtggctaattttaaaaggtgtccagtgtgacgtgcagttggtggagtctgggggcgcctgggtacggccgggggggtcgcgtgagactctcctgtgcggcctctggattaagtttggagtcatgccagtgaacgtggtccgcgagctccgagggaagggctggagtggtcgtcgactagtagtggctagtgggtgcgtctagtatattagtgacgacgaccgtcccgtaggaacgggtccggtttacaccgtacgtttaccgagtaacgactaacgttacggaaacgtaaccgacgtacttacggtactacgtacgaaccaaagttcgggaaggtacgtcccgttaggaacgtaccgtacgaaccgtaaccgaccggtccgttattaacgtttagttaggtaacgttaaggacgtagtaccgtaggaacgggtaccggggacccggtccggtaacgttaccggaccgtacggtcgggaccgtacggggtacgtcgtacggtacccg

SEQ ID NO: 54800 - DNA, 690 bp, Homo sapiens
  misc_feature: GYAE6OF02GVN50.29.78.H01.1.454.CMB.1.raw
tcagatagagtactcacgaccggtgctcgatttagtgtgagtagtttgggtttgggggcggcctgggtacggccggggggggtcgctgagactctccgtgtgcggcctctggattaagttttaggagtcatgccagtgaactgggtccgccaggctccagggaaggggtctggagtgggtctcggctattagtggcagtggtggcgctatatattatgcagacgccctgaagggccgttcgaccatttccagtagacaattcgaagacacgctagtatctgcaaatggagagcctgagactacgacgacacggccgtctattattgtgttaaaaggcgagtcgtggaaataccggggaccgggccgtacgttggacccacgtggggaccagggaccgcgtggtacaccggtctccgtcacgcctaccaccgaaggccccagtccggtccttcccccgtagggacccacccgtccctaccgaaacggacgaccgaacccgttcggtacgggggtaccaccgtacggaccgtacggtccccgtggggacccttcgggcccgttacgggtaccctaaacgggtcccttaaaccgttccccgaaggttaccgtccttaacggttccgtcggaacggtaccggggcgtttaaccgggccgtaaacgggtcccggtaacgtacggttaggcctagg

SEQ ID NO: 54801 - DNA, 610 bp, Homo sapiens
  misc_feature: GYAE6OF02F18FQ.29.78.H01.1.454.CMB.1.raw
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccggggcccgacgttgaccacgtcggggccgaggggacgcgtggtcaccgtctcctcagccctccaccgaacggcccacgtccggtcccttcccccgtcggcccacccgtccctaccgaacgacgcctacccgtcgtcggggccacgcgcgacgcccgtgggcctcgcccgttggtaccgaacggaccgttaccttacgtacgttacctactacgtcgtggacggtcgggtcgtcggacgaacgggccggtacgacgtaggatcg

SEQ ID NO: 54802 - DNA, 739 bp, Homo sapiens
  misc_feature: GYAE6OF02J19XJ.29.78.H01.1.454.CMB.1.raw
  modified_base (528)..(528): a, c, t, g, unknown or other
  misc_feature (528)..(528): n is a, c, g, or t
tcagatagagtactcacgaccggtgctcgatttagtgtgagtagtttgggtttggggtctgagagaggagtccacccctgggatcttcaggtgttttcatttggtgatcaggacggaacagagagaactcaccatggtagtttgggctgagctggtctttttcttgtggctattttaaaaggtgtccagtgtcgacgtgcagttggtggagtcgtgggggcgaccgttggggtaccggggccggggggggtcacgtggacgaccttcgtccctggtggccggcctcgtggtatttaacgttttagggagtcatcgccatgaacctgggtacccgcgaggtcctccgaaggggacgggcgtggacggtcgggtctcgggctagttaggtggcgaggtcgggtgcgtacttatagttactagtcggcaggaccgcccgtagggacggggtcccggttacaccgtaactttcccgaagtacgaacgtacgttacggaaacgaccgtacgactagtactcgtcagtaaacgngggaagtacgacctggaacgtaccgtccggaccggaccgtaacccggtcccgttcgttaacgtttagtttcgggttaacggttaaacgggtacgtaggtacccgggtaggtaaaccgggtaacccgggggacccgggttaccccgtcgttaccgggtaacccggacgggtcccggggacccgtagggggtaccctcgggttcggtaccccg

SEQ ID NO: 54803 - DNA, 706 bp, Homo sapiens
  misc_feature: GYAE6OF02J0CKL.29.78.H01.1.454.CMB.1.raw
  modified_base (301)..(301): a, c, t, g, unknown or other
  misc_feature (301)..(301): n is a, c, g, or t
  modified_base (555)..(555): a, c, t, g, unknown or other
  misc_feature (555)..(555): n is a, c, g, or t
tcagatagagtactcacgaccggtgctcgatttagtgtgagtagtttgggtttgggggcgcctgggtacggccgggggggtcggcgtgagactctcctgtgcggcctctggattaagttttaggagtcatgccatgaactgggtccgccaggctccagggaaggggctggagtgggtctcggctattagtggcagtggtggcgctatatattatgcagacgccctggaacgggccggttcaccgtatttcccagtagaacaattccgaaagaacacggctgtaatctgtaccaaatggagngtcctgagactcgacgactacggcccgtacgatttagtagtaggttaaacggtcggagtaccgttaggaaacgttaacccggggggaacccggggtccccgttaaccgttacgtaccgaccgttcggggaccgacggggacgtcgtacgggttccaaccggtctccctacgacggccctaccgaacccgacggtcccgtacgtcccggttccttaccccccgtcggtcctacccctcccgtaccgtaacggacnccgtacctccggcggggtaccacgacgcgacgccgtacggtccacgtcgtcgtacgtaacgtcctaacgttccgacttacgtccttaccgtctacggacggtaccgggtccgttacggacgttaaccgggcgtaaccgtacggtcggactc

SEQ ID NO: 54804 - DNA, 708 bp, Homo sapiens
  misc_feature: GYAE6OF02IVGB3.29.78.H01.1.454.CMB.1.raw
  modified_base (338)..(338): a, c, t, g, unknown or other
  misc_feature (338)..(338): n is a, c, g, or t
  modified_base (420)..(420): a, c, t, g, unknown or other
  misc_feature (420)..(420): n is a, c, g, or t
tcagatagagtactcacgaccggtgctcgatttagtgtgagtagttttgggtttggggtccgagccatggtgcagactccccagagctctcctcctcctccactgcacagggtctctcctcccagcctgtgctgactcaatcgccctctgcctctgccctccgtgggagctcggtcaaggtcacctgtactctgagcagtggacacagcagctacgcagtcgcttggcatcagcagcggccagaccgaccgggcccttagttactgactagacagtacaacagtgagtggacagacacgaggcggaacgggggcgactccgagtactcgtcttcgacncgtctcgacgcgtcgtacgggcctaggacgtcgtacctacctcgaactacgtttcccgcccgtaccctacgtacgtttacgngggtaacgtacggtgacgtcgtaacggtaactttaacgttaccgttagtaccggtaaccgtacccgggttagggaccttacggttaccggtccgttttaaacgtttccgggtaccgggtttaaccgggttacccgggaaacccgggggtaccttaacggggtacccttacccgggttcgggttacccggtaaccgacccgggtaaaccccaaccgggtaccccctaaaccccgtttacgttacccggtacccgtacccggtttcccggttccccgtttaacccccccg

SEQ ID NO: 54805 - DNA, 936 bp, Homo sapiens
  misc_feature: GYAE6OF02F0G0N.29.78.H01.1.454.CMB.1.raw
tcagatagagtactcacgaccggtgctcgatttagtgtgagtagtttgggtttggggtctgagagaggagtccacccctgggatcttcaggtgttttcatttggtgatcaggacggaacagagagaactcaccatggagtttgggctgagctggctttttcttgtggctattttaaaaggtgtccagtgtgacgtgcagttggtggagtcgtgggggcgccgtggggtacgggccgggggggtcgcgtgagactctcctgtgcggcctcgtggtatttaaggttttaggagtcatgcctatgaacgttcgggtcccgccgaggtcctaccgaggggaaggggcgtgggtaggtggggtccgtcggacgttagttaggtggtacgaggttgggtgggcgacttaagttattagttagtcgtcaaggacccgtcccgttagggaaaccgggggtcccggtttaccgaacccgttaacgttttacccgaaggtaacgtaaccgtaaacgtttaccgggaaaacgtaaccgaacggtaccgttaggttaacttaccgttacgaaacccgtaaaaggttacggggaaaggtaccgtcccggttaaggaccggtaacccgttacccgggaaacccgggtaacccgggtaacccggggttaccccgtttaccgttttaaacgtttttaacggttttacgggttttaaacggggttttaaaaaccgggggaccgggttaacgggttacccgggtttaaacggggggtaaacccggggtttaaacccccgggggggggtaaacccccgggggggttaacccccccgggttaaccggttttaaccccgggaacccccggttacggggggtttacccgggggggaaccccggggtaacggggggggtaaccccggttccggggtttacccggggtttaaccccccgg

SEQ ID NO: 54806 - DNA, 672 bp, Homo sapiens
  misc_feature: GYAE6OF02IJFUM.29.78.H01.1.454.CMB.1.raw
  modified_base (297)..(297): a, c, t, g, unknown or other
  misc_feature (297)..(297): n is a, c, g, or t
  modified_base (352)..(352): a, c, t, g, unknown or other
  misc_feature (352)..(352): n is a, c, g, or t
  modified_base (668)..(668): a, c, t, g, unknown or other
  misc_feature (668)..(668): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagaccgccctggaagggccggttacaccctatttcccgagacgaacaattacgaagaacacgctgtatctgacaaatggaganccgtgacgactcgacgacgacggcccgttctatttattggtagttaaaggcgagntggaaacgtacggggacccgggtcccgacttcggaccgacgtcggggccagggggaccgtgcggtccacgtcctacctcgacgtcctacccgaccgaacggccccgacgtccggtccccttcccccgtcggccctacccctccctccaacgacgccaccgttcggtacggggactaccgcggaccacgtcccgtacgggtcctacgtcccggtacgtccgtaaacgtaccgttaaccgttcctacgttacctacgtaccgttacgtccggacgggtcggtccggttacggaccggtaacggacggaccgagtacgngacg

SEQ ID NO: 54807 - DNA, 653 bp, Homo sapiens
  misc_feature: GYAE6OF02GV54Y.29.78.H01.1.454.CMB.1.raw
  modified_base (220)..(220): a, c, t, g, unknown or other
  misc_feature (220)..(220): n is a, c, g, or t
  modified_base (406)..(406): a, c, t, g, unknown or other
  misc_feature (406)..(406): n is a, c, g, or t
  modified_base (587)..(587): a, c, t, g, unknown or other
  misc_feature (587)..(587): n is a, c, g, or t
  modified_base (648)..(648): a, c, t, g, unknown or other
  misc_feature (648)..(648): n is a, c, g, or t
tcagatagagtactcacgaccggtgctcgatttagtgtgagtagtttgggtttggggggagagaggagtccacccctgggatcttcaggtgttttcatttggtgatcaggacggaacagagagaactcaccatggagtttgggctgagcgtggctttttcttgtggcttattttaaaaggtgtccagtgtgacgtgcaggttggtggagtcgtgggggcnccgtggggtacgggccggggggtcggcgtgaggactctccgtgtgcggcctcgtggtattaagtttaggagtcatgcctatagtacgtcgggtccgcaggtcgtccgtaggggaagggcggtggaggtcgggtcgtcggtcgtagttaggttacggcgtaggtgggtggcgtcttatatatttagngacagaccgcctaggaacgggtccgttcgtaccctattcgacgacgtacattacgaagtaccacgtctagtaactcgagaactaaacggtggaaaggccgtaccgttagacgtaacgtccggaaacggccgaacgggtaccctttgtaactttagtacggttaaggttaaacggtgacgtntagggtacgcggggtacccggccgattcgaccgtaggtcgggcgagggccgtgacggtccnccgtc

SEQ ID NO: 54808 - DNA, 692 bp, Homo sapiens
  misc_feature: GYAE6OF02ILAIR.29.78.H01.1.454.CMB.1.raw
  modified_base (691)..(691): a, c, t, g, unknown or other
  misc_feature (691)..(691): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcgatgccatgaactgggtccgccaggctccagggaaggggctgggagtgggtctcggctacttaggtggctagtggtggcgctatatattatgcagacgcctgaagggccggtcacctatttccagacgacaattacgaagtaacacgctgttactctagactaagtggagacgtcgtagacgacgtacgacgaccgtaccggtccgtacttactttacgtttaggttaggttaacgggacgtacgacgtaggaacggtaaccggggacccgggtaccggtacgtcgaccgtacggtacggggacggaacggggccgtcgtcggtaccgtaccgtcctacctcgacaccctccgaaccgaaccggtccgtacgtcccggtccgttccccgtacggtcccgtacccgtaccctaccgaaccgtacgaccgtaccgtcgggtacgggaccaccgaccgaccgacgtccgtcggccgtccgtccgtacgtacgaacgtacttaccgtacgtactactacgtacgtcggtacggcggccggtacgacggacgtacggcgtacgagtacgnc

SEQ ID NO: 54809 - DNA, 728 bp, Homo sapiens
  misc_feature: GYAE6OF02FY41E.29.78.H01.1.454.CMB.1.raw
  modified_base (189)..(189): a, c, t, g, unknown or other
  misc_feature (189)..(189): n is a, c, g, or t
  modified_base (208)..(208): a, c, t, g, unknown or other
  misc_feature (208)..(208): n is a, c, g, or t
  modified_base (277)..(277): a, c, t, g, unknown or other
  misc_feature (277)..(277): n is a, c, g, or t
tcagatagagtactcacgaccggtgctcgatttagtgtgagtagtttgggtttggggtctgagagaggagtccacccctgggatcttcaggtgttttacgatttggtgatcaggacggaacagagagaactcaccatggagtttgggctggagcgggtgtggttctaaggtggctaagttttaaaaggntcagtgtgatgctgttggngagtgtggcgcgtgggtcgggcggggtcgcgtgagtctctctgtgcgctcgtgtagttaagttagtgtntatgactagtagacgtcggtccgacgacgtcgtacggagggacgggtcggtggtaggtcggtccgtacggtacgttagttaggtggacgtaggtggtcggtcggtactaagtaattaattagttagtacgtaaccgtaccgtaccggtacggtaacggtaccgttaccgtaaccgttaaccgtttaccgacgaacgtaacgttaacgtacggtaaaacgaaacgaacgtacgttacgtaactacgtacgagtaagtaggtacgtaggtcgtagagtaccgtaccgacgtaacgtaccggtaccgtacgttagtttaagtttacggttaggttaacgggtacgtacgtacgtaaggtacggtaaccgggtacccgggtacccggtaccggtacggtaaccggtaccggtacgggtaccgggtaacgggtaaccggtaccggtaccggtccgg

SEQ ID NO: 54810 - DNA, 631 bp, Homo sapiens
  misc_feature: GYAE6OF02HE6HZ.29.78.H01.1.454.CMB.1.raw
tcagatagagtactcacgaccggtgctcgatttagtgtgagtagtttgggtttggagtctgcaccatggctcggaccccactcctcttcctcaccctcctcctccactgcacagggtctctctcccagcctgtgctgactcaatcgccctctgcctctcgcctcccgtgggagctcggtcaaggtcacctgtactctgagcagtggacacagcagctacgcatcgcttggcatcagcagacggaccaggaccgaccgggcccttcgttactgatgacagtacaacaagtgagtggacagtcacgacggacggaagggggacggtatcccgtgacgttccgcttactcgacgttcctaccgagtcctcggtcgggacctggacgtccgtacctacctcaactactccgtacccggtcctacgagtcgaggacgtatcggacgtctacgtacttacgtacgtcgtacgacggtccggtcgggactacgtggacttacgtccgtagggtccgttaccggggaaccgggtactacgggtccgtaccgggttccgccggtacgtaacccggaacccgtacggtaaccccccgtaccgttacgtaccggttacccaccggtttcccggtacccccgg

SEQ ID NO: 54811 - DNA, 662 bp, Homo sapiens
  misc_feature: GYAE6OF02GMVM8.29.78.H01.1.454.CMB.1.raw
  modified_base (291)..(291): a, c, t, g, unknown or other
  misc_feature (291)..(291): n is a, c, g, or t
  modified_base (310)..(310): a, c, t, g, unknown or other
  misc_feature (310)..(310): n is a, c, g, or t
  modified_base (372)..(372): a, c, t, g, unknown or other
  misc_feature (372)..(372): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgagggccggtcacctatttccagagacaattcgaagaacacgctgtatctgcaaatggagagcctganactcgacgacacggccgtntattattgtgttaaaggcgagctaggaacgtacggggacccgggcccgtaacttggaacccngtcgggggaccgaggggaccgcgtagggtcctaccgttctcccgtacgacgtccctacccgaaccgaacgggcccacgtaccggttaccttcccccgtcggaccctaccctacccgtcccaacgtacgaccaccgtccgtcgggggcctacgacgccgacggcccgtggctcgcctcgggtaccgaacggtaccttaaccgttacccgtaaccgttaccttccgtacgtacgttacggaccggcgggttaccgtcgggtacgacgggcccgtacgtacgttaccggatcg

SEQ ID NO: 54812 - DNA, 661 bp, Homo sapiens
  misc_feature: GYAE6OF02H5QKD.29.78.H01.1.454.CMB.1.raw
  modified_base (318)..(318): a, c, t, g, unknown or other
  misc_feature (318)..(318): n is a, c, g, or t
  modified_base (632)..(632): a, c, t, g, unknown or other
  misc_feature (632)..(632): n is a, c, g, or t
tcagatagagtactcacgaccggtgctcgatttagtgtgagtagtttgggtttgggggcggcctgggtacggccgggggggtcgctgagactctcctgtgcggcctctggattaagttttaggagtcatgcccatgaactgggtccgccaggctcccagggaaggggcctggagtgggtctcggctattagtggcacgtggtggcgctatatattatgcagacgccctgaagggccggttcaccatttccagtagacaattcgaagaacacgctgtagtctgcaaagtgagagcctgagactcgacgacacggccgtntattagtgtagttaaagcgagctaggaacgtaccgggaccgggcccctacgttcgaccctacgtcgggggacctagggggaccgcgtcggtaccacccggttccgtccctcacgccccgtacccaaacccgtaacgggacccctacgtcccggttccccttcccccgtccggtcccgtacccctccctaccgaaccgtacgtaccgacccgttcgtaccgggggccacgtacgccgacgcccgtacggcgtaccgccgtcgtaccgtaaggccgttacgtcctagtactcgtacgtcgtacgacggtcggtcgnggtacgaccggtccgacgtacgtcgatcg

SEQ ID NO: 54813 - DNA, 675 bp, Homo sapiens
  misc_feature: GYAE6OF02GBUW4.29.78.H01.1.454.CMB.1.raw
  modified_base (243)..(243): a, c, t, g, unknown or other
  misc_feature (243)..(243): n is a, c, g, or t
  modified_base (550)..(550): a, c, t, g, unknown or other
  misc_feature (550)..(550): n is a, c, g, or t
  modified_base (653)..(653): a, c, t, g, unknown or other
  misc_feature (653)..(653): n is a, c, g, or t
tcagatagagtactcacgaccggtgctcgatttagtgtgagtagtttggggtttgggggcgcctgggtacggccggggggggtcgctgagactctcctgtgcggcctcgtggagttaagtttaggagtcatgccatgaactgggccgccaggctccaggggaagggggctggagtgggtctcggctattagtggcaggtggtgcgctatatattatgcagacgccctgaagggccgttcaccntttccagagacaaattcgaaagaacacgctgtaatctgacaaatgggagagcctgagacctgacgacaccggcgttacatttatgtagttaaaggcagctggaatacgggaccgggggaccccagttagacccagtcgggggaccaagggggccacgtggtctaacccggtctccctaccacggtcccctacccgaaccgaaacggggcccctaagtcccggggttaccctttccccccggtgggacccaaccccttccctaaccggaaacggcgaccacccgttacgggtacgggggcaaacccgngaccgaccggtcccgtcgggtaccgtcgtcgttacgggtaacctaaacggtacccttaccgtaccgaacttactacgttacgtcgtaggaccggtcgggtacncggacgaacggcactacgtagc

SEQ ID NO: 54814 - DNA, 792 bp, Homo sapiens
  misc_feature: GYAE6OF02FZ2XI.29.78.H01.1.454.CMB.1.raw
  modified_base (240)..(240): a, c, t, g, unknown or other
  misc_feature (240)..(240): n is a, c, g, or t
  modified_base (259)..(259): a, c, t, g, unknown or other
  misc_feature (259)..(259): n is a, c, g, or t
  modified_base (786)..(786): a, c, t, g, unknown or other
  misc_feature (786)..(786): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccgagggaagggctggagtgggtctcggctattagtggcagtggtggcgctatatattatgcagacgccctggaaggtccgttcactnttccagagacaattcgaanaacgacgctgtatctgacaaagtggagagtcctagagtacctagaccgaccgaccggccgtcttattacgttgtaacggtttaaacgggcgtaggtcgttagggaaacgttacccgggggacccggggtccccgtacgtttcgaccgtacgtcgggggaccgtacgggggactccgttgggtacctaccggttactcctaccgacggtccctacccgtaacccgaacgggccctacgtaccggttcccgtttacccccgtcggtcccaaccccttcccgtaccctaaacggaccgtacctacccgttacccggtcggggggtacccaccggtaaccggtaccgaccggtaccccggtcggggtacccgttcggtacccggttaccggtacccgttaaacgggtaccctttaacccggttacccgtaacccgttacgttacccgtttaccgtaccggttacggtaaccgggtccggggtaccgtaccggggtacggttaaccgggccggttaaccgtaacggttaccnccgtag

SEQ ID NO: 54815 - DNA, 755 bp, Homo sapiens
  misc_feature: GYAE6OF02IE3Q8.29.78.H01.1.454.CMB.1.raw
  modified_base (753)..(753): a, c, t, g, unknown or other
  misc_feature (753)..(753): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagacgacaattcgaagaacacgctgtatctgcaaagtggagagcctagacgactcgacgacgaccggccgtactatttagttagtagttaaaggcgagctagggaacgtaccggggacccggggtaccccgtacgttcgacccgacggtcgggggacccgagggggaccgcgtacgggtccgtacccggtccgtccctacgaccgtcccctacccgtaacccgaaccggggtcccctaacggttcccgggtttcccctttccccccggtacgggaccctaccccccgttcccgtacccgaacggacgtacccgtacccgttaccgggtacgggggacctaaccgacggaccgtaaccggccccgggttagggcccgttccgggacccgtttaccgggaccgtaaacgggttacccttaaccgttacccgtaaccgttaccgtaccttaacgtccggttacggacgggtccgggtacgtccgggacgacgggtccgacgttacgaccgngc

SEQ ID NO: 54816 - DNA, 746 bp, Homo sapiens
  misc_feature: GYAE6OF02INTJM.29.78.H01.1.454.CMB.1.raw
  modified_base (145)..(145): a, c, t, g, unknown or other
  misc_feature (145)..(145): n is a, c, g, or t
  modified_base (186)..(186): a, c, t, g, unknown or other
  misc_feature (186)..(186): n is a, c, g, or t
  modified_base (189)..(189): a, c, t, g, unknown or other
  misc_feature (189)..(189): n is a, c, g, or t
  modified_base (195)..(195): a, c, t, g, unknown or other
  misc_feature (195)..(195): n is a, c, g, or t
  modified_base (216)..(216): a, c, t, g, unknown or other
  misc_feature (216)..(216): n is a, c, g, or t
  modified_base (230)..(230): a, c, t, g, unknown or other
  misc_feature (230)..(230): n is a, c, g, or t
  modified_base (245)..(245): a, c, t, g, unknown or other
  misc_feature (245)..(245): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccnccaggctccagggaagggctggagtgggtctggctattagnggnagtggngcgctatatattatgcagacncctgaaggccgttnaccatttccagaganaattcgaagaacacgctgtatctagactaaatggatagcctgagacgtgacgacgaccggcccgtacgttaattaattgtagttaaaaggcgagtcgtaggaaacgttaccggggaaccgggaccccgtacgttcggaaccgtacgtacgggggaccgtaaggggtaccggtctagggttacccaacccgggttaccgtaccctaccggaacgtccccgttaaccccaaccggaaaccgggtaccccgtaacgttccgggttacccctttaccccccggtaccggtacccgtacccccgtacccgttaccgaaaaccggtacgggaccttaacccgttaccggacgggggtaccctaaccgaacgccgtaacgccccgttaggggactccggtccgtgggtaaccaaacggtaaccttaaccgtacccaaggttacctacttacgtcttacggaggtccgggtcgtagggtaccgacggtacgacctaaagtccgtatcgg

SEQ ID NO: 54817 - DNA, 670 bp, Homo sapiens
  misc_feature: GYAE6OF02FOO30.29.78.H01.1.454.CMB.1.raw
  modified_base (324)..(324): a, c, t, g, unknown or other
  misc_feature (324)..(324): n is a, c, g, or t
  modified_base (340)..(340): a, c, t, g, unknown or other
  misc_feature (340)..(340): n is a, c, g, or t
  modified_base (418)..(418): a, c, t, g, unknown or other
  misc_feature (418)..(418): n is a, c, g, or t
  modified_base (668)..(669): a, c, t, g, unknown or other
  misc_feature (668)..(669): n is a, c, g, or t
tcagatagagtactcacgaccggtgctcgatttagtgtgagtagtttgggtttgggggcgcctgggtacggccggggggggtcgctgagactctcctgtgcggcctctggattaagttttaggagtcatgccatgaactgggtccgccaggctccagggaaggggctggagtgggtctcggctattagtggcagtggtggcgctatatattatgcagacgcccgtgaagggtccggttacacctatttccagagacaattcgaagaacacgctgtatctgactaaagtggagacgcctagagactcgacgacacggcctctatnttgtagtaaggcgagntaggaacgtaccggggaccgggcccgtacgttcgaccgacggtgggggccgaggggacctcgtcggtcaccgtctccncgtacgccctaccgaacccgtacgcccgtacgtcccggttcccttccccccgtcggaccctaccccgtccctaccgaaccgacgtcccgtaaccctcggggttcggggacccaggtaccgccgaaccggtccccggtacgggtcgtccgtccggtacgggtaaccgtacggtaacccttcgtaccgtacgtacccgtactcgtccgtacggcgggtaccggtcgcggaacgacggcgtaccgtagaccgnng

SEQ ID NO: 54818 - DNA, 704 bp, Homo sapiens
  misc_feature: GYAE6OF02GBRCQ.29.78.H01.1.454.CMB.1.raw
  modified_base (433)..(433): a, c, t, g, unknown or other
  misc_feature (433)..(433): n is a, c, g, or t
  modified_base (701)..(701): a, c, t, g, unknown or other
  misc_feature (701)..(701): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaagggctggagtgggtctcggctattagtggcagtggtggcgctatatattatgcagaccgccctggaacgggccggttcaaccgtatttccgagagaactaattacgaagaaacaccgctgtatctgaccaaagtggagacgcctgaagtactacggacgaccgaccggtccgttacttagttacttaggtaggttaaacggcgtaacggccgtaggaacgtcccggggacccgggcccgacgttcgaccgacggtcggggccggaggggaccncgtcggtccgtccgtcctccgtccgacgcccgtaccgaccgtacgggaccctacgtccgtcccgttcccccgtcgcccgtaccctcccgtaaccacggaccaccgtaccgtcggttcggggaccacgacggccgaccggccgtacgggcgtccgtccgttacggtaccgtaacggtactttaacccgtaccgtaccgttaccgttaccttacgttccgtaacgtaccgggtccggtacggtcgggaaccgacggcgtacgacttgganacg

SEQ ID NO: 54819 - DNA, 648 bp, Homo sapiens
  misc_feature: GYAE6OF02HDZHH.29.78.H01.1.454.CMB.1.raw
  modified_base (250)..(250): a, c, t, g, unknown or other
  misc_feature (250)..(250): n is a, c, g, or t
  modified_base (273)..(273): a, c, t, g, unknown or other
  misc_feature (273)..(273): n is a, c, g, or t
  modified_base (329)..(329): a, c, t, g, unknown or other
  misc_feature (329)..(329): n is a, c, g, or t
tcagatagagtactcacgaccggtgctcgatttagtgtgagtagtttgggtttgggggcagggtgtacacctgtggttctcggggctgccctttggctttggagattggttttctcgatggggggctggggagggcttttgttggagaccttgcacttgtacctccttgccattcagccagtcctggtgcagggacggtgaggacgctgacccagacggtacgtgcttgttgtactgccttcctcccggnggtcttttgtcttggacatttancgccacctccacgccgtccacgtaccagttgacttgacctcgaggtcttcgtgtcncgtacgtccaccaccacgcatcgtcgaccgtcgaggggtccggagacgtcagtggagggttgttccggtttgggggtttagggggaaggtaggaagtacgtacggacccggtacccccgaggtacgttacgaggtcgcgtgggcgcgggtagggcagttcgtggtagtcgtttagacaatagtgttcgactctaacgttccttacgtcctacgttggttcgttgtcgtcggtcgttgttcgtattacgtacggttcgacgtagtacgttaggttaggttaccggttgggtaccgtacccggaagtccgttagtaccggg

SEQ ID NO: 54820 - DNA, 574 bp, Homo sapiens
  misc_feature: GYAE6OF02IKRH5.29.78.H01.1.454.CMB.1.raw
  modified_base (267)..(267): a, c, t, g, unknown or other
  misc_feature (267)..(267): n is a, c, g, or t
tcagatagagtactcacgaccggtgctcgatttagtgtgagtagtttgggtttgggtggtctctctcccagcctgtgctgactcaatcgccctctgcctctgcctccctgggagctcggtcaaggtcacctgtactctgagcagtggacacagcagctacgccatcgcttggcatcagcagaggccagacacgggccctgttacttgatgacagtcaacaatgatggcagtcacagcgaagggggacggatccctgactccgcttcncagtctccaggcttcgtgggcctggacgccgtctacctcactaactccgtccggcctccagtctggagtatggagctgacttattactgtacacgccgtggggcacgtcggctattcgaggttccgtaccgggaccgggacacggtccgtaccggtcgtcggtcaccgacccgacggacccaacccgcgtacgtcctacctcgttccgttaccccgcccttcctaccgtacgttcctacttacgttccgtggtaccgggtccgggtaccgtcgggaccgtaacgggccgtacgtacgtaggcgcgtg

SEQ ID NO: 54821 - DNA, 742 bp, Homo sapiens
  misc_feature: GYAE6OF02F9U8O.29.78.H01.1.454.CMB.1.raw
  modified_base (392)..(392): a, c, t, g, unknown or other
  misc_feature (392)..(392): n is a, c, g, or t
  modified_base (524)..(524): a, c, t, g, unknown or other
  misc_feature (524)..(524): n is a, c, g, or t
  modified_base (542)..(542): a, c, t, g, unknown or other
  misc_feature (542)..(542): n is a, c, g, or t
tcagatagagtactcacgaccggtgctcgatttagtgtgagtagtttgggtttggggtctgagagaggagtccaccccgtgggatcttcaggtgttttcatttggtgatcaggacggaacagagagaactcaccatggagtttgggctgagctggtcttttttcgttgtggctaatttttaaaaggtgtccagtgtgacgtgcagttggtggagtcgtggggcgcctggggtacgggccggggggtcgcgtgagactctccgtgtgccggccttcgtggtatttaacggttttaggagttcagtgccatcggtaactgggtcccaccggaggcctacccggaaggggtaacggggcgtagggacggtcggggtctcggtacttagttacggnggtacgtagggtgggtcgggctactaagttattacgttagtggacacggacgtcccgtagggaacgggtcccgttacgaccttacgttaccgaagagtactaagttacgaaagacgtacgcgtagtactcgngtaaccgtaagtgggaanccggtactacgggaagtaacccgtacggaaccgaaccgtcccgggtacccgtttagttacgttttagttaccgttaaggttaaaccggtgacgttacggttaacgggaacgggtaccccgggggtaccgggtaccctaacggtttcggacccggtacggttcgggggaacccgtaggggacccgttcggtacggtacccg

SEQ ID NO: 54822 - DNA, 891 bp, Homo sapiens
  misc_feature: GYAE6OF02IDGKG.29.78.H01.1.454.CMB.1.raw
  modified_base (306)..(306): a, c, t, g, unknown or other
  misc_feature (306)..(306): n is a, c, g, or t
tcagatagagtactcacgaccggtgctcgatttagtgtgagtagtttgggtttgggggcgcctgggtacgaccgggggggtcgctgagactctcctgtgcggccctctggattaagttttaggagtcatgccatgaactgggtccgccaggctccgagggaagggctggagtgggtctcggctattaggtggcagttggtggcgctatatattatgcagacgccctaggagggccggttcacctatttaccagagactaattacgaagaacacgctgtaattctgacaaagtggagacgcctgganactcgaacgaccgacggccctacttattaagtttaggtaggttaaacggacggtaggtccgtaagggaaacggtaccggggggaaccccggggacccgtacgttccggaacccgtaacggtccgggggaccggaaggggggaccggtcctacggggttacccgaacccggtttcccgtaccctaccgaccggtcccccgtaaccccgaacccgggtaaacccgggtacccccgtaaacggttccccgggtttcccccgtttcccccccggtttaccgggacccccgttaaccccccggttccccgttaaacccggaaaaccggtacccggtaacccggttaaccccgtttcccggggtaccggggggttaccccaaaccgtaccggacccgtaaccgggcccccgggttacggggtacccgttacccgggtcccgttaaccgggttaaccgtaaaaaccggttacccgttaacccgtttacccgtaaccgtttaccgtacccgtttaaccggttaccggtaacgggaccggggtaccgggttacccgtacgggaccgtaacgggtaccgtagtaacgtacgggcg

SEQ ID NO: 54823 - DNA, 657 bp, Homo sapiens
  misc_feature: GYAE6OF02I9NUW.29.78.H01.1.454.CMB.1.raw
  modified_base (340)..(340): a, c, t, g, unknown or other
  misc_feature (340)..(340): n is a, c, g, or t
  modified_base (430)..(430): a, c, t, g, unknown or other
  misc_feature (430)..(430): n is a, c, g, or t
  modified_base (655)..(655): a, c, t, g, unknown or other
  misc_feature (655)..(655): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccgagggaaggggctggagtgggtctcggctattagtggcagtggtggcgctatatattatgcagacgccctggaagggccgttcaccactttccagagacaattcgaagaacacgctgtatctgacaaagtggagagcctagagactcgacgacgaccggccgtctattattgtgttaaaggcgagngtaggaagtaccggggacccggggccgtacttacgacccacggtcggggccgaggggaccgtcgtcggtccaccgtcctcctccacgccnccaccgacggtcccacgtccgttcccttccccgtcggccctaccctccctaccgaacgtacgacctacccgtcgggttcggggccgacgtacgccgacgtcccgtcggggcctccgtcccggttgggtaaccgaacgggtacccttaaccgttacccgtaacgttacccttataccgttcgtaccgggacggtccgggtcgtacggacggacggcgacgagtagncg

SEQ ID NO: 54824 - DNA, 744 bp, Homo sapiens
  misc_feature: GYAE6OF02JNN4U.29.78.H01.1.454.CMB.1.raw
tcagatagagtactcacgaccggtgctcgatttagtgtgagtagtttgggtttggggtccgagccatggtgcagactccccagagctctcctcctcctccactgcacagggtctctctcccagcctgtgctgactcaatcgccctctgcctctgccctcccgtgggaggcgtcggtcaaggtcacctgtactctgagcagtggacacagcagctacgacctactcgtcgtcgtacgtacgtacgacgacgacggacgaccgacgaccgaccggtaccgttaccgttacgtacgttacgtaacgtaacgtaaccgtaacgtaacgtaacgtaaacgtacggtacgtacggtaccgaacggtaacgtaacggaacgggaacggtaacgggtaaccggtaacggtaccgtacgtacgttaccgtaccgtacgtaccgtacgtaccgtaccgtacgtacggtacgtacggtaccgtacgtaccgtaccgtaccgtaaccgtaccgtaccgtaccgtaccgtaccgtaccgtaccgtacggtacgtacgtacggtacgtacgtacggtacgtacgtaacgttacgtacgtacgtacgtacggtaccgtacggtacgtacgtacgtacgtacgtacgtaccggtaccggtaccgtaaccggtaccgtaccggtaccggtaccggtaccgtaccggtaccgtaccgaccgtaaccgtaccgtaccgtaccgtaccgtaccgtaccgtaccg

SEQ ID NO: 54825 - DNA, 729 bp, Homo sapiens
  misc_feature: GYAE6OF02JZ2L6.29.78.H01.1.454.CMB.1.raw
  modified_base (162)..(162): a, c, t, g, unknown or other
  misc_feature (162)..(162): n is a, c, g, or t
  modified_base (243)..(243): a, c, t, g, unknown or other
  misc_feature (243)..(243): n is a, c, g, or t
  modified_base (257)..(257): a, c, t, g, unknown or other
  misc_feature (257)..(257): n is a, c, g, or t
  modified_base (517)..(517): a, c, t, g, unknown or other
  misc_feature (517)..(517): n is a, c, g, or t
tcagatagagtactcacgaccggtgctcgatttagtgtgagtagtttgggtttggggtctgagagaggagtccacccctgggatcttcaggtgttttcatttggtgatcaggacggaacagagagaactcaccatggagtttgggctgagctggtctttttnttgtggctaattttaaaaggtgtccagtgtgacgtgcagttggtggagtcgtggggcgccgtgggtacgggccggggggtnctgagactctctgngcgcctgtggtattaaggttttagagtcagtgcagtgaacgtcggtccgcgacggtcgtcgaaggggacggggctagggaggtgggtcctcggcgttaagttaggtcgggtcgtaagggttgggacggtcggtaacttaagtagttaagttagttcggaccgtaacggacccggtcccgtagggtaaacgggttcccgttacgaaccgttactttaccgaagtacgaactaagtacgaaagacagctagtactcgagtanaagtgagacgtcgtaagacggtaccgtaacgacgaccggaaccggtcctttaacgttaacgtttagtttaagttaacggttaaaagggcgtacgggttacgtaggtaaacccggggccgggggtaaaccccggccggtaaccgttaaccgacccgggttacggtacccggggggacccggtacgggggacccttacgggtcgggtaaccccg

SEQ ID NO: 54826 - DNA, 772 bp, Homo sapiens
  misc_feature: GYAE6OF02IOK9H.29.78.H01.1.454.CMB.1.raw
  modified_base (149)..(149): a, c, t, g, unknown or other
  misc_feature (149)..(149): n is a, c, g, or t
tcagatagagtactcacgaccggtgctcgattttagtgtgagtagtttgggtttggggtccgagccatggtgcagactccccagagctctcctcctcctccactgcacagggttctctctcccagcctgtgctgactcaatccgccctntacgccttctcgccctcccgtggggacggcgtcggtaccgaacggttcctaccttgtactctagagcgaggtggacacgagcagcctaccgacctagttccgtcgtttggacctacgtaccgagccgaaggaccggaccgaacggaccggtaccgggtccccttacggtttacgtagacgttacgaacgtaacgtaaccaaacgtacgtagtacgtcggactagtacacgacggacgggaacgggggtacgtaacgttaccgtagtacgttccgtcgttctccgtacgtacgtcgtagtctacggtcggtcgtacgacgtaccgtacctaccgtactacgtaccgtccgtacccggtaccttccggtactcggtaacggtacgtcgtaacgggtaccgtaccgttaccgtaacgttttaccgtaccgtttcgtaacgacccgtaccgggttaggccttaacggtcggtaacttcggtaccggttcgggttacccgggacggaacccgggttaacgaccgggttccgtaaccgggtccgtacgggttacccaccggtacccggtaaccgtaaccccgtacgttaccggttccgtacccgttccgttccgtaccccgttaccccg

SEQ ID NO: 54827 - DNA, 809 bp, Homo sapiens
  misc_feature: GYAE6OF02HADIP.29.78.H01.1.454.CMB.1.raw
  modified_base (802)..(802): a, c, t, g, unknown or other
  misc_feature (802)..(802): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctggaacgggccgttcacctatttccagagacaattcgaagaacacgctgtatctgactaatggagagcctgacgacgtcgacgaccgaccggtcccgtactatttagttaggttaggttaaaggccggaacggaccccggggtaaagtaccccggggggaccccggggtacccccggtaacgtttccggaacccgtaccggtcgggggacccgggaacgggggtaccgtccggttacgggtacccgacccggttcctaccctccgaccgtccccgtaccccgaacccggaaccggggcccctaaccggttccccggttccccgtttacccccccgtccgggtacccctacccccgtcccgtaacccgtaacggaacccgtcccgtaaccccgttccggggtccgggggtacccaccgaacgccgaccggcccgttcggggcctacggtcccgtagggtaccgaacggttacccttaccgttacccgtaacgttccttaccgttaccgttacgtaccgggtacgggtcccggggttacgtaccggggtacgaaccggggtacgtaaccggaggtaccggtnacggtcg

SEQ ID NO: 54828 - DNA, 708 bp, Homo sapiens
  misc_feature: GYAE6OF02FSZJR.29.78.H01.1.454.CMB.1.raw
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctggaacgggcccggttcacctatttcccgagagaaccaattcgaaagaaccacgctgtactctgacaaagtggaagagcctgaacgcgtcgacgaccgacggtccgtctatttagttgtacgttaaaggcgtagtcgtagggaaacggtaccggggacccggggtcccgtacgttcgacccgtacgtcgggggaccgacgggggacgtacgtcggtcccgaccggttcctccgtaccgcgtacccgtcccgaaccgtaaccggggccccgtaacgttccccggttacccgtttccccccgtccggtaccccgtaccccttcccgtacccgaacgaacgccctaacccgttcggtcgggggaccaccgacggaccgaccggtcccggtcgggccgtccggtccgtcggtaccgtaacggaccttacgtaccgtacttacgtctacgtcaggtcgcggtcgccggacgacggccgtagacgtcagtcg

SEQ ID NO: 54829 - DNA, 697 bp, Homo sapiens
  misc_feature: GYAE6OF02IHGJY.29.78.H01.1.454.CMB.1.raw
  modified_base (314)..(314): a, c, t, g, unknown or other
  misc_feature (314)..(314): n is a, c, g, or t
  modified_base (696)..(696): a, c, t, g, unknown or other
  misc_feature (696)..(696): n is a, c, g, or t
tcagatagagtactcacgaccggtgctcgatttagtgtgagtagtttgggtttggtggtctctctcccagcctgtgctgactcaatcgccctctgcctctgcctccctgggaggctcggtcaaggtcacctgtactctgagcagtggacacagcagctacgccatcgcttggcatcagcagaggccagacacgggcctcgttactgatgacagtcaaacaatgatggcagtacacagacggaaagggggacggatcccgtgactcgtcttctcagtcctaccagcctcgtacggggcctgacgccgtctaaccncctaataacgttccgtcccggtacctccgagtccgtaggacggacttggaacggtcttaggtaacttagttacgtacgtacgtaacggtccggtaggggaccctaggtcggtacgtaacgtttccggacgggtttacggttacccggggtaaccggggaaccctaagggttccgaaccggttccggttaccgggtacctaaccggacccgtaaaccggaccccttaaaaccccggacttacgttacccgtacgtttaccgtcgtttacccgtaccctaacccgttcccgttaacccgtaacggttacccttaccgttacgttcccgtacgggaccgggttccgggacgttcgggaccgtaacgggccctagaaccgttgacng

SEQ ID NO: 54830 - DNA, 806 bp, Homo sapiens
  misc_feature: GYAE6OF02IYRP9.29.78.H01.1.454.CMB.1.raw
  modified_base (803)..(803): a, c, t, g, unknown or other
  misc_feature (803)..(803): n is a, c, g, or t
tcagatagagtactcacgaccggtgctcgatttagtgtgagtagtttgggtttgggggcgccctgggtacggccgggggggtcgctgagactctcctgtgcggcctctggattaagttttaggagtcatgccatgaactgggtcccgccaggctccgagggaaggggctggagtgggtctcggctattagtggcagtggtggcgctatatattatgcagacgccctgaacgggccgttcaccatttccagagacaattcgaagaacacgctgtatctgacaaatggagagccgtgagactcgacgacgacggcccgtcttaatttagttggtaggttaaacggcgtagcgtagggtaaacgtaccgggggacccggggaccccgtacgttaccgaccgtaaccggtcgggggaccggacgggggaccgtccggttacggtaccgtaacccggttcctcccgttacgaacccggtccccgttaccccgaacccggtaaaccgggggacccccgtaacggttaccccgggtttacccccgttttccccccccgttcgggtacccctacccccgttaccccgttaaccccgtaaacgggacccgtacccgtacccgttccgggtaccgggggtacccaaccgtaccggacccgtaccgggtaccccgttggggtcccgtaccgggtcccgttacgggtacccgtaaacgggtaccctttaaccgttacccgtacgttaccttcgttaccgttcgtacggtacgggtccgggtacgttacggacggaacggtccgaccgtagtacgnacg

SEQ ID NO: 54831 - DNA, 570 bp, Homo sapiens
  misc_feature: GYAE6OF02HQY8Q.29.78.H01.1.454.CMB.1.raw
  modified_base (381)..(381): a, c, t, g, unknown or other
  misc_feature (381)..(381): n is a, c, g, or t
  modified_base (433)..(433): a, c, t, g, unknown or other
  misc_feature (433)..(433): n is a, c, g, or t
  modified_base (568)..(568): a, c, t, g, unknown or other
  misc_feature (568)..(568): n is a, c, g, or t
tcagatagagtactcacgaccggtgctcgatttagtgtgagtagtttgggtttgggggcgccctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaggcgagctggaatacgggaccggggcccacgttgaccacgtggggccagggggcncgtggtcaccgtctcctcagccctcaccgaacggcccatcggtccttccccnggccaccctcctccaagcgcaccctgcgggggcacgagccacgcccgtgggcctggcccgtggtccgaaggtacctaccttcccagtaccttctagttctcgaggtccgggctgggccaagggccgtacgagtgncg

SEQ ID NO: 54832 - DNA, 633 bp, Homo sapiens
  misc_feature: GYAE6OF02FG4QZ.29.78.H01.1.454.CMB.1.raw
  modified_base (315)..(315): a, c, t, g, unknown or other
  misc_feature (315)..(315): n is a, c, g, or t
  modified_base (475)..(475): a, c, t, g, unknown or other
  misc_feature (475)..(475): n is a, c, g, or t
  modified_base (515)..(515): a, c, t, g, unknown or other
  misc_feature (515)..(515): n is a, c, g, or t
  modified_base (525)..(525): a, c, t, g, unknown or other
  misc_feature (525)..(525): n is a, c, g, or t
  modified_base (629)..(629): a, c, t, g, unknown or other
  misc_feature (629)..(629): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaagggctggagtggtctcggctattagtggcagtggtggcgctatatattagtgcagaccgccctaggaacgggtccggttcacctatttccagagacaattcgaagaacacggctgtatcgtgacaaagtggagacgtcctggagactcgacgacncggccgttctattattgtagttaaaggcgtagctaggaagtaccggggcccggggtcctacgttgaccgacgtggggaccgaggggacgctcgggtcaccggtcgtccttcgactccgtcccaccgaacgggtcccagtccggttcctccccgtggaccnccctacctaccagacgccacgtccgtgggccagacgtccncggtacccgnggtaccctgccttacgggtacaacggtaaactcctttacccgagtttaccacttacgtccgtaggacggtcgggtacctgggtacgacgggtaccagaactggngtcg

SEQ ID NO: 54833 - DNA, 873 bp, Homo sapiens
  misc_feature: GYAE6OF02HFMTX.29.78.H01.1.454.CMB.1.raw
  modified_base (143)..(143): a, c, t, g, unknown or other
  misc_feature (143)..(143): n is a, c, g, or t
  modified_base (174)..(174): a, c, t, g, unknown or other
  misc_feature (174)..(174): n is a, c, g, or t
  modified_base (199)..(199): a, c, t, g, unknown or other
  misc_feature (199)..(199): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactggtccnccagctccgagggaagggctggagtgggtcncggactattagtggcagtggtgcgntatatattatgcagacgcctaggacgggtccgttacacctactttccgagacgaactaatcggaaacgaacctaccggcttagtaactccgtagaccgtaaaagttggaagtacgaccgttaggacgtaaccgtcggaaccgtaaccggaccggtaccgttacttaagtttacgtttacggttaacgttaaaacggcggtaacgtacgttacgggtaaaacggttaaccgggggaccccggggtaaccccgtacggttaaccggtaacccgaacggttccgggggaaaccggtacggggtaacccgtcgttacggtaccctaacccggtctacccgtacgaccggtccctaacccggaaacccggtaaccggtacccgtaacggttcccggttaccccgtttaccccccgtacgggtaccccctaccccgttacccgtaacccgtaaaccggtaaccgtacccgttaacccggttaaccgggttcggggtacccaaaccgggtccgtaaccgtaccggtaaccccggttcgggtacccgtcggtacccgttacgggttaacccgtaacggttacccgttaacgttcccgtaacgttacccgttcgttaccgtcgttaaccgggtacggacggttaccgtaggaaccgtacggaccgtacgtacgtacgtccgag

SEQ ID NO: 54834 - DNA, 736 bp, Homo sapiens
  misc_feature: GYAE6OF02JLFFC.29.78.H01.1.454.CMB.1.raw
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccgagggaaggggctggagtgggtctcggctattagtggcagtggtggcgctatatagttatgcagaccgcccgtggaacgggtccggttacacctatttccgagacgacaattcgaaagaacacgctagtatctgacaaagtggagacgcctgagactcgacgacacggccgtactattagtgtaggttaaggcgagacgtagggaacgtaccggggaccggggccccgtacgttacgacccacggtacggggccgtaaggggaccgtcggtcggtccaaccgttcctccctcgacgtccccgtacccgaaccgaaccgggcccctacggtcccggttacccgtttccccccgtaccggtaccctaaccccgtcccgtaccaacggacgtacccgtacccgttccggtcgggggacctaaccgacgacccgtaccggtacccgtcgggtaccgttccggtacccgttcgggtaaccgtaaccggtaaccgttaaccgttaccgtaaccgttaccttaccgtacgttccgtacggaagggtccgggtaccgtacggacgacgggccgtactacggtagcgtacg

SEQ ID NO: 54835 - DNA, 793 bp, Homo sapiens
  misc_feature: GYAE6OF02F9S29.29.78.H01.1.454.CMB.1.raw
tcagatagagtactcacgaccggtgctcgatttagtgtgagtagtttggtttggggcgcctgggtacgccggggggtcgctgagactctcctggtccgcggcctacgtggacttaaggttttaggacgttcaacttgtccagtgaaccgtgggtccgaccaggctccgagggaagggctcggagtgggtctccggcgtattacgtggcacgtggtgcgctatatagttatgcagacgccctaggaagggtccggttctaccgtagtttacccaaggtacgacaaactttacgtaaacgaacaccgcttaggttagtcgttggaccaaagttcggaagtacgaccgtaggaacgtaccttacgacgtacgacgtccgtacttaattagttcgttagttaaaggtcgagtcgtacggaacttacgggaccgggtcccgtacgttcggaccgtacgtacggggaccgtacgggggaaccgcggtacgggtacgacccggttctaccctacgacggtacccgttcccaaacccggaacggggaccctaacggttccggttacccgttacccccggtcggtacccgaaccccgtttacccgttaacccgaacgtaaccgtaccttaccgttaccggtacggggaccacgtaacggtaccgaaccggtccccggtacgggccgttaccggaccgttcgggtaaccgtaacggtacgttaaccttaccgacgttacgtaccttacgtcgtgacggtcggtaccgtacggaccgtacggtaccgtacgtacgtacgctacg

SEQ ID NO: 54836 - DNA, 621 bp, Homo sapiens
  misc_feature: GYAE6OF02GLNP7.29.78.H01.1.454.CMB.1.raw
  modified_base (380)..(380): a, c, t, g, unknown or other
  misc_feature (380)..(380): n is a, c, g, or t
  modified_base (591)..(591): a, c, t, g, unknown or other
  misc_feature (591)..(591): n is a, c, g, or t
  modified_base (619)..(619): a, c, t, g, unknown or other
  misc_feature (619)..(619): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattatgtgttaaagcgagctggaatacgggaccgggcccgacttcgaccacgtggggaccagggggcncgtcggtcaccgtctcctcacgcctccaccaacgggcccagtccggtccttcccccgtgccacccgtcctacccaacgaccgaccacccgttccggtcgggggtaccaccgacggccgaaccgtccccggtgggtcctcggtccgttcgggttaccgaacggaccgttaccttaccgagttacctacttacgtctaggacggccggggtcncgggacgacgggaccggtcagtacggtncg

SEQ ID NO: 54837 - DNA, 716 bp, Homo sapiens
  misc_feature: GYAE6OF02GEV3W.29.78.H01.1.454.CMB.1.raw
  modified_base (277)..(277): a, c, t, g, unknown or other
  misc_feature (277)..(277): n is a, c, g, or t
  modified_base (293)..(293): a, c, t, g, unknown or other
  misc_feature (293)..(293): n is a, c, g, or t
  modified_base (406)..(406): a, c, t, g, unknown or other
  misc_feature (406)..(406): n is a, c, g, or t
  modified_base (674)..(674): a, c, t, g, unknown or other
  misc_feature (674)..(674): n is a, c, g, or t
  modified_base (711)..(711): a, c, t, g, unknown or other
  misc_feature (711)..(711): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctggaacgggccgttacacctatttccaagagacaattcgaagaacacgctagtanctgacaaagtggaagngcctgacgactcgacgacacggccgtctattattgtagttaaaggcgagcgtaggaacgtacggggacccgggccctagttcgaaccgtacgtcgggggccgagggggtaccnccgttgggtaccacccggttcctcccgtacgacggccctacccgaaccgaacgggcccctacgttcccggtccctttacccccgtcggaccctaccccgttccctacccggaaacgtacccggcctaacccgttcgggtcgggggaccctacgaccggtccaccgtcccggtacggtccgtccgtcccgtacggtaaccgaaacggtccttaaccgttcccgaacgtttaccctaccgttaacgtccgtaacggtccgggtacccggngttaccgggaacgaaccgggtccgtaacctaggtacncgtcg

SEQ ID NO: 54838 - DNA, 684 bp, Homo sapiens
  misc_feature: GYAE6OF02FET0P.29.78.H01.1.454.CMB.1.raw
  modified_base (277)..(277): a, c, t, g, unknown or other
  misc_feature (277)..(277): n is a, c, g, or t
  modified_base (289)..(289): a, c, t, g, unknown or other
  misc_feature (289)..(289): n is a, c, g, or t
  modified_base (343)..(343): a, c, t, g, unknown or other
  misc_feature (343)..(343): n is a, c, g, or t
  modified_base (405)..(405): a, c, t, g, unknown or other
  misc_feature (405)..(405): n is a, c, g, or t
  modified_base (682)..(682): a, c, t, g, unknown or other
  misc_feature (682)..(682): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtggtctcggctattagtggcagtggtggcgctatatattatgcagacgccctggaacgggtccggttcacctatttccagagacaattcgaagaacacgctgtatcngacaaatggganagccgtagagactcgacgacaccggtccgtctattattgtagttaaaggcgtancgtaggaacgtaccggggacccggggcccgattcggacctacgtcggggaccgagggggccncggtcggtaccaccgtctcccgtacgcgtccctccgaaccgaacgggccctacgtccggttcccttcccccgtcggccctacccctccctaccgaacgacgtaccaccctcggtacgggggcctaacgacgccgaccgtcccggtcgggtccgtccggtccgtacgggtaccgaaacgtaccgttcccttaccctaccgttaccttaccgtacgtaccgttaggaccggtcggggtaccggtacgggaccggaacggggtaccgcgaacgttacggncg

SEQ ID NO: 54839 - DNA, 581 bp, Homo sapiens
  misc_feature: GYAE6OF02I5CMS.29.78.H01.1.454.CMB.1.raw
  modified_base (329)..(329): a, c, t, g, unknown or other
  misc_feature (329)..(329): n is a, c, g, or t
  modified_base (542)..(542): a, c, t, g, unknown or other
  misc_feature (542)..(542): n is a, c, g, or t
  modified_base (578)..(578): a, c, t, g, unknown or other
  misc_feature (578)..(578): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcggacgacacggccgtctattatgtgttaaaggngagctggaatacgggccgggccacgttgaccacgtggggccaggggacgcgtggtcaccgtctcctcacgcctccaaccgacgggccccacgtccggttccttcccccgtcggcctccctccctccaacgacgccacctcggtcggggccacgacgcacgcccgtcgggctcgccgtggtacaacgaccttactccgagtacctctacgttcnggtacggcggtcgtaggtacgacggcgaccagtagnacg

SEQ ID NO: 54840 - DNA, 785 bp, Homo sapiens
  misc_feature: GYAE6OF02H1BDM.29.78.H01.1.454.CMB.1.raw
  modified_base (223)..(223): a, c, t, g, unknown or other
  misc_feature (223)..(223): n is a, c, g, or t
  modified_base (780)..(780): a, c, t, g, unknown or other
  misc_feature (780)..(780): n is a, c, g, or t
tcagatagagtactcacgaccggtgctcgatttagtgtgagtagtttgggtttgggggcgcctgggtacggccgggggggtcgctgagactctcctgtgcggcctctggatttaagttttaggagtcatgccatgaactgggtcccgccaggctccgaggggaaggggctggaggtgggtctcggctagttagtggcaggtgggtggcgactatatattatgnagacgcctggaagggtccggttcacctatttccagagtaacaatagaagaacacgtctgtatctagactaaagtggagacgcctgaagtctacggacgtaccgaccggtccgtacttaatttacggttagttacggttaaaaggcgtagtacgtagggtaaacggtaccggggtacccggggacccctacgtttacgacccgtacggccgggggtaccggacggggaccgtcggttacgggtccctaccggttccctccgttcgaccgtccctacccgaacccggaaccgggtccctaacggttcccggtccccttttcccccggcgggtcccctaaccccttccgtaacccaagggaccgttcccaccgtttcgggtaccggggaccctacgaacggtccaccgggtcccggtgggtccctacggtccccgtaggttaccaagggttaccttaccgttaccgtacgttaccgtttaccgttcgtaccggttacggacccgggggttacgggccgtaccgggttacggaaccggggtcccgtaagtacggttaacgnaccgg

SEQ ID NO: 54841 - DNA, 886 bp, Homo sapiens
  misc_feature: GYAE6OF02ISGU4.29.78.H01.1.454.CMB.1.raw
  modified_base (316)..(316): a, c, t, g, unknown or other
  misc_feature (316)..(316): n is a, c, g, or t
  modified_base (515)..(515): a, c, t, g, unknown or other
  misc_feature (515)..(515): n is a, c, g, or t
tcagatagagtactcacgaccggtgctcgatttagtgtgagtagtttgggtttggggcagggtgtacacctgtggttctcggggctgccctttggctttggagattggttttctcgagtggggggctgggacgggtctttgttcggagaccttgcctactttgtactccttgcctagttcagcctagtcctggtgcaggtacggtgacggacgtcctgaacccaacgtacggttacgtgtccttggttcgtaaccgtcgtcccgtcccgtccccgggtcggttcttttcgttaccgttgggaccttaagtttaacncggcccctaaccgttccccgaacccggtcccgttaccccgtaaccggttaacccgtaacggttttacgtaaccgtttacgtacccgttccggtaacgggttccgttcggtccggtaccgttaccgtacccgtacccacccgtaaccaccgtacctagttccggtcgtaccgttcggtacggggtaccgggagtactagnggtcggtacgggttcgtttccgggtttaggggggtttaacgggggaaagtacggggtaacgtccggttaccgggaccccggttccccggtaagggttaccggtacgtacgggtacggtccggtacgggtaccgggtcgggtacggaagttcggttacggtggttcggttactttacggacgttaaacgtcggttaacggtttcgggtaaccctttacgttaaccggttttaccgtaccggttacccggtttacggtttcggttagttccggttcggttacgttgttcgttacgtacgtttccgtacgtgacgttacggtggtttacggttcggttacggttggtccctaggtaaccggttcgcggtacggg

SEQ ID NO: 54842 - DNA, 781 bp, Homo sapiens
  misc_feature: GYAE6OF02G7VT2.29.78.H01.1.454.CMB.1.raw
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccgaggggaagggctggagtgggtctcggctagttaggtggcaggtggtggcgacttatatattagtgcgagtaccgccgtaggaacggggtcccgttaccaacctatttccgaagtacgaactaacttacggaaaacgaaccgaacggtccttaggtaactccgtagactaaagtggacgagtccgtagacgacgtacgacgacgacggtccgtactaagttacgttgtaaggtaagcgacgtcgtaaggaacgtaccggggaccggcctacgttcgactacggtcggggccgaaggggctcgtcggaccgtaccgttccgtaccgtcgaccgtaccctaccgaaccggtacccgggtaccctacggttcccggtttaccccgttccccgtccgggacccctaaccccgttaccgaaaccccggtagacccgtaaccgttcccgtacggggtaccgggtcccaacgggtaccgaccggtaccggtacccccggttggcccgtcgtacccgttcggtaacgtaaccgggtaacttacccgtaccgaacgtttcctaaccgttcgtaacgggtcggtacgggccggtaaccggttcggaaccggttacgccggtacgttacgacggctag

SEQ ID NO: 54843 - DNA, 632 bp, Homo sapiens
  misc_feature: GYAE6OF02FKQ9C.29.78.H01.1.454.CMB.1.raw
  modified_base (395)..(395): a, c, t, g, unknown or other
  misc_feature (395)..(395): n is a, c, g, or t
  modified_base (459)..(459): a, c, t, g, unknown or other
  misc_feature (459)..(459): n is a, c, g, or t
  modified_base (484)..(484): a, c, t, g, unknown or other
  misc_feature (484)..(484): n is a, c, g, or t
  modified_base (629)..(629): a, c, t, g, unknown or other
  misc_feature (629)..(629): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccgttcacattccagagacaattcgaagaacacgctgtatctgacaaatggagacgcctgagactcgacgacaccggccgtactattattgtagttaaaggcgtaggctggaagtaccggggacccggggcccgacgttgacccgtacgtgggggccagggggacncgtggtcacccgtctccctcacgccctacccgaccgacgggcccagtccggtcccttcccccgnggccctaccctaccctaccaaggcncctacccgtcggtcggggccacgacgtccgaccgtcccggtacgggtcctcggtccgttacggtaccgaacggtaccttaccgttccgacgttacctcgttacgtcgtaggacggtccggacgtggacgacggcgtacgagtcgntcg

SEQ ID NO: 54844 - DNA, 825 bp, Homo sapiens
  misc_feature: GYAE6OF02ICRO6.29.78.H01.1.454.CMB.1.raw
  modified_base (820)..(820): a, c, t, g, unknown or other
  misc_feature (820)..(820): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaacgtgggtccgccaggctccgaggggaagggcctggagtgggtctcggctattagtggcagtggtggcgctatatattatgcagacgccctaggaacgggccgttcaccgtatttaccgagagaaccaagttacgaaagaacacgctgtatctagacaaagtggagacgctgagacgtacgacgacacggccgtactagttagttagtaggttaaaggcgacggaccggtaaacggtaccgggggacccggggtacccgtacgtttacggacccgtacgggtggggccccggaagggggtaccgtccggttacgtcccggtaacccggtccgttcccgtccgaccggtccccttaccccgaacccggaacccggggtacccctaacgggttccccggtttacccccgtttacccccccgggtcgggtacccccgtacccccgttccccgtaaacccgtaaacggacccggtaccctaaccccggttcggtacccggggggttaacccgaaccgtaccggtacccgacccgggtccccggtacggggtccgtacccggtaccggttacggtaccgtaaacggttacccgttacccgttaccgtaacggttacctaccgttaacgtcgtacggaccgggtcgggtaccgtacggaacggtacggtacccggacgtaacggtagtcgngtacg

SEQ ID NO: 54845 - DNA, 841 bp, Homo sapiens
  misc_feature: GYAE6OF02F0W6V.29.78.H01.1.454.CMB.1.raw
  modified_base (224)..(224): a, c, t, g, unknown or other
  misc_feature (224)..(224): n is a, c, g, or t
tcagatagagtactcacgaccggtgctcgatttagtgtgagtagtttgggtttggggtctgagagaggagtccacccctgggatcttcaggtgttttcatttggtgatcaggacggaacagagagaactcaccatggagtttgggctggagcgtggtctttttcttgtggctaatttttaaaaggtgtccagtgtgacgtgcagttggtggagtcgtgggggcnccgtggggtacgggccggggggtcgctgacgactctccgtgtgcggcctcgtggatttaaggttttaggagtcgatcgccagtcgaacgtcgggtcccgccgaggcctaccgaggggaagggcgtggaggtcgggtctcggtcttagttacggtggcgtaggttgggtcggacgtacttaagtacgttaagttagtcgcaacggacccgtccctagggaaacggggtcccgtttaccaacccgttacttttacccgaaggtaaccgtaacgtaaacgttaccggaaaacgaaaccgtaaccggtacgttaagttaacgtaccgtaacggaactaaagggtacgggaacgtacggtaacccgtgggaaacggtacccgttaccgggaaccggtaacccggacccgggttacccgtttacgtttaacgtttttaagtttacggttaaacgggtttaaacgggccggtaacggtaccggttaacggggtaaaccgggttaaccccggggggggaccccgggttacccccggtaacggtttacccggaacccggtaacccggggtttcgggggaaccccggtaacgggggtacccgttaccgggtaccgggttacccccgg

SEQ ID NO: 54846 - DNA, 565 bp, Homo sapiens
  misc_feature: GYAE6OF02HUHUQ.29.78.H01.1.454.CMB.1.raw
  modified_base (395)..(395): a, c, t, g, unknown or other
  misc_feature (395)..(395): n is a, c, g, or t
  modified_base (549)..(549): a, c, t, g, unknown or other
  misc_feature (549)..(549): n is a, c, g, or t
  modified_base (558)..(558): a, c, t, g, unknown or other
  misc_feature (558)..(558): n is a, c, g, or t
  modified_base (564)..(565): a, c, t, g, unknown or other
  misc_feature (564)..(565): n is a, c, g, or t
tcagatagagtactcacgaccggtgctcgatttagtgtgagtagtttgggtttgggggcgcctgggtacggccgggggggtcgctgagactctcctgtgtggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgatctgcaaatggagagcctgagactcgacgacacggccgtctattattgtagttaaaggcgagctggaatacggggaccggggcccgacttgaccactggggccaggggacgcgtggtcaccgtcncctcacgcctccaccaacgggcccacgtcgtccttcccccgtcggccacccgtccctccaaacgcgccaacctcgtcggggcacacggcacgcccgtcggctcgccgtgtacgaacggactaacgtcctagtacttactactctcgagcgggcnggcgagcgngatagnn

SEQ ID NO: 54847 - DNA, 775 bp, Homo sapiens
  misc_feature: GYAE6OF02I4ZYY.29.78.H01.1.454.CMB.1.raw
  modified_base (208)..(208): a, c, t, g, unknown or other
  misc_feature (208)..(208): n is a, c, g, or t
  modified_base (222)..(222): a, c, t, g, unknown or other
  misc_feature (222)..(222): n is a, c, g, or t
  modified_base (246)..(246): a, c, t, g, unknown or other
  misc_feature (246)..(246): n is a, c, g, or t
tcagatagagtactcacgaccggtgctcgatttagtgtgagtagtttgggtttggggtctgagagaggagtccacccctgggatcttcaggtgttttcatttggtgatcaggacggaacagagagaactcaccatggagtttgggctgagcgtggtctttttctagtggctaagttttaaaaggtgtccagtgtgacgtgcagttggnggagtcgtggggcnccgtgggtacgggccggggggtcncgtgacgtactctcctgtgcggcctcgtggtaattaagtttaggagtcatgccatcgaacgtcggcctaccgagccgtaccgaagggaagggtcgtagggacgtcgggttacgtcggactagttacgtcgggtacaggtcggtaggcgacgttaatatttaagtaagtcgaccgtaacgaccggtaccccgttaggaaacggggtacccggtttcaacccgttaacgtttcccgaaagaacgtaacgtaaaccttacgaaaacgtaacgaccgtaccgttaggtaaacttcgtacgactaaaaacggttggaagacggtaccgtagaacgtacccgtaagacgtaaacccgtccgggaacccgttaagtttactttaacggtttaacgtttaggttaaaaacgggccgtaaggggtattaaccggggtaaacggtaacccgggggtacccgggaaccccggttaacttacccgggacccgtacgggtacgggggaacccgtaagggggcccgtacgttccgggtacccg

SEQ ID NO: 54848 - DNA, 581 bp, Homo sapiens
  misc_feature: GYAE6OF02JLMU3.29.78.H01.1.454.CMB.1.raw
  modified_base (281)..(281): a, c, t, g, unknown or other
  misc_feature (281)..(281): n is a, c, g, or t
  modified_base (454)..(454): a, c, t, g, unknown or other
  misc_feature (454)..(454): n is a, c, g, or t
  modified_base (494)..(494): a, c, t, g, unknown or other
  misc_feature (494)..(494): n is a, c, g, or t
  modified_base (573)..(573): a, c, t, g, unknown or other
  misc_feature (573)..(573): n is a, c, g, or t
  modified_base (580)..(580): a, c, t, g, unknown or other
  misc_feature (580)..(580): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactggtccgccaggctccagggaagggctggagtgggtctcggctattagtggcagtggtggcgctatatattatgcagacgccctgaagggccgttcaccatttccagacgacaattcgaagacacgctgtatctgcaaatgganagcctgacgactcgacgacacggccgtctattagtgtagtaaaggcgagtcgtaggagtaccgggaccggggccctacgttcgaccacgtcggggaccgacgggggacgacgttggccaaccgtcctccctcgacgtccctccaccgacgggcccagtccgtccttcccccgngcccacctcctcaacgacgcaccgtcgtcgggctacgacncacgccgtcggcgtcgccgtacggacaacggctactccacgttactcctagtctgacggcggtcgtagccgtagccgtnacgtagnc

SEQ ID NO: 54849 - DNA, 715 bp, Homo sapiens
  misc_feature: GYAE6OF02FVTUD.29.78.H01.1.454.CMB.1.raw
  modified_base (193)..(193): a, c, t, g, unknown or other
  misc_feature (193)..(193): n is a, c, g, or t
  modified_base (280)..(280): a, c, t, g, unknown or other
  misc_feature (280)..(280): n is a, c, g, or t
tcagatagagtactcacgaccggtgctcgatttagtgtgagtagtttgggtttggggtccgagccatggtgcagactccccagagctctcctcctcctccactgcacagggtctctctcccagcctgtgctgactcaatcgccctctgcctctgcctccgtgggagctcggtcaaggtcacctgtactctgancagtggacacagcagcctacgccatcgcttggcatcagcaggaggccagacgaccgggtcccttacgttacttgatgacagtacaanaatgatggcagtacacaggacgaacgggggggacgtactcccgtgactccggtcttcgtccaggtcctaccgagtccgtacgtcgggcctaggaccgctacctaccctcaccaacttcccgtcccggtcctaccgaggttccctagggaaacggtcgtagggacggtaccgttagtaaccttaacgtttacccgtcggtacccggtacggtaccccggggtggggtacccttaacggtccggtaccgtttaacggttacccgggttacgggtttacccggttaccccgggggaaaccgggtaccgtaaaccggggttcctaacccggggtttcggtaacccggaccggtaacccggtaaccccggaacgggtccccccaaaccccgttacggttccgttaaacccgcccgttttcccggtcgtttacccccccgg

SEQ ID NO: 54850 - DNA, 638 bp, Homo sapiens
  misc_feature: GYAE6OF02GLDPX.29.78.H01.1.454.CMB.1.raw
  modified_base (410)..(410): a, c, t, g, unknown or other
  misc_feature (410)..(410): n is a, c, g, or t
  modified_base (635)..(635): a, c, t, g, unknown or other
  misc_feature (635)..(635): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgccaggctccagggaaggggctggagtgggtctcggctattagtggcagtggtggcgctatatattatgcagaccgccctgaagggtccggttcaaccatttccagagacaattcgaagaacacgctgtatctgacaaatgggagcgcctgacgacgtccgacgacaccgggcctctattattggtagttaaaggcgagtcgtaggtaaacgtacggggacccggggccctacgttcggacccacgtcgggggccgaacgggggccncggtcggtaccgtacccgtcgtcctcgacgtccctccgaaccgacgggccctacgtccggtcccttccccgtcgccctaccctcctaccgaacgcgaccgacctccggtacggggccacgacgaccgacgccgtcgggcctcgtccctggtaccgaacggtactaccgttcctagttacctcgttatcggtagtacgggcggtcgtggacgagccgactacgagntcg

SEQ ID NO: 54851 - DNA, 629 bp, Homo sapiens
  misc_feature: GYAE6OF02HUPU2.29.78.H01.1.454.CMB.1.raw
  modified_base (208)..(208): a, c, t, g, unknown or other
  misc_feature (208)..(208): n is a, c, g, or t
  modified_base (304)..(304): a, c, t, g, unknown or other
  misc_feature (304)..(304): n is a, c, g, or t
  modified_base (329)..(329): a, c, t, g, unknown or other
  misc_feature (329)..(329): n is a, c, g, or t
  modified_base (334)..(334): a, c, t, g, unknown or other
  misc_feature (334)..(334): n is a, c, g, or t
  modified_base (404)..(404): a, c, t, g, unknown or other
  misc_feature (404)..(404): n is a, c, g, or t
  modified_base (549)..(549): a, c, t, g, unknown or other
  misc_feature (549)..(549): n is a, c, g, or t
  modified_base (626)..(626): a, c, t, g, unknown or other
  misc_feature (626)..(626): n is a, c, g, or t
tcagatagagtactcacgaccggtgctcgatttagtgtgagtagtttgggtttgggggcgcctggggtacggccgggggggtcgctgagactctcctgtgcggcctctggatttaagttttaggagtcatgccatgaactgggtccgccaggctccgaggggaaggggctggagtgggtctcggctattagtggcaggtggtggcgtntatatattatgcagaccgccctaggaacgggtccgttacacctatttccgagacgactaattcgaaagacacgctgtatctgactaaagtggagancctgagctacgacgacgacgccgtntattntgtagttaagcgagcgtagaacgtacgggccgggcctagtcgaccgaacgtcggggaccgacggggtacncggtacggtctacccggtctcccgtacgacgccctaccaccggaacggtcctacgtccgttcccgttccccgcggtccctaccctacctaccgaacggtacacctaccgtcggacgggcctacgacgcacgtcccggtacggtcncgtcgtcgacgtacgtactctccagtcctactcgtcgtcgtcgggtccgcgtggaccggtacggccgtagcgttagntag

SEQ ID NO: 54852 - DNA, 699 bp, Homo sapiens
  misc_feature: GYAE6OF02HYEQ5.29.78.H01.1.454.CMB.1.raw
  modified_base (267)..(267): a, c, t, g, unknown or other
  misc_feature (267)..(267): n is a, c, g, or t
  modified_base (695)..(695): a, c, t, g, unknown or other
  misc_feature (695)..(695): n is a, c, g, or t
  modified_base (699)..(699): a, c, t, g, unknown or other
  misc_feature (699)..(699): n is a, c, g, or t
tcagatagagtactcacgaccggtgctcgatttagtgtgagtagtttgggtttgggggcgcctggggtacggccgggggggtcgctgagactctcctgtgcggcctctggattaagtttaggagtcatgccatgaactgggtccgccaggctccgagggaaggggctggagtgggtctcggctattaggtggcagtggtggcgctatatattatgcagacgccctggaacgggccggttcacctatttccagagactaattcgaaanaacacgctgtatctagacaaagtggagagcctggacgtacgtacggacgaccgaccgggcccgttacttaagttttatttagggttaacggttaaacgggcgtaacggtcgttagggaaacggtaccggggggacccggggtacccgtcgttacggaaccgacggtcggggggaccgagggggaccgcgtacgggtccgtaaccggtcctccgtacacggcccttacgacccgaacggggtccctacgttcccggtcccgttcccccgtcggtaccctaccctccctaaccgaacgacgcctacccgtcgggtcggggaccacgagccgaccgccggtcgggcgtcgtccgtcggtactaacggtcctaccttaccgacgttctctacgtcgtgacggtccggtcgtagggctaaggccctagtacgngacn

SEQ ID NO: 54853 - DNA, 765 bp, Homo sapiens
  misc_feature: GYAE6OF02FW919.29.78.H01.1.454.CMB.1.raw
  modified_base (677)..(677): a, c, t, g, unknown or other
  misc_feature (677)..(677): n is a, c, g, or t
tcagatagagtactcacgaccggtgctcgatttagtgtgagtagtttgggtttggggtctgagagaggagtccacccctgggatcttcaggtgttttcatttggtgatcaggacggaacagagagaactcaccatggagtttgggctgagctggctttttcttgtggcttaattttaaaaggtgtccagtgtgacgtgcagttggtggagtcgtgggggcgccgtggggtacgggccggggggtcgcgtagagactctccgtgtcgcggcctcgtggtaactttaaggttttaggagttcattcgccagttacgaaccgtcgggtcccgaccgagggtcctaccgggaacggggggaacgggggtccgtaggggtacgggttcggggttccgtccggggtactttaagttaggggtcgggacgtagggttggggtcgggcgtacgttaattaatttagttagtcggtacgtaacggacccgtcccggttagggaaaccggggtccccggtttacccacccgttaagttttacccgaaggtacgtaactaaacgtttaccggaaacgaaacgtacgtcgttacgttactacgtacggaactaaaggtcgggaagtacgtccgtagaccgtacgtacgaccggacgccggtccgttatagtttagttagtacggtaagntacggtgtacgggaacggtaccgggggacccggtacctaacgttccgacgtacgggtcgggaccgacggggtcgtacgtcggtacccg

SEQ ID NO: 54854 - DNA, 721 bp, Homo sapiens
  misc_feature: GYAE6OF02JS6DG.29.78.H01.1.454.CMB.1.raw
  modified_base (185)..(185): a, c, t, g, unknown or other
  misc_feature (185)..(185): n is a, c, g, or t
  modified_base (215)..(215): a, c, t, g, unknown or other
  misc_feature (215)..(215): n is a, c, g, or t
  modified_base (528)..(528): a, c, t, g, unknown or other
  misc_feature (528)..(528): n is a, c, g, or t
  modified_base (717)..(717): a, c, t, g, unknown or other
  misc_feature (717)..(717): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgcaggctccgagggagggctggagtggctcggctattgtggnagtggtgcgctatattattgtgcaggaccnccgtgaacgggtccgttacaccgtatttcccgagagacaagttcgaaagacacgctagtaatcgtgacaagtggagacgcctaggacgtacctacggacgaccgtaccgggtcccgttctattttaagttgtaaggtttaaacggcggtaacggtcgtacggtaaacgtacccggggacccggggtaccccttaacgtcgggaaaccttacggcggggaccggtaagggccgtcggtacgtaccgtaccgttcgtccctagccgcccgtaccgaccgtacgggcctacgtccggttccctcccgtcgtacccnccttccacctaagccgacctaccgtcgggcgggtcccgaatacggtacgtaccggtccgttaacgggcctacgggttcccgaaggttccgaaacggttaccctaccgttaccgaacggtttcctaacgggtctaccgtagggaacggttcccggtcgtaccgggaacgtacgcggaacgcgtaccggtnaacg

SEQ ID NO: 54855 - DNA, 711 bp, Homo sapiens
  misc_feature: GYAE6OF02JEWHR.29.78.H01.1.454.CMB.1.raw
  modified_base (144)..(144): a, c, t, g, unknown or other
  misc_feature (144)..(144): n is a, c, g, or t
  modified_base (289)..(289): a, c, t, g, unknown or other
  misc_feature (289)..(289): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccncgaggctccgagggaagggctggagtgggtctcggctagttagtggcaggtggtgcgctatatattatgctagacgccgtagaacgggccgttacaacctatttccgaagacgacaagttcgaaagaaccacgctagtaacttcngacaaagttggagagcctgacgactcgaacgtaaccgacggtaccgtctaattattcgttagtaaaggcgagctaggaactacgggaccgggccctacgttcgaccgacgttacggggacaaagggggtccgacgtggtaccgaaccgttctccgtacgaagtcccctaccgaaaccgtacgggacccacgtacccggttaccgtttccccccgtagggccctaacccgtcccgttaaccgtaacgtaaccgtaccgtaccggttaccggtacgggacctaaccgagtaccgaccgtacccgtgggtcctcggttaccgtcggtaacgaacggtaccgttaaccggtaccagttaccgtacgtacggttctaacgtaggtaccggcgttacggacggaccggtcgtacgtacgttagcgtac

SEQ ID NO: 54856 - DNA, 823 bp, Homo sapiens
  misc_feature: GYAE6OF02HBV68.29.78.H01.1.454.CMB.1.raw
tcagatagagtactcacgaccggtgctcgatttagtgtgagtagtttgggtttggggtccgagccatggtgcagactccccagagctctcctcctcctccactgcacagggtctctctcccagcctgtgctgactcaatccgccctctcgcctctcgcctcccgtgggaggctcggtcaaggtcacctgtactctgagcagtaggacacagcagcctacgccatcgcttggcagtcaagcaggagaccagaccgacgggtcccttgttactgatagacagtaccaaataatcggaagtggcctaagtaccagacgggtaccgggaaagggggtacggtactcccgtaggtaacttccgtacgttcgaaccgtagtcccgttaccgtcgtccgttaccggtcgggtcctagggtaaccgtccgtacccttaacccgtaacgaccttaaccgtcccgtaccccggtaccctaccgtaacggttaccggtagggtaacggtacggtacgggtaacggtcccttaacggttaaaccgtttaacgtttaacccgtacggttaccgaaaccggtacccgggttaacgggggtacccgttaaccggttcgggtacctttaaacggttcccgggttaaaccggggtttcccggtttaacccgggggaaaccggggttaacccggttaaccgggggttaccccgttaccgggtttcccggggtaaccggtaccgtaacccgggtacccccgggaaaccggtaaacccccgtaacccccgttacgtaacccggtttaccctaacccggtttcccttaccccgggttccccccc

SEQ ID NO: 54857 - DNA, 682 bp, Homo sapiens
  misc_feature: GYAE6OF02GX3OG.29.78.H01.1.454.CMB.1.raw
  modified_base (292)..(292): a, c, t, g, unknown or other
  misc_feature (292)..(292): n is a, c, g, or t
  modified_base (424)..(424): a, c, t, g, unknown or other
  misc_feature (424)..(424): n is a, c, g, or t
  modified_base (680)..(680): a, c, t, g, unknown or other
  misc_feature (680)..(680): n is a, c, g, or t
tcagatagagtactcacgaccggtgctcgatttagtgtgagtagtttgggtttgggggcgcctgggtacggccgggggggtcgctgagactctcctgtgcggcctctggatttaagttttaggagtcatgccatgaactgggtccgccaggctccagggaaggggctggagtgggtctcggctattagtggcagtggtggcgctatatattatgcagacgccctggaacgggccggttacacctatttccagagacaattcgaagaacacgctgtatctgacaaatggagancctgagactcgacgacacggccgtctattattgtagttaaaggcgagctagggaagtacggggacccggggccgacgttcgaccgacgtgggggccgaacggggacgtcgtacggtccgaccgttctcctcncgtcccgtaccaccgaaccgggcccacgtccggttccccttcccccgtacgccctcccttacctccaaacggtccaccctacccgtccgggtacgggggcccaacgtcgcccgacgtacccggtccgggtcgtcgtacccgtcgggtaccaaacggtaccttaccgttacccgaaggtttcccttacgttaagtccgttagggtaccggaccggggtccgttcgggaaccgtaacgggcccgaagtacggtagtcncg

SEQ ID NO: 54858 - DNA, 717 bp, Homo sapiens
  misc_feature: GYAE6OF02JD09T.29.78.H01.1.454.CMB.1.raw
  modified_base (220)..(220): a, c, t, g, unknown or other
  misc_feature (220)..(220): n is a, c, g, or t
  modified_base (241)..(241): a, c, t, g, unknown or other
  misc_feature (241)..(241): n is a, c, g, or t
  modified_base (605)..(605): a, c, t, g, unknown or other
  misc_feature (605)..(605): n is a, c, g, or t
tcagatagagtactcacgaccggtgctcgatttagtgtgagtagtttgggtttgggggggagagaggagtccacccctgggatcttcaggtgttttcatttggtgatcaggacggaacagagagaactcaccatggagtttgggctgagcgtcggtcttttctggtggcttagttttaaaggtgtcagtgtgacgtgcagttggtggagtcgtgggggcnccgtgggtacggccgggggtncgtgagactctcctgtgcggctcgtggtattaaggtttgagtcagtcggccatgaacgtcgggtccgcgaggtcctccggaaggggaagggcgtgggagggtcgggtcgtcgggtacttagtacggtcggtagtggttgggtacggcggtcttaggttaattgtaagtcgcgaacgtacccgccggttaaggaacggggtccggttaccaccgttatttacccgagtacgaacgtaacgttacggaaacgtaaaccgtacggtccgttagtaccgtacgttacggaacgtaaaggtaccgggtaagacggtcccgtagaaccgtcggtacacgggtaacccacggttaccgtacttaacgtttnttacgttaggtaaacgtcgtagtacgtagggtacggtaccggggtacccgggtccttacggtcgaccgtagggtcccgggagtacggggctaccgggtcgtccgtcgtaccg

SEQ ID NO: 54859 - DNA, 633 bp, Homo sapiens
  misc_feature: GYAE6OF02GFAFB.29.78.H01.1.454.CMB.1.raw
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtactattatgtagttaaaggcgtagctggaactacggggaccgggcccgtacttcgaccacgtcggggaccgaggggacgcgtggtcaccgtctccgtcacgccctccaccgaacgggcccacgtccggtcccttcccccgtcggaccctaccctccctacccgaacgacgccacctcgtacggggccacgacgccgacgcccgtacgggcgtcgccgtcggtacgtaaacggtaccttaaccgttcctaacgtaccttaccgtaacgttcgtacggacggtccggtacgtacggacgaacgggtccgacgtaacgtagctacg

SEQ ID NO: 54860 - DNA, 667 bp, Homo sapiens
  misc_feature: GYAE6OF02HE1J7.29.78.H01.1.454.CMB.1.raw
  modified_base (430)..(430): a, c, t, g, unknown or other
  misc_feature (430)..(430): n is a, c, g, or t
  modified_base (446)..(446): a, c, t, g, unknown or other
  misc_feature (446)..(446): n is a, c, g, or t
  modified_base (665)..(665): a, c, t, g, unknown or other
  misc_feature (665)..(665): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgcaggctccgaggggaaggggctggaggtgggtctcggctattaggtggcaggtggtggcgctatatattatgcagaccgccctaggaacggggtccggttacacctatttccgaagacgaactaattacgaaagaaccacgctagtactctgactaaaagtggaagacgcctggaacgtacgtaccgaacgacgaccggcccgttatattagttgtaaggttaaaggcgagcgtaggaaagtaccggggaccgggccgattcgacacggtggggaccaggggacncgtggccacgtctccnacgccctccaaccgtaacggaccacgtccgtcctcccccgtggccctacccgtcctaccaagacgacctaccgtacggtcggggaccacgacgaccgacgcccgtacgggcctacggcccgttgggtaccgaaaggtacctaaccgttacgtacgttaccgttacttacgtcgttacgacgggtcggtccggtacggacgacgggccgtacacgtaggnag

SEQ ID NO: 54861 - DNA, 836 bp, Homo sapiens
  misc_feature: GYAE6OF02FYBOI.29.78.H01.1.454.CMB.1.raw
tcagatagagtactcacgaccggtgctcgatttagtgtgagtagtttgggtttggggtccgagccatggtgcagacctcccagagctctcctcctcctccactgcacgagggtctctcctcccagcctgtgctgactcaatccgccctctcgcctctcgcccttcccgtggggacggtccgtcggtacaaggtccaccgttgtacctctgagcgaggtcggaacacgagcacgcctacgcctagtccgtcgttggactactcgagacgaggacggaccaaggaccggtacccggggtcccctttaggtttaccgttagatcgaacctagtaccaaacgagtgacggtggactacgtccaacggaacgggacgggtaaacgggggggacggtaccttacccggtaggaccttccggtaccttccgtacgtacgttcccgtaccgacggtccgtttacgggtcggtccgacggcggtccccgtacctaacctaccgaactaacgttcccgacccggtacccttaccgtacgttacgtacgggtacggtacggtacgggtacgtccgttaagttaaccgtttaagtttaccgttaccggtacgtaccgggttacccgggtcggggtaccgtacggttccggtaaccgttcgtttaccgggtacggggtttacccgggtaccgggggaaacccggggtaaccgtaccgggtttcccggtaacccgggttccgggttaacccgggaccgtaaccccgggaaacccgtaacccggtaacccctaacccccgtcggttaaccggtcccctttaacccgttcccgttaccccgttaaccccccg

SEQ ID NO: 54862 - DNA, 602 bp, Homo sapiens
  misc_feature: GYAE6OF02I0L60.29.78.H01.1.454.CMB.1.raw
  modified_base (485)..(485): a, c, t, g, unknown or other
  misc_feature (485)..(485): n is a, c, g, or t
  modified_base (600)..(601): a, c, t, g, unknown or other
  misc_feature (600)..(601): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgacaaatggagacgcctagagtactacggacgaccgaccggccgtactatttagttgtagttaaaggcgagctaggaacgtacgggaccgggccgacgttcgaccacgtcggggcccaggggaccgcgtggtccaccggtctcctcacgtccctccgaaccgacgggacccactccggtcccttcccctcgtccaccctcctaccacgacnccaccgtcgtcgggacacgacgcgacgccgtcggctcgccgtcgtcgaacggactaccgtaccgtacgtactctacgtctgacggtcggcgtaggcgaacggcgacgacgtacgnng

SEQ ID NO: 54863 - DNA, 920 bp, Homo sapiens
  misc_feature: GYAE6OF02JDMNL.29.78.H01.1.454.CMB.1.raw
  modified_base (915)..(915): a, c, t, g, unknown or other
  misc_feature (915)..(915): n is a, c, g, or t
tcagatagagtactcacgaccggtgctcgatttagtgtgagtagtttgggtttgggggacgcctgggtacggccgggggggtcgctgtagactctcctgtgcggaccgtctggattaagttttaggagttcgatgccgatgaacgtgggtcccgccaggctccgagggaagggcttggagtgggtctcggcttagttagtcggcagtggtggcgacttatattattactcgacagaccggccctcggaacgggtccggtttcgacctactttaccgagacgactaacttaccgaaacgaacctacgctagtactcgtacgacgtaagtggaagacgtccgttagtacgtaccgtaccggaaccgaaccgaccggtacccgttacgttactttacgttacggttaacggttaaacgggccgtacgtacgtaacggtaaacggtaacccgggggtaccccgggtacccgtaccgttaccgaacccgtaccggtaccggggaccgggtaacggggtaccgtccggttacggtacccgtacccggttccgtccccgtaccgtacccgccccgtacccggaacccggaaccggggtccccgttaccggtttcccgggtttcccccgtttacccccgtacggtacccccttaccccgttacccgtaacccgaaaccgtacccgtacccgttacccggtaccgggtacccggggtaaccctaacccggtaccggtacccggtacccggtacccgggttaccgggtcccgttaccgggttacccggttaaccgggtaacccgtttaaaccggttaccctttaaccgttaccgttaaccgttaccgttaccttacggttacgtaccggtaccgggttccgggtaccgtacggtaccggacggttaccggtaacgtacggtacgngtacg

SEQ ID NO: 54864 - DNA, 736 bp, Homo sapiens
  misc_feature: GYAE6OF02HO82L.29.78.H01.1.454.CMB.1.raw
  modified_base (689)..(689): a, c, t, g, unknown or other
  misc_feature (689)..(689): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgccaggctccgagggaaggggctagggaggtcgggtctcggctagttagtggcagtggtggcgactatatattatgcagacgccctggaacgggtccgttacacctatttccagagactaatacgaaagtaaccacgtctagtactcgttagactaaagtggaagacgtccgtagaacgccgtacggaaccgacccgtaccggggtaccttacttaatttaagttacggttaacgggtttaaacggccgtaaggtccgttaagggaaaacgggtaccggggggtaccccgggaccccgttacgttaccggacccgttaacggcgggggaaccgtagggggacccgtggtccggtacctaccggttcctaccgtacgaccgtccctaaccgaccggacggacctacgtccggttccccgttccccgtcgtccctaccctccgacgtacgacgactcccgtggaccgggtcctacgccgcgtacgtcccggtaggtcgtaccgacggttacggaccgaacgtcgttaacctacgacgtactacgtacncggtaaggcggtcggtacgtggacgacggtacgacgtacgtcgatcg

SEQ ID NO: 54865 - DNA, 675 bp, Homo sapiens
  misc_feature: GYAE6OF02FN3MN.29.78.H01.1.454.CMB.1.raw
  modified_base (316)..(316): a, c, t, g, unknown or other
  misc_feature (316)..(316): n is a, c, g, or t
  modified_base (409)..(409): a, c, t, g, unknown or other
  misc_feature (409)..(409): n is a, c, g, or t
  modified_base (672)..(672): a, c, t, g, unknown or other
  misc_feature (672)..(672): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagaccgccctgaagggccgttcaccatttccagagacaattcgaagaacacgctgtatctgcaaatggagagcctgagactcggaccgacaccggcccgttntaattacgtttgtagtttaaaagggcgagcctagggaaataccggggacccggggacccacgttcggacccacgtgggggaccgagggggacncgtgggttccacccggttctccctcgacgtccctacccgaccgtaagggcccacgttccggtcctttccccccgtcggcccacccgttccctacccgaacgaccgccgtacccgttcgtcgggggccacgtacgccgacgtcccgtagggcctccggccgtagggtccaacgggtaccttacgttacccgacgttacctccttaagtccgtaggaccggtccggggtccgttagggaccgtaacgggccgtaaccgagtacgnacg

SEQ ID NO: 54866 - DNA, 901 bp, Homo sapiens
  misc_feature: GYAE6OF02F0LHV.29.78.H01.1.454.CMB.1.raw
  modified_base (897)..(897): a, c, t, g, unknown or other
  misc_feature (897)..(897): n is a, c, g, or t
tcagatagagtactcacgaccggtgctcgatttagtgtgagtagtttgggtttgggggcgccgtgggtacgggccgggggggtcgcgtgagactctcctgtgcggcctctggtattaagtttaggagtcatgccatgaacgtcgggtccgacgacggctaccgaggggaacggggtctcgggtaggttcgggtcgtcgggacttagtttaggtcggactagggtggtggccggtacttaataagttagtttactcgtacgacggaccgtccgtaggaacggggtccgttacctaaccgtacgtttaccgaacggacgtaacctaagttaccggaaacgaaaccgtaccggtcttaggttaacttccgtaggtaactaaaggtcggaagtaccgtaccttggaacgtaccttaccggaccggaccgtaccggtccgttacttacgttacgttcggttaaggtaaacggcgtacgcgttaaggtaacggtaccggggaccccgggtacctacggttacgaacccgtacgggtacgggggaccgtaacggggtcctacggtttacgggtacccgtacccggttcggtacccgttacggacccggttaccccgtaccgaacccgggtaacccgggtccgtaaccgtttcccgggtaccccgtttaccccggccggtaccctaccccttaccgtaccgaacgtccgaccgttaccgtccgggttcgggaccgtaaccgacggaccgttaccggtccgggtccgggtaccgttaccggtaccgttaccgggtaaccgtaaccggttaaccgtacccgttaccggtaacgttacgtaccgttacgttcggaccggtacgggtccgttacggtacggtaccggtacggtccggtagtacggtacncgac

SEQ ID NO: 54867 - DNA, 770 bp, Homo sapiens
  misc_feature: GYAE6OF02F1MXK.29.78.H01.1.454.CMB.1.raw
  modified_base (766)..(766): a, c, t, g, unknown or other
  misc_feature (766)..(766): n is a, c, g, or t
tcagatagagtactcacgaccggtgctcgatttagtgtgagtagtttgggtttgggggcgcctgggtacggccgggggggtcgctgagactctcctgtgccggcctctggattaagttttaggagtcatgccatgaactgggtccgccaggctccagggagggctggagtgggtctcggctattagtggcagtggtggcgctatatattatgcagaccgccctaggaacgggtccggtttcacctacttttaccaggacgacaagttccgaaagtaacacgctagtatctgacaaagtggagacgcctggacactcggaccacgaccggtccgtcttaagtttacttggtagttaaaacggccggtaagtccgttagggaaacgttaaccgggggaccccggggtacccgaaccgttcgaacccgtacgttcgggggacccgtagggggaccgtcggtcgggtacctacccggtccttacccgtccgacgtaccccgttaccccaaccggaaccgggacccctacgtcccgggtttacccctttcccccggttccggaccctacccccgttacccttacccgaaacggtaccgtcccgtacccggttaccggtcgggggaccctaaccgacgtacccgaaccggttcccgtcgggtacctccggtcccgttacgggtacgtaaacggtacctttaacccttaccgtacgttaccttcgtacgtcgtacgtacggcggtcgcggtacgacggaccgacgtagtacgngtcg

SEQ ID NO: 54868 - DNA, 863 bp, Homo sapiens
  misc_feature: GYAE6OF02GJN3Y.29.78.H01.1.454.CMB.1.raw
tcagatagagtactcacgaccggtgctcgatttagtgtgagtagtttggggtttggggagagctctggggagtctgcaccatggctcggaccccactcctcttcctcaccctcctcctccactgcacgagggtctctctcccagcctgtgctgactcaatccgccctctcgcctctcgcccgttcccgtaggggacggtcgtcggtacgaacggtccacctgtactcgtagacgcgagtacggacacagacgagacctacgacctagtccgtcgttacggcactacgacgcgaaggacggaccaagaccgaccggtccttacgttacgtagagtacgaacgtaacgtacaaactaagtagtacgtacggacacgtacgaacggtaacggaacggggaaacgggggtacggacttaccgaggtactccggtacttaccgtactacggtacctaccgtacgtcgttacggtacgggtacgtacgtacggtaccctaccttaaacccgtacggtaaacccttaacggtccccggttaccgtacccgttaaccggtacggttacggaacgggttaacggaacggtttacggaacgttaacccttacggtttaaaacctttaacgtttaccgggaacccggttaaccggtaaaacccggggttcccgggtagggtaaacccgtttaaccgtaccgggaatttttaacccggggttacgggttaacccgggggtaaccgtttaaacccccggggggggaaaccggtaaaccgttccggggtaccccgttaaaccggggggtttcaacccgggttaaccgtaaaacccccggaacccgtaaccccgggtaacccccttaacccggtcccg

SEQ ID NO: 54869 - DNA, 684 bp, Homo sapiens
  misc_feature: GYAE6OF02JUGCL.29.78.H01.1.454.CMB.1.raw
  modified_base (321)..(321): a, c, t, g, unknown or other
  misc_feature (321)..(321): n is a, c, g, or t
  modified_base (365)..(365): a, c, t, g, unknown or other
  misc_feature (365)..(365): n is a, c, g, or t
  modified_base (509)..(509): a, c, t, g, unknown or other
  misc_feature (509)..(509): n is a, c, g, or t
tcagatagagtactcacgaccggtgctcgatttagtgtgagtagtttgggtttgggtccgagccatggtgcagactcccagagctctcctcctcctccactgccacagggtctcctctcccagcctgtgctgactcaatccgccctctcgcctctcgcctcccgtgggacggtctccggtcaaggtcaccgtgtacctctgacgcagtggacacagcagctaccgcatcgcttggcactcagcagcggaccagaccgaccgggtccctcggttacttgatgactacgaccgaaataatacggatcggagtacgtaccaacncggaacggaagggggaccgacgtaccgtacgacttcgtaccttnaccgtacggtccctccgtaccgtcgttcccggtacgggtctaccggagtcccgtacccgtaccctacgtaccgtaactccgttcccggacccttcgccgttacgtcggtagggtcctaggcggacgttacgtacttaccgttcnccggttcgtaacgtcggttacggcgtacgtacggtctacggttacgtccgggtacgtccgggaaccgggtaccgtacgggtaccgtaccggttccgggtacgtacccggtaacgtccccgtaagacccccggtaacctccgtaacccgtccgtaccgttcccgtcccgtcccccg

SEQ ID NO: 54870 - DNA, 642 bp, Homo sapiens
  misc_feature: GYAE6OF02G7K9F.29.78.H01.1.454.CMB.1.raw
  modified_base (331)..(331): a, c, t, g, unknown or other
  misc_feature (331)..(331): n is a, c, g, or t
  modified_base (335)..(335): a, c, t, g, unknown or other
  misc_feature (335)..(335): n is a, c, g, or t
tcagatagagtactcacgaccggtgctcgatttagtgtgagtagtttgggtttggagtctgcaccatggctcggacccactcctcttcctcaccctcctcctccactgcacagggtctctctcccagcctgtgctgactcaatcgccctctgcctctgcctcccgtgggaggctcggtcaaggtcacctgtactctgagcagtggacacagcagctaccgcatcgcttggacatcagcagagccagacgacggccctacgttactgatgacagtacaacaatcggataggcagtcacgacgcggaaagggggacggatccctgacgtcgtnttcnctacgtctaccagtactcgtcgggtctacggacgcgaccttccgaacaactaacgtcccgtacccggtccctccgacgttcgtaacggacggtaacgttcggacggtcttaagtacttaacgttcgtacgtacggaccgtaacggttcggggcctacggtacggtcgtacttacgtacggttaccggttaacggggacccgggtaacgtacgggtacccggtaccggttccggtaccggtacgaacccggaacccgaaaccggaccctacccgtaacgttaccgtaccgttacctcggttaccccgg

SEQ ID NO: 54871 - DNA, 599 bp, Homo sapiens
  misc_feature: GYAE6OF02FTV1Z.29.78.H01.1.454.CMB.1.raw
  modified_base (384)..(384): a, c, t, g, unknown or other
  misc_feature (384)..(384): n is a, c, g, or t
  modified_base (597)..(597): a, c, t, g, unknown or other
  misc_feature (597)..(597): n is a, c, g, or t
tcagatagagtactcacgaccggtgctcgatttagtgtgagtagtttgggtttgggggcgcctgggtacggccggggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtagttaaaggcgagctggaatacggggaccgggcccgacttgaccacgtggggccagggggacncgtggtcaccgtctcctcagccctccaccagggcccatccgtccttcccctcggccaccctcccaccaacgacgccaccgtcgtcggggccacgcgcacgcccgtcgggcgtcgccgttcggtccgaaacggtacctaaccttcccgaacgttacctactacgttcgtacggacggccgggcgtgggaccgaacgggccgaccgagttacggntc

SEQ ID NO: 54872 - DNA, 692 bp, Homo sapiens
  misc_feature: GYAE6OF02JBLZR.29.78.H01.1.454.CMB.1.raw
  modified_base (146)..(146): a, c, t, g, unknown or other
  misc_feature (146)..(146): n is a, c, g, or t
tcagatagagtactcacgaccggtgctcgatttagtgtgagtagtttgggtttggggtccgagccatggtgcagactccccagagctctcctcctcctccactgcacagggtctctctcccagcctgtgctgactcaatcgccctntgcctctgcctcctgggagctcggtcaaggtcacctgtactctgagcaggtggacacagcagcctacgccatccgcttggcatcagcagagccagaccacgggccctgtactgatgacagtcaacaatgatggcagtccacaggcggaagggggacggactcccgtgacgttcgcctttctcgtagtcctaccaggtccttcgtcggggacctgggacggtcccgaccttacccacgtaactaacgtcccgtacccgggtccctaccgtacggtccgagggtaacggtagtacggacgggtaccttaggtaacttacgttttacgtacgttaacccgacgggtaccggtacggggtaaccgtaaccggttcggaacgttacgtttaccggtacgggtttcccgttaaccgggggaaccccggggaacttaaccgggtcccgttaacccggtccgggttaccgggtaccgaacccgggacccgtaaccgggacccctaaacccccgtgtacccgtacctacccgttcccgttaccgttacccccccg

SEQ ID NO: 54873 - DNA, 808 bp, Homo sapiens
  misc_feature: GYAE6OF02G1H07.29.78.H01.1.454.CMB.1.raw
  modified_base (146)..(146): a, c, t, g, unknown or other
  misc_feature (146)..(146): n is a, c, g, or t
  modified_base (202)..(202): a, c, t, g, unknown or other
  misc_feature (202)..(202): n is a, c, g, or t
  modified_base (252)..(252): a, c, t, g, unknown or other
  misc_feature (252)..(252): n is a, c, g, or t
tcagatagagtactcacgaccggtgctcgatttagtgtgagtagtttgggtttggggtccgagccatggtgcagactccccagagctctcctcctcctccactgcacagggtctctctcccagcctgtgctgactcaatcgccctntcgcctctcgcctccgtgggagcctcggtacaaggtcctaccgtgtacctctggancgagtggacagagcgagactaccgcctagtcgtcgttagctactcgacgngacggtacgccacgaaccggtccggtacccttacgtttactagactacgactagtacaaactagtgacgtgacacgtacgacggaggtacggggacggggtaccgacgtccgtagtacctccggttacctcgtacgtaccgtcctaccggtacgtaccgttcgggtacggtaccgacgggtacccgttacccggtaacctttaccccgtacgtaaaccctacccggttcccgtaccccggttacctaccggtacgttacgacgggtaaggtacggtacgggtacggtacccgttacgtaacgtttacgtttcgaccgtaaccgtaccgggtacggtccgggtaacgtccggttaaccgtaacgttcggttaaccggttccccgggttaaaaccgggtacccggggaaaccggtaaccgtttaaccgggggaccgtttaacccccgggtaggttccccgggttaaaccgccccgggtaaacccgggtaaaccccaacccggtacccgttccgtacccggtaccggtttacccgttaccccggtccccgttaccccgg

SEQ ID NO: 54874 - DNA, 769 bp, Homo sapiens
  misc_feature: GYAE6OF02GG3F6.29.78.H01.1.454.CMB.1.raw
  modified_base (193)..(193): a, c, t, g, unknown or other
  misc_feature (193)..(193): n is a, c, g, or t
tcagatagagtactcacgaccggtgctcgatttagtgtgagtagtttgggtttgggggcgccctgggtacggccgggggggtcgctgagacgtctcctggtgcggcctcgtcggattaagttttaggagtcatgccatgaactggtccgccaggctccgagggaagggctggagtgggtctcggctattacgnggcagtggtggcgctatatagttatgcagacgccctggaacgggtccgttcaccgtatttccagaagacaatttcggaaagaaaccgacgtacctggttaactctacggacgtaaacgttgggaacgtacgccgttaggaacgtactaccggacgaacgtacgggtacccgtacttacgttatttcggtaggtaaacggtcgtaacgtcggtaacggaacgttaacccgggggtacccgggaccccgttaagttcgggtaaccccaccgggttcggggtacccggaacgggggtaccgccgtttacggggtaccctaaccgggtctacccccgttacgaacgggtccccttacccgaaccgaccggggtacccgtacgttcccggggttacccttccccggtacgggtaccctacccgtcccggtaaccaacggtcgaccgtaccgtgtcggggtacaacgagccgtacgccgtggaccgtcgccgtcggacgtagtaccttaccgtacgaccttcacgttactcggaaggtacggaccggtcggtacggagtaccgcgggaactacggatgtacg

SEQ ID NO: 54875 - DNA, 697 bp, Homo sapiens
  misc_feature: GYAE6OF02JULB9.29.78.H01.1.454.CMB.1.raw
  modified_base (220)..(220): a, c, t, g, unknown or other
  misc_feature (220)..(220): n is a, c, g, or t
  modified_base (244)..(244): a, c, t, g, unknown or other
  misc_feature (244)..(244): n is a, c, g, or t
  modified_base (498)..(498): a, c, t, g, unknown or other
  misc_feature (498)..(498): n is a, c, g, or t
  modified_base (516)..(516): a, c, t, g, unknown or other
  misc_feature (516)..(516): n is a, c, g, or t
  modified_base (532)..(532): a, c, t, g, unknown or other
  misc_feature (532)..(532): n is a, c, g, or t
  modified_base (576)..(576): a, c, t, g, unknown or other
  misc_feature (576)..(576): n is a, c, g, or t
tcagatagagtactcacgaccggtgctcgatttagtgtgagtagtttgggtttgggggagagaggagtccacccctgggatcttcaggtgttttcatttggtgatcaggacggaaacagagagaactcaccatggagtttgggctgagcgtggtcttttcttgtggtctaagttttaaaaggtcgtcagtgtgacgtgcagttggtggagtcgtggggcnccgtgggtacgggccggggggtcngtgagactctcctagtcgcggcctgtaggaacgtttaaggttttaggacgttcgagttcgaccgtatacgaacgttcgggtacccgccgaaggtcctcccggaaggggaaacggtgtacgggagtcggtccgtcggtatacgttaaggcggtcgtagtcggggtagccgtacgttaatagttaattagtcgacgacggaccgtccgtaggacgggtccgttcaactactttaccgagacagtaacgtacgaaanacgcgtactagtactcgngtaacaaagcggtaancggtcgtagaccgtaacgccgtaaccgacgaccgtccgttaatnttacgtaggtttaacgtaacggtacgtacgtacgtaggaccggtaccgggacccggtccgtaccgtagaaccgttacggtcgggaaccggtagggtacgtacgtacggaccgtacgtcccg

SEQ ID NO: 54876 - DNA, 758 bp, Homo sapiens
  misc_feature: GYAE6OF02JH089.29.78.H01.1.454.CMB.1.raw
  modified_base (204)..(204): a, c, t, g, unknown or other
  misc_feature (204)..(204): n is a, c, g, or t
  modified_base (246)..(246): a, c, t, g, unknown or other
  misc_feature (246)..(246): n is a, c, g, or t
  modified_base (388)..(388): a, c, t, g, unknown or other
  misc_feature (388)..(388): n is a, c, g, or t
  modified_base (507)..(507): a, c, t, g, unknown or other
  misc_feature (507)..(507): n is a, c, g, or t
  modified_base (547)..(547): a, c, t, g, unknown or other
  misc_feature (547)..(547): n is a, c, g, or t
  modified_base (582)..(582): a, c, t, g, unknown or other
  misc_feature (582)..(582): n is a, c, g, or t
tcagatagagtactcacgaccggtgctcgatttagtgtgagtagtttgggtttggggtctgagagaggagtccacccctgggatcttcaggtgttttcatttggtgatcaggacggaacagagagaactcaccatggagtttgggctgagctggcttttcttgtggtctattttaaaaggtgtccagtgtgacgtgcagttggnggtacgtcgtggggcgccgtggggtacgggcccgggggggtncgtggagacctctccgtgtcgccggcctcgtggtaatttaagttttggagttcgatcgccagtacgaacgtgggtacccgtcgacggccgtaccgaggggaacggggcgtagggacggttgggtcgtcggtctagttacggnggtacgtggtgggtggcgtactagtatattactggtacgacgtacgaccgtaggaaccgggtccggtaccaccgtacgtttccgaacgagtaacctaactaccggaaacgaacgaccgnttacgtactactgaacgtaacggtggaacgtacgtaccgngtaaccgcgtaacggtaccgaaccgtaacccgggnttaccgttaagttacgttaggtttaagggtaaaccgggccgtaaggtcccgttaaagggtaacccggtaaacgggggacccggggttacccggtaacgtttaacccgggacccggtaaacccggttcggggaaccccgggtacggggtaaccccggtggtaccgggttaaccccgg

SEQ ID NO: 54877 - DNA, 711 bp, Homo sapiens
  misc_feature: GYAE6OF02HD5RM.29.78.H01.1.454.CMB.1.raw
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcaggtggtggcgctatatattatgcagacgccctaggaagggccgttacacctatttaccagagactaatcgaagaacacgctagtatctgacaaagtcggagacgccgtagagacgtcgaaccgacgacggtccgtatatttacttgtaggttaaaggcggagcgttagggaaggtaaccggggaccgggcccgtacgttcgaccacggtcggggccgagggacgcgtggtctaccgtcgtccctacgacgccctaccgaccgaacgggcccacgtccggtcccttccccgtacggccctaacccctccaccgtaagaccgaccaccgtttcgacggggacctaccgacgtaccgaacgtccccgtggggtacctccggtaccgttcggtaaacgtaaccgggtaaccctttaaccttaccgtaaccgttacgttccgttaacgtccggtacgtaacggggcccgggtaacgttcggggaaccgttaacgggacccggttaacgaaccggtaggagtacg

SEQ ID NO: 54878 - DNA, 847 bp, Homo sapiens
  misc_feature: GYAE6OF02ICGYC.29.78.H01.1.454.CMB.1.raw
  modified_base (176)..(176): a, c, t, g, unknown or other
  misc_feature (176)..(176): n is a, c, g, or t
  modified_base (202)..(202): a, c, t, g, unknown or other
  misc_feature (202)..(202): n is a, c, g, or t
  modified_base (208)..(208): a, c, t, g, unknown or other
  misc_feature (208)..(208): n is a, c, g, or t
  modified_base (842)..(842): a, c, t, g, unknown or other
  misc_feature (842)..(842): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaagggctggagtgggtcncggctattagtggcagttggtggcgntatatntatgcagacgccctggaagggtccggttcacctaatttcccagacgtaacaagttacgaagtaacacggctagtactctgacaaagtggaacgagtcctagaagccgttacgaaccggaaccgaccggtacccgttcgttaacttttaagttacggttaaggttttaaaacgggccggacgtaccgtttagggaaacggtaccgggggtaaccccgggggccctaccgtttcggaacccttaacgggcggggggtacccgaagggggggtacctcggttacggttacccgaacccgggtttcctccctaaccgacggtaccccttacccgaacccggtaaacggggacccctaacgttccccgggttccccttttcccccggtacgggacccgttaccccctacccggttaacccgaaacggtacgtaccctaaacccgttccggtacggggggacccttaacggaaccgtctaaccggggtcccctagggggtaccctacgggttcccgtaacggggtaacctaaacggggttaacctaaccgtttaacccgtaacgtaccggttaaccttacgtaaccgttcggaacggtccgggtacctgggtaccgaacgggtccgacgtaacgttacgntacgg

SEQ ID NO: 54879 - DNA, 651 bp, Homo sapiens
  misc_feature: GYAE6OF02F76U1.29.78.H01.1.454.CMB.1.raw
tcagatagagtactcacgaccggtgctcgatttagtgtgagtagtttgggtttggagtctgcaccatggctcggaccccactcctcttcctcaccctcctcctccactgcacagggtctctctcccagcctgtgctgactcaatcgccctctgcctctgcctcccgtgggacggctcggtcaaggtcacctgtactctgacgcagtcggacacagcagactacgccatcgcttggcatcagcagagcagacacgggccttgttacttgatcgacagtacaacaagtgatggcagtacacgaggacggaagggggacggactccgtagactcgtcttctcgtacgtcctccgacgtcctcggtcgggaccgtcgaccgtcgtacccttaccgtaccaaccgtaaccgttcccggtacccgggaccccttaccgacggttccgtacgggaacgtacgttagggaccggtccttacggtaactttacgttaccggtaggtcctaaccgggtaccgggtcgggaacccttacgggttccgtaacgttaccggttcgaaccggttccgggttaacgggacccgggtaacgtcgtaccgtaccggtcgtacgtccgacgtacccgacgccctaccgtacgcgtacctcgtgtccccg

SEQ ID NO: 54880 - DNA, 800 bp, Homo sapiens
  misc_feature: GYAE6OF02FIVJZ.29.78.H01.1.454.CMB.1.raw
  modified_base (274)..(274): a, c, t, g, unknown or other
  misc_feature (274)..(274): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatcngcaaatggagagcctagagactcgacgacaccggccgtctattattgtagttaaaggcgaagtcgtaggaaagtaccgggggaacccggggccccgtacgttcggaccctacggtcggggcccgagggggaccgtcgtgggtaccacccggtccttcccgtcgtacgccccttacccaacccgtaacggggcccctaaggtcccgggtttccccttaccccccgttcgggacccctaccccgttaccccctacccgtaaaacggaccgtcccgtaaaccccgttccgggttaccgggggtacccgaaccgtaacggacccggaacccggtccccggttacggggtcccgttcccggttacccggttacgggtttacccggtaaaaccgggttaccctttaacccgtttccccgaacggttttacccttacctttaaacccggttcggttaaccggaaccggggtcccggggttacccgacgggtacccggtaacgggtaccccggtacgtaacggttacggctacg

SEQ ID NO: 54881 - DNA, 778 bp, Homo sapiens
  misc_feature: GYAE6OF02JLNQ5.29.78.H01.1.454.CMB.1.raw
  modified_base (281)..(281): a, c, t, g, unknown or other
  misc_feature (281)..(281): n is a, c, g, or t
  modified_base (591)..(591): a, c, t, g, unknown or other
  misc_feature (591)..(591): n is a, c, g, or t
  modified_base (623)..(623): a, c, t, g, unknown or other
  misc_feature (623)..(623): n is a, c, g, or t
  modified_base (656)..(656): a, c, t, g, unknown or other
  misc_feature (656)..(656): n is a, c, g, or t
tcagatagagtactcacgaccggtgctcgatttagtgtgagtagtttgggtttggggtctgagagaggagtccacccctgggatcttcgaggtgttttcagtttggtgatcgaggacggaacagagagaactcaccagtggtaggtttgggctggagcgtggtctttttcgttgtcggcttaagttttaaaggtgtaccgagtgtcgacggtgcgtagttgggtggtacggtcggtcgggggccgtccggttcggggggttccggggccggggggggtccncgtagggacgtaccgttccgtcgtggtcggccggtccttcgttagggttaattttaaggttttagggattcgaagtcggcctaagttgtaaccggtcgggtcccgccgtaggcctaccgggaaggggacgggcgtgggtagggtcggttacggtccggtagttagttaggtcggagtaggtcgggttcggacttcgtaaattatacgttagccggtacacgggttacccgccgttaaggggacgggttcccgttacctaccgttacgttacgaagaacgaacgttaacgtaacggaaagaccgtaacgtntacgtaactcgtacagtaagcgtagacctcgnaacgtacgtcaaccggtacgccgttaacccgtntttaacttacggttggtaaacgttcgacggacgttcgacgggtaacggtccgggggaaccgtcggttaacctacgggaccgacgggtaccgggtggtacgggaacgttccgtcggtaacccg

SEQ ID NO: 54882 - DNA, 683 bp, Homo sapiens
  misc_feature: GYAE6OF02GQ4HA.29.78.H01.1.454.CMB.1.raw
  modified_base (557)..(557): a, c, t, g, unknown or other
  misc_feature (557)..(557): n is a, c, g, or t
  modified_base (683)..(683): a, c, t, g, unknown or other
  misc_feature (683)..(683): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgagctgggtccgccaggctccagggaaggggctggagtgggtctcggctattagtggcagtggtggcgctatatattatgcagacgcctggaagggccggttcacctatttccagacgacaattcgaagaacacgctgtatctgacaaagtggacgagcctgagacgtacgacgaccacggtccgtctattattggtgttaaaggcgagctgggaagttaccgggggaccggggcccgagtttcgaccctacggtcggggccagggggaccgcgtcggtacgtacccgtctcccgttcacgcccctacgaacccgacgggtaccccagttcccggtcccttcccccggtggtcccaccccgttccaccctaacgacgccctacccgtaccggtcggggaccctacgacgccgaccgtacccggngggtcccgtgtcccgttcgggtaaccgaaacggttacccttaccgttaaccgtagttaaccctttcgttacctacgtacggaccggtccgggacgttcgggacgacgggtacccgctacgtacggn

SEQ ID NO: 54883 - DNA, 1002 bp, Homo sapiens
  misc_feature: GYAE6OF02H1IMU.29.78.H01.1.454.CMB.1.raw
  modified_base (243)..(243): a, c, t, g, unknown or other
  misc_feature (243)..(243): n is a, c, g, or t
tcagatagagtactcacgaccggtgctcgatttagtgtgagtagtttgggtttggggtctgagagaggagtccaccctgggatcttcaggttgtttcatttggtgatcaggacggaacagagagaactcaccatggagtttgggctgagcttggctttttctgtgctattttaaaaggtgtccagtgtgacgtgctagttggtggagtcgtggggcgtccgtgggtacgggccgggggggtcncgtgacggtactctccgtggtcgccggccttcgtaggtatttaaggtttaggagtcagtcgccatcgaaccgttggttacccgccgtaggcctaccggaaggggaaggggtctaggggtaggtacggggtcgttaccggaccgttaagtttaacggtcgggtaccgtagggttcggggtagggccggtaccttaaagttaacgtttagtttaacgtttacgaccggtaacggtaaaccccgggtacccccgttaagggaaaaccgggggtccccggtttaaccctaaaccccggttaaacgttttaccccgggtaaaggaaacggtttaaacccgttaaaacgttttacccgggaaaaacggtaaaacccggtaaaccgggtaacctttacggtttaaaccgttaccgttaaccggtaaacccgtaaaaaaggttacggggtaaacggaacggttacccggtaacggtaaaccgtaaccgttacccgggaaaccggtaaacccggtaacccggggttaaccccgttttaacgtaacgttttttaaaccggtttttaacgggttaaaccggttttaaaaacgggggtacccgggttaaacgtaccggtttaaaggggggttaaacccggtaaccccggggggggttaaccccggggggtacccccggttaaacccgtttacgggtaacccccgttacgggttaccggggggaaccccggtaacggggggtacccggtaccggtttaccggggtaaccccg

SEQ ID NO: 54884 - DNA, 727 bp, Homo sapiens
  misc_feature: GYAE6OF02JKT2Y.29.78.H01.1.454.CMB.1.raw
  modified_base (716)..(716): a, c, t, g, unknown or other
  misc_feature (716)..(716): n is a, c, g, or t
  modified_base (722)..(722): a, c, t, g, unknown or other
  misc_feature (722)..(722): n is a, c, g, or t
  modified_base (725)..(725): a, c, t, g, unknown or other
  misc_feature (725)..(725): n is a, c, g, or t
tcagatagagtactcacgaccggtgctcgatttagtgtgagtagtttgggtttggtggtctctctcccagcctgtgctgactcaatcgccctctgcctctgcctccctgggaggctcggtcaagggtcacctgtactctgagcagtggacacagcagctacgccatcgcttggcatcagcaggaggccagaccgacggggcccttcggttacttgacttgaccacgtacaaacaactggaatcgggaccacgtaccaacgaaggaccggggaaaggggggacgggactacccggtggacgtccgtctttaccgagtaccgttccctaccggagtcccgttcggtcgggggtcctggaaccggtcccggtcttaacccgtcaacctaaccgttcccgtccccggtaccctcggtacgtacggtagggaacggtacggtcgtacggtctacgtaactttatacgtcgtacgcggtaccgggcggccgtacgtcggtactacgttcggacggttccgggttacggggaacccggggtaacctacgggtaccgttacccgggtaggttccccggaacgccgaaccccgtaaaccggccccctaaacccggtcttccgaccgttacccttccggttacccctccccgtaccttcccgtattacctaccgttcgtaacgtccggtcggtaccggcgggtacctcggacggaccggtcgaacncgttancancg

SEQ ID NO: 54885 - DNA, 610 bp, Homo sapiens
  misc_feature: GYAE6OF02J2MLX.29.78.H01.1.454.CMB.1.raw
  modified_base (247)..(247): a, c, t, g, unknown or other
  misc_feature (247)..(247): n is a, c, g, or t
  modified_base (352)..(352): a, c, t, g, unknown or other
  misc_feature (352)..(352): n is a, c, g, or t
  modified_base (404)..(404): a, c, t, g, unknown or other
  misc_feature (404)..(404): n is a, c, g, or t
  modified_base (442)..(442): a, c, t, g, unknown or other
  misc_feature (442)..(442): n is a, c, g, or t
  modified_base (447)..(447): a, c, t, g, unknown or other
  misc_feature (447)..(447): n is a, c, g, or t
  modified_base (476)..(476): a, c, t, g, unknown or other
  misc_feature (476)..(476): n is a, c, g, or t
  modified_base (486)..(486): a, c, t, g, unknown or other
  misc_feature (486)..(486): n is a, c, g, or t
  modified_base (508)..(508): a, c, t, g, unknown or other
  misc_feature (508)..(508): n is a, c, g, or t
  modified_base (592)..(592): a, c, t, g, unknown or other
  misc_feature (592)..(592): n is a, c, g, or t
tcagatagagtactcacgaccggtgctcgatttagtgtgagtagtttgggtttggggtctgagagaggagtccacccctgggatcttcaggtgttttcatttggtgatcaggacggaacagagagaactcaccatggagtttgggctgagcgtggtcttttcgtgtggtctattttaaaaggtgtcctagtgtgacgtgcagttggtaggagtcgtggggcgccgtggggtacgggccggggggtcncgtgacgacgtcgtcgtgtgccggcctgtgagtttaggttttaggagtcatcgacctagtacgacgtgggtcccaccgacggctccgaaggggagggccgtaggnggtcggtcgtacggtcttaggtagtggacgtagtgggtggacgctagtaatntactggctagccgtccgtgaacgggtccttacaccgtnttccngacacgtatcgaaagaccagtctagtacnctagactagngaagtgactgagcctaggaccncggtacgccgtatagttctggtaagtacggcagtacgtagaacggtacgggcccggtagtacgtccacgggtagtcgggaccgnggggacctggtcgtaccg

SEQ ID NO: 54886 - DNA, 715 bp, Homo sapiens
  misc_feature: GYAE6OF02FZX50.29.78.H01.1.454.CMB.1.raw
  modified_base (337)..(337): a, c, t, g, unknown or other
  misc_feature (337)..(337): n is a, c, g, or t
  modified_base (711)..(711): a, c, t, g, unknown or other
  misc_feature (711)..(711): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgcctgaacgggccgttcaccatttccagagacaattcgaagaacacgctgtatctgacaaagtggagacgcctgagactcgacgacacggccgtactattatgtaggtaaggcgagcgnggaagtacggggacccggggccgacgttcgaccacggtcgggaccgaaggggacgcgtcggtctaccgtctcctcgcgcccgtaccaacgacggccctagtcccggtccccttcccccgtggacccctaccccgttcccgtacccgaaacggtccgtacccctacccgttacgggtccggggaaccaaccgtacggaacccaccgggtccccggtagggtccgttcccgtcccgggtttacggaacccgtaaaccggtacccgtttaacccttaacccgtacggtttacccttccggttaacgttccggtaaccggtaccggggtaccgggtccgtaccgggtaccggaaccgggtccgacgtaggttaccggngtcg

SEQ ID NO: 54887 - DNA, 725 bp, Homo sapiens
  misc_feature: GYAE6OF02FUIQA.29.78.H01.1.454.CMB.1.raw
  modified_base (224)..(224): a, c, t, g, unknown or other
  misc_feature (224)..(224): n is a, c, g, or t
  modified_base (249)..(249): a, c, t, g, unknown or other
  misc_feature (249)..(249): n is a, c, g, or t
tcagatagagtactcacgaccggtgctcgatttagtgtgagtagtttgggtttggggtctgagagaggagtccacccctgggatcttcaggtgttttcatttggtgatcaggacggaacagagagaactcaccatggagtttgggctgagcgtggtcgttttcttaggtggctaattttaaaaggtgtccagtgtgacgtgcagttggtggagtcgtgggggcnccgtggggtacggccgggggggtcncgtgagctctcctgtgccggctcgtggattaagtttaggagtcatgccatcgaacgtggtccgcgaggcctcgagggagggctggagtggtcgtcggctagttacggtggctaggtggtggcgtactagtattacttagtgtacacgaccgtccgtaaggaacggggtcccgttacacctacgtttacccgaggaacgtactaaagttaccgaaacgtaaccgtacgtcgttagttacgttcgtacgaaacgtaaaggttaggaacgtacgtacctaggtacgaccggttccgaaccgggaactacccgggtaccgtttacttaaggttttaacgttgggttaaacgttaaacgggtcggtacgtaccgttaagggaaccggttaaccgggggaccccgggttacccgtaacggtttcccgaaccgtaccgggtcggggtacccggaacggggtcgtaccggttcgggtaaccccg

SEQ ID NO: 54888 - DNA, 762 bp, Homo sapiens
  misc_feature: GYAE6OF02GOHKA.29.78.H01.1.454.CMB.1.raw
  modified_base (215)..(215): a, c, t, g, unknown or other
  misc_feature (215)..(215): n is a, c, g, or t
  modified_base (760)..(760): a, c, t, g, unknown or other
  misc_feature (760)..(760): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccgaggggaaggggctggagtgggtctcggctattagtggcaggtggtgcgtctatatattangcagaccgccctggaacgggtccgttcacctattccgaagagacctaagttcgaaagaacacgctgtatctgacaaagtggagacgcctagacgacctacgacgaccgccggccgtacttagttattggtaggttaaacggcgacgtcgtaggaaacgtaccgggggacccgggccccgtaacgttcgaaccgtacggtcggggtaccgagggggactcggtcggtaccgtaccggttacccgtccctaccgaccgtaccccgtacccgaaacccggtacccggggacccctaacgttccccgggttacccccgttttccccccgtcggtacccccgtaccccttacccgtaacccgaaccggtaccgaacccgtacccgttccgggacggggtacccacgtaccggaccgaccggtcccggtacggtccgtaccggtccgttaccgggtaccgaacgttacccttaaccgttaccgtacgttacgtcttaacgtcggtacggacgggtccggtacgtaggaccgacgggtctacggtaagtcgncg

SEQ ID NO: 54889 - DNA, 844 bp, Homo sapiens
  misc_feature: GYAE6OF02IZ0AD.29.78.H01.1.454.CMB.1.raw
  modified_base (153)..(153): a, c, t, g, unknown or other
  misc_feature (153)..(153): n is a, c, g, or t
tcagatagagtactcacgaccggtgctcgatttagtgtgagtagtttgggggtttgggggagagctctgggggagtctgcaccatggctcggaccccactcctcttcctcaccctcctcctccactgcacagggtctctctcccagcctggtnctgactacaatccgccctctcgccttctcgccttcccgtggggacgtcttcgggactaacggtcctaccgtgttacctcgtaggacgactaggtcggacaacagacgacgtcccgtaaccgcctagtcccggtacgttcggactaactccgacgacgtaggaccggaccacggaacccggacccgggttacccgttacggttactttaggaacgttagaacctaacggtaaactaaagaacgtggtaacgtacggtaacgtaccgtaaccgaagaacggggaacgggggtaaacggggggggaaccggtacgttaccgtacgggtaaccgttccgttaccgtttaccgtaccgtacgtaccgtacgtacgggttcccttcgggtaccggtcgtaccggtacggtccctaccgttaaccgtactaaaccgttacctccccggttaccgtacccgtacgtacggtcgtggtaacgtcgttaggacgtacgttaacaccgtttagttaccgtacggtaaccggtacgggtaccgggtagggacccgttcgggtaaacggctttacgttaccgggttacggttacccgggtaaccgggttacccgggaacggttaccgtaacgggtaacccgggttggaacccggttaccggaccggtaacccgggaacccgttaacccccgtagttaaccccgg

SEQ ID NO: 54890 - DNA, 797 bp, Homo sapiens
  misc_feature: GYAE6OF02JTBBS.29.78.H01.1.454.CMB.1.raw
  modified_base (285)..(285): a, c, t, g, unknown or other
  misc_feature (285)..(285): n is a, c, g, or t
  modified_base (795)..(795): a, c, t, g, unknown or other
  misc_feature (795)..(795): n is a, c, g, or t
tcagatagagtactcacgaccggtgctcgatttagtgtgagtagtttgggtttgggggcgcctgggtacggccgggggggtcgctgagactctcctgtgcggcctctggatttaagttttaggagtcatgccatgaactgggtccgccgaggctccgaggggaagggctggaggtgggtctcggctattagtggcagtggtggcgctatatattatgcacgaccgccctaggaacggggtccggttccacctagtttaccaggagaacaattcgaaagaacacgntgtatctgaacaaagtggagacgtcctgaactacgtacgacgaccgaccggtccgtacttatttagttggtaggttaaacggccgtagtcgtaaggaacggtaccgggggacccgggtccctaacgttcggaccgacggtccggggaccggaacgggggtaccgtcgttacgggtaccgtcccgttcctacccgttccgaaccgttcccccgtaccgaacccggtaaccgggccctaacggttccccgggtccccttttcccccggacgtcccctaaccccttccgaccgaaggtaccgcccgttaaccgttaccggggcgggccaaaccggtacgaccggtacccggtccccggtcggggtaaccttccggaacccgttcggggttaaaccacggttaaaccctttcccgttaccgtaaggttccccttaacggttactttaacccgggacgggtccggtaccgggtccgtaggggacccgaacgggttacccgcgtaacgtttccggncg

SEQ ID NO: 54891 - DNA, 770 bp, Homo sapiens
  misc_feature: GYAE6OF02GC9PO.29.78.H01.1.454.CMB.1.raw
  modified_base (292)..(292): a, c, t, g, unknown or other
  misc_feature (292)..(292): n is a, c, g, or t
tcagatagagtactcacgaccggtgctcgatttagtgtgagtagtttgggtttgggggcgcctgggtacggccgggggggtcgctgagactctcctgtgcggccctctggattaagttttaggagtcatgccatgaactgggtccgccaggctccaggggaaggggctggagtgggtctcggctattagtggcagtggtggcgctatatattatgcagaccgccctagaacgggtccgttcacctatttccagagacaattcgaagaacaccgctgtatctgacaagtgganacgcctgagacctcggaccgtacgaccggcccgtacttaattacttggttaggttaaacgggcgagtcgtaggaaacgttacccgggggacccggggaccccgtactttcggacccgtaaccggtcggggggacccgaagggggacccgcgtttcgggtccctacccggttcccgttcccgttccgaccggtcccccttaccccgaacccgtaaccggggaccccctacggttccccggttaccccgtttcccccccgtcggtcccccgtacccccttccccgtaccccaaacggaccgccccgtaacccgtccgggttccggggacctacccgggaccgtaccgacccggttccccggtcgggtcctccgggtccggtccggtaccgaaccggtacccttaaccgtccgtaccgtaccttacctacgtcgtacggcggtcccgggtcgtcggacggacggaccgtacgcgtagcgcg

SEQ ID NO: 54892 - DNA, 792 bp, Homo sapiens
  misc_feature: GYAE6OF02HHM3Q.29.78.H01.1.454.CMB.1.raw
  modified_base (788)..(788): a, c, t, g, unknown or other
  misc_feature (788)..(788): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccgagggaagggctggagtgggtctcggctattagtggcagtggtggcgctatatattatgcagaccgtccctggaacgggccgttcacctatttccgagagacctaattcgaaagtaaccacgctgtatctagactaaagtggagagtcctagacgactcgaacgacgtacggccgtacttattatgttagttaacgcgagtcgtaggaacgtacggggacccgggtcccgacgttcgaccacggtcggggaccgacgggggacgtcgttcgggtacccaccggttccctaccctacgtaccggtaccccctacccgaacccggaaaccggggtcccctaacgggttccccggtttacccccgtttccccccggtaccggtacccccggttaacccccttccccgttaccccggaaacggtacccgacccgtaacccggttcccgggttccgggggtacccaacggtaacccgccgtaacccgggtcccgttaccggggtacccgtccggttaccggttaccggttaaccgggtaaaccggttacccgttaaccgttacccgtaccgttaccgtttaccttaccgttaccgtcggacggtccgggtacgtccggacggtaccgcggtacacgtgngtac

SEQ ID NO: 54893 - DNA, 822 bp, Homo sapiens
  misc_feature: GYAE6OF02GA9HR.29.78.H01.1.454.CMB.1.raw
  modified_base (754)..(754): a, c, t, g, unknown or other
  misc_feature (754)..(754): n is a, c, g, or t
tcagatagagtactcacgaccggtgctcgatttagtgtgagtagtttgggtttggggtctgagagaggagtccacccctgggatcttcaggtgttttcatttggtgatcaggacggaacagagagaactcaccatggagtttgggctgagctggctttttcttgtggctaatttttaaaaggtgtaccagtgtgacgtgcgagttgggtggtagtctgggggcgcccgttaggggtaccggggtccggggggggtccgcgtggacgtaccttccgtccgttgtggccggtccgtctagggtatttaaggttttggagtcagtcgtacagtacgaacgttcgggtcccgcaggcctccggaagggaggggctaggggtagttcgggtcctgggtaccgttagttaggtcggtacgtaacgggtgggttacggcgtacgttaacgttaattaactttaagtcggtacaaccggtacccgttaccccggtagggaaaccgggtcccggtttaccaaccgttaccgtttaccgaaacgtacgtaacgtaaacgtttaacgaaaacggtaactaaccggtcctagtaccgtacgtacgtaacgaaaggttacggaagtacgaccgttacggacgtaaccgtcggaaccggtaccgtaccggtacgtactttaagtttaggttacgtttaaacggtaacgggacgtagtacggttaacggaacggttacccggggggaacccggtacccgggtttaaccnccgggtaacccggtacgggttcccggggtaacccggaaggggtcccggtaccggttccggtaccccgg

SEQ ID NO: 54894 - DNA, 736 bp, Homo sapiens
  misc_feature: GYAE6OF02G2NLJ.29.78.H01.1.454.CMB.1.raw
  modified_base (734)..(734): a, c, t, g, unknown or other
  misc_feature (734)..(734): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccagctccgagggaaggggctggagtgggtctcggctattagtggcagtggtggcgctatatattatgcagaccgccctggaacgggtccggttcaacctatttccaagagacaattacgaaagaacacgctagtatctgacaaagtggagacgccgtgacgacctcgaacgaccgaccggccgttacttatttagttgttaagggttaaacggacggacggtacgtagggaaaccggttaaccgggggaccccggggaccccgtacgttacggacccgtaacggtcgggggaccggacgggggtaacgtccggttacgggtacccgtacccggttccttacccgtacgaccggtcccctaacccgtaacccggaaccggggtcccctaacggttccccggttcccctttcccccggacggttccccaccccggttccctaaccgaacggaccgtaccctacccgtcgggtcgggaccacgcgccgacgcccggtagccgtcgccgttaggactaacggtctacccgtcgacgtccttctacgtcgtcggacgccgggtacgtggaaccggtcggcccgatacgtacgngc

SEQ ID NO: 54895 - DNA, 749 bp, Homo sapiens
  misc_feature: GYAE6OF02G508W.29.78.H01.1.454.CMB.1.raw
  modified_base (712)..(712): a, c, t, g, unknown or other
  misc_feature (712)..(712): n is a, c, g, or t
tcagatagagtactcacgaccggtgctcgatttagtgtgagtagtttgggtttgggggcgcctgggtacggccggggggtcgctgagactctcctgtgcggcctctggtatttaagttttaggagtcatgccatgaactgggtcccgccgaggctccgagggaagggctggagtgggtctcggctattagtggcaggtggtggcgcgtatatattatgcagaccgccctggaacgggccgttcacctattaccagacgaacactcgaagaacacgtactgttactctgacaagtggagacgctgagaccgtcgaccgacgtaccggtccgttactattagtttagttaggttaaacggcgtaagtcgtaggaaacggtacccggggtacccggggaccgtcgttacgacccgtaacggtcggggaccggacgggtccgtcgtcggttcccgtaccgtccttacccgtcgaacgcccctaccgacccggaaacgggtcccctacgtcccgtttccccgttcccccgtcggtacccctccccgtacccgttacccgaacgtaccgtccgtacccgttacgggtccgggacccgaacacggaccgaccggtcccggtcggtacccgttccgggcccgttacggtaccgtaaaccgttacccgttacccttaccgttaccgtacttaccgtacgttccgtaggaccggttcccggngtacccggtacgaccgggtacgacgtacgtaggtcag

SEQ ID NO: 54896 - DNA, 668 bp, Homo sapiens
  misc_feature: GYAE6OF02H6GCE.29.78.H01.1.454.CMB.1.raw
  modified_base (224)..(224): a, c, t, g, unknown or other
  misc_feature (224)..(224): n is a, c, g, or t
  modified_base (569)..(569): a, c, t, g, unknown or other
  misc_feature (569)..(569): n is a, c, g, or t
  modified_base (627)..(627): a, c, t, g, unknown or other
  misc_feature (627)..(627): n is a, c, g, or t
  modified_base (666)..(666): a, c, t, g, unknown or other
  misc_feature (666)..(666): n is a, c, g, or t
tcagatagagtactcacgaccggtgctcgatttagtgtgagtagtttgggtttgggggcgcctgggtacgggccgggggggtcgctgagactctcctgtgcggcctctggatttaagttttaggagtcatgccatgaacgtgggtccgccaggctccgaggggaaggggctggaggtgggtcgtcggcttattagtggcaggtggtggcgctatatattatgcngacgccctggaacgggccggttccacctactttccagagaactaattacgaagaaccacgctgtatctgacaaagtggaagacgcctaggacgactacgacgaacaccggtcccggttacttatttagtttacggttaggttaaacggcgtagcgtaggaacgtaccggggacccggggtacccgtacgttacgaccctaaccggtcggggccggaggggaccggtcgtcgggtccacccgttctccctcaccgcctcccaccgaaccggcccacgtccggtcccccttccccgcgcctaccctccgtccaacgcgtcccaaccggttcggcgggccatacgacncgtcccgtaggcctcgaccgtgaccgaacggtacctacctccgtatacgtcctagtcnggcggtaccggtcgtggaccgaaggccacgtaagtacgngc

SEQ ID NO: 54897 - DNA, 797 bp, Homo sapiens
  misc_feature: GYAE6OF02GWEHZ.29.78.H01.1.454.CMB.1.raw
  modified_base (203)..(203): a, c, t, g, unknown or other
  misc_feature (203)..(203): n is a, c, g, or t
tcagatagagtactcacgaccggtgctcgatttagtgtgagtagtttgggtttggggcgcctgggtacggccgggggtcgctgagactcgtcctgtgcggcctctggattaagtttaggagtcatgccatgaactggtccgccaggctccagggaagggctaggacgtgggtctcggctattagtggcagtcggtggcgctanatattatggtcagacgccctgaagggccggttcacgatttccgagagaccaattcgaagtaacacggacttggtaacttcttggaccaaagttcggaagtacggcctaggaggtaacacggacgacgtaacgggtccgtcttaagttagtttgtacgtttaaaacgggcctaaggcgttaagggaaacgtttacccgggggaaccggggtaccccgtaaacggtttcggaaccccacgtttacggggggaccctaacggggggacgtaaccgtttggggaccgtaacccggttcttaaccccgttcgaaacggtcccctttacccgaacccggtaacgggtacccctaccgttacccgggtaaccttttccccccgacggttacccggtaaccccttacgttacccgaacggtaacgtaccgtaacccttaccggttcgggggacaccggtaaacgccgtaacgtcccccgttaagggcccgtttacgaccgtccgggtcgtaaacgggtaccgtaacgttaccgaacgttactacgtacgtcgttacggacgtacgggtactgggtacaacggtccgtacgacgttaggcctg

SEQ ID NO: 54898 - DNA, 604 bp, Homo sapiens
  misc_feature: GYAE6OF02I4YH2.29.78.H01.1.454.CMB.1.raw
  modified_base (401)..(401): a, c, t, g, unknown or other
  misc_feature (401)..(401): n is a, c, g, or t
  modified_base (474)..(474): a, c, t, g, unknown or other
  misc_feature (474)..(474): n is a, c, g, or t
  modified_base (520)..(520): a, c, t, g, unknown or other
  misc_feature (520)..(520): n is a, c, g, or t
  modified_base (602)..(602): a, c, t, g, unknown or other
  misc_feature (602)..(602): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaacgggccgttcacctatttccagagacaattcgaagaacacgctgtatctgacaaatggagacgctagacgactcgacgacacggccgtacttattacgtgttagtaaaggcgagtctggaacgtacggggaaccgggcccgtacgttagacccacgtggggaccgacggggaccncgtcggtcaccgtctcctcacgccctaccgaccgacggcccacgtccggtccttccccgtcgcccaccctccncctagacgccaccgtcgcggggtccacgacgcacgccgtacggtcncgtccgtcggtacgaacgtacctactcctacgtacttcgtactcgtacgacggtcggcgtcggacggacgccgacacgtagntc

SEQ ID NO: 54899 - DNA, 727 bp, Homo sapiens
  misc_feature: GYAE6OF02GYVCH.29.78.H01.1.454.CMB.1.raw
  modified_base (184)..(184): a, c, t, g, unknown or other
  misc_feature (184)..(184): n is a, c, g, or t
  modified_base (220)..(220): a, c, t, g, unknown or other
  misc_feature (220)..(220): n is a, c, g, or t
  modified_base (363)..(363): a, c, t, g, unknown or other
  misc_feature (363)..(363): n is a, c, g, or t
tcagatagagtactcacgaccggtgctcgatttagtgtgagtagtttgggtttggggtctgagagaggagtccacccctgggatcttcaggtgttttcatttggtgatcaggacggaacagagagaactcaccagtggagtttgggctgagcgtggtctttttctgtggcttaattttaaaggntccagtgtgacgtgcagttggtgagtctgggggccncgtggggtaccgggccggggggtccgtgagacctctcctgtgcggcctgtggtaatttaaggtttaggagtcagtcgacctatcgtaacgtcgggtccgccaggcctaccgaggggagggctagggtagtcgggtcgtacggnttaacgtaggtggctagggtggtgggccgtacttatacttattacgtcgacgtacggaacccgtcccggtaagggtaaacggcccgtattacccgacgtttactttaccggacgtacgtaacctaaacgtttacggaaacgtaacgtaccgtacgttagtacctcgtacgaccgtaaaggtcgggtacgacggcgtacggacgtaccgtccggtaaccgaccggtaccgtcccgttattacgtttaacgttacggttaagtaacgggcgtacgtacggtaaggtacgggtaacccggggcccgggtacctaggtccgtaaccggtcggtaccggggaaccgttacggggccctaggtacccggg

SEQ ID NO: 54900 - DNA, 674 bp, Homo sapiens
  misc_feature: GYAE6OF02FH1TF.29.78.H01.1.454.CMB.1.raw
  modified_base (182)..(182): a, c, t, g, unknown or other
  misc_feature (182)..(182): n is a, c, g, or t
  modified_base (213)..(213): a, c, t, g, unknown or other
  misc_feature (213)..(213): n is a, c, g, or t
  modified_base (218)..(218): a, c, t, g, unknown or other
  misc_feature (218)..(218): n is a, c, g, or t
  modified_base (240)..(240): a, c, t, g, unknown or other
  misc_feature (240)..(240): n is a, c, g, or t
  modified_base (356)..(356): a, c, t, g, unknown or other
  misc_feature (356)..(356): n is a, c, g, or t
  modified_base (393)..(393): a, c, t, g, unknown or other
  misc_feature (393)..(393): n is a, c, g, or t
  modified_base (501)..(501): a, c, t, g, unknown or other
  misc_feature (501)..(501): n is a, c, g, or t
  modified_base (549)..(549): a, c, t, g, unknown or other
  misc_feature (549)..(549): n is a, c, g, or t
  modified_base (592)..(592): a, c, t, g, unknown or other
  misc_feature (592)..(592): n is a, c, g, or t
  modified_base (597)..(597): a, c, t, g, unknown or other
  misc_feature (597)..(597): n is a, c, g, or t
  modified_base (647)..(647): a, c, t, g, unknown or other
  misc_feature (647)..(647): n is a, c, g, or t
tcagatagagtactcacgaccggtgctcgatttagtgtgagtagtttgggtttggggtctgagagaggagtccacccctgggatcttcaggtgttttcatttggtgatcaggacggaacagagagtaacctcgaccatggagtttgggctgagcgtgcttttctagtggctatttaaaggtntccagtgtcgacgtgcagttggtgagttcgngggcnccgtgggtacggccgggggtcncctgcgactctccgtgtcgacggcctcgtggtattaaggtttaggactcatcgccatcgaactcggttaccgaccgacgtccgtccctaagggggaacgttcgtggagttggtccncggtcttagtacgtgctaggtcggtggactccttaanacgttattacgcggacgttacgggaccctccccggtagaaacgggggtccctttaccgaacccgtttactttacccgaagtacgaaccgtagtacccgaaggtaaccnccggtctagtaaccttcgacgataaacgtgaacgtcgacttagggacnccgtacgacgacgaacgtcgtacctatttcgtactacggttanaccgngtacacgggaacgtacggggccgtacccgtagttaccggaccgttacggnggggtaccagggactcgacccggttac

SEQ ID NO: 54901 - DNA, 744 bp, Homo sapiens
  misc_feature: GYAE6OF02FKZB5.29.78.H01.1.454.CMB.1.raw
tcagatagagtactcacgaccggtgctcgatttagtgtgagtagtttgggtttggggtccgagccatggtgcagactccccgagagctctcctcctcctccactgcacagggtctctctcccagcctgtgctgacttcaatcgccctctgccttcgtcgccctcccgtgggacggctcggtcaaggtcacctgtactctgagcgagtggacacgagcagctaccgcatcgcttgcatcagcaggcgccagacgacggtccttagtacttgattcgatacgtacaacgtagtgacgtcggcgtacgtcaacggacggacgggaacgggggtaacgtaccgttacccgtagtaacgtcgtcttccgtacacggtcctcgaagtccgttcgtaccggcgttacgacgtccgtaaccgtacctaccgaacttacgtacccggtcccggtaccttaaccgtacgggttaccgtacgggtaacggtcggtaacgtaccggtacgtttaacgtaaaccttacgggtttaaccgttggaacccggttacggtaccgggttacggtaccgttcgggtaaccgttcccgttaagttttcccggtaccgggtttacgtaaccccgggggtaacccggttacgaaccggttcccgggtcccggttaggtcccgggttaaccgtaccgggaacccgttaacccgaaccgtaccctcgggtttactacccggtacctccggtttacccgtaacccccg

SEQ ID NO: 54902 - DNA, 871 bp, Homo sapiens
  misc_feature: GYAE6OF02IH3OL.29.78.H01.1.454.CMB.1.raw
tcagatagagtactcacgaccggtgctcgatttagtgtgagtagtttgggtttgggggcgcctgggtacggccgggggggtcgctgagactctctgtgcggcctctggattaagttttaggagtcatgccatgaactgggtccgccaggctccagggaaggggctggagtgggtctcggctattagtggcagtggtggcgctatatattatgcagacgccctggaacgggccggttcaccgtatttccagagacaattacgaagaacacgctggtatctgactaaagtggagagcctgagtacctcgaacgaccgaacggtcccggttacttaacgtttatttcggttaaggtttaaacgggacggtacgtcgtacgggtaaacgtaaccggggggaccccggggtaccccggtaacgttcggacccgtacggttcggggaccggtacggggggacgtccgtacgggttacctacccggttccctacccgtaccggtacccgtccccgttaacccaacccggaaccggggtacccctacggtttacccggggttcccccttttcccccccggtccggggtacccctaccccgtttccccggaccctaacggtaaccggtccctaaacccgtttccggggtacggggacccgaccgtaccggaccgacccggtcccgggttaccggggtacccgttccgggtccgttaccgggggttaacccgtaaaccgggtaaaccctttcccggttaacccgttacccgttaccgttaccgtttacggtacccggttacgggtcggggtaacccggggttccggttaaccggggaacccgtaaacggggtcccgggaacgtaacggtcggtaaccgtcg

SEQ ID NO: 54903 - DNA, 718 bp, Homo sapiens
  misc_feature: GYAE6OF02HR6FS.29.78.H01.1.454.CMB.1.raw
  modified_base (236)..(236): a, c, t, g, unknown or other
  misc_feature (236)..(236): n is a, c, g, or t
tcagatagagtactcacgaccggtgctcgatttagtgtgagtagtttgggtttggtggtctctctcccagcctgtgctgactcaatcgccctctgcctctgccctcccgtggggagctcggtcaaggtcacctgtactctgagcaggtggacacagcagcctacgccatcgcttggcatcagcgagcggccaaggaccgaccgggtcccttacgttacttgatgacagtaccaaanagtcggatcggcacgtcaacgaggaacgggtaacggggggacggtaccttcccgtagacttcgtcttcgtcgtacgttacctaccgacgtccgtacggtccgggtacctggaccgtccgtacccttaaccgtacgtaacgaaccgtttcccggaccccggtacctaccgtaacggttccgtaagggaacggagttcggaacggtcgtaagttaacctttacgttacgtcgtaacggtccggtacgggtacgggacttaacgtcgggtaacttacggttacggtacggttaccgggtaccgggggaaccggtaacgtacgggtccgtaaccggttcgggtacccgtacgaacccgccgaaaccgtcccaaccgttacggtccttacgcctttcccgaccgttccctaccgtactctacgtaccttcgttaacgcggtacggccggtacggcgtaccggacgtacgcgtacgtagagtccaggc

SEQ ID NO: 54904 - DNA, 715 bp, Homo sapiens
  misc_feature: GYAE6OF02JKFQK.29.78.H01.1.454.CMB.1.raw
  modified_base (224)..(224): a, c, t, g, unknown or other
  misc_feature (224)..(224): n is a, c, g, or t
  modified_base (247)..(247): a, c, t, g, unknown or other
  misc_feature (247)..(247): n is a, c, g, or t
  modified_base (298)..(298): a, c, t, g, unknown or other
  misc_feature (298)..(298): n is a, c, g, or t
  modified_base (326)..(326): a, c, t, g, unknown or other
  misc_feature (326)..(326): n is a, c, g, or t
  modified_base (707)..(707): a, c, t, g, unknown or other
  misc_feature (707)..(707): n is a, c, g, or t
  modified_base (713)..(714): a, c, t, g, unknown or other
  misc_feature (713)..(714): n is a, c, g, or t
tcagatagagtactcacgaccggtgctcgatttagtgtgagtagtttgggtttgggggcgcctgggtacggccgggggggtcgctgagactctcctgtgcggcctctggatttaagttttaggagtcatgccatgaactgggtcccgccaggctccgaggggaaggggctgggagtgggtctcggctattagtggcagtggtggcgctatatattatgcagacnccctggaacgggccgttcacctntttccagagacaattcgaaagaacacgtctagtatctgacaaagtggaganccgtgacgacctgacgacgacggccgtnttaattagttgtaggttaaacggcgagcgtagggaacgtaccggggaccgggtccgacgttacgaccgtacgtacgggggtaccgaacggggcgtacggtcggtacgtaccgtccgtcccgtacgaccgtccctacccgaacggaacccgggtacccgtacgttacccggttcccctttacccccggcggtaccccgtaccccttcccgtaaaccgaaccggacgtcccgtaaccgttccgggtacgggccctaaccgaacggccgtaccggtcccggtcggtcgtccggtacgtccgggtaccaaacgggttacctccggttacctacgttcctacgtacgtccgaaggtcggccggtcgtacgggacgcggtccgaccngtacgnng

SEQ ID NO: 54905 - DNA, 774 bp, Homo sapiens
  misc_feature: GYAE6OF02FY5M8.29.78.H01.1.454.CMB.1.raw
  modified_base (266)..(266): a, c, t, g, unknown or other
  misc_feature (266)..(266): n is a, c, g, or t
  modified_base (342)..(342): a, c, t, g, unknown or other
  misc_feature (342)..(342): n is a, c, g, or t
tcagatagagtactcacgaccggtgctcgatttagtgtgagtagtttgggtttgggggcgcctgggtacggccggggggggtcgctgagactctcctgtgcggcctctggattaagttttaggagtcatgccatgaactgggtccgccaggctccgagggaaggggctggagtgggtctcggctattagtggcagtggtggcgctatatattatgcagaccgccctggaagggccggttacacctatttccagagacaattcgaanaacacgctgtatctgacaatggagagcctagagactcggacaccgaccggccgtactattattggtaggttaaggngagcgtagggaagtaccgggggacccggggaccccgtacgttacgaccctacggtcgggggcccgaacgggggccgtacggttcgggtccgtaacccggtcccgtttaccctacacccggtccctaccccgaaccggtaaccggggacccctacggtcccgggtttcccctttccccccggtgggtacccccttaaccccctacccgttaacccaacggtaccgtacccgtaacccgtccgggttccgggggaccaacccgtcgacccggacccggtcccggtacggggtcctaccgggtccgtcgggtaaccgtaacggtaccgtttacccgtttacccgacgtttacctaccgttacttaccggttacgggacgggttccgggaccggttacgggaaccgggacgggtaccgtacgtaaggttcgacgtg

SEQ ID NO: 54906 - DNA, 737 bp, Homo sapiens
  misc_feature: GYAE6OF02H7GH1.29.78.H01.1.454.CMB.1.raw
  modified_base (181)..(181): a, c, t, g, unknown or other
  misc_feature (181)..(181): n is a, c, g, or t
  modified_base (258)..(258): a, c, t, g, unknown or other
  misc_feature (258)..(258): n is a, c, g, or t
  modified_base (673)..(673): a, c, t, g, unknown or other
  misc_feature (673)..(673): n is a, c, g, or t
  modified_base (701)..(701): a, c, t, g, unknown or other
  misc_feature (701)..(701): n is a, c, g, or t
  modified_base (716)..(716): a, c, t, g, unknown or other
  misc_feature (716)..(716): n is a, c, g, or t
  modified_base (735)..(736): a, c, t, g, unknown or other
  misc_feature (735)..(736): n is a, c, g, or t
tcagatagagtactcacgaccggtgctcgatttagtgtgagtagtttgggtttggtggtctctctcccagcctgtgctgactcaatcgccctctgcctctgccctcccgtgggaggctcggtcaaggtcacctgtactctgagcagtggacacagcagctacgccatccgcttggcatcgngcaggcgccaggaccgaccgggcccttcgttacttgatcgacagtacaaaacagtgagtcggactacgtacaacggnggaaccggggtaaaggggggcggtactcccggtagtactcggtacttcttcgacgttccaccgagtcgttaccggttcggggacttggacggtcctacctaacccgttgaaaccgtacgtttcccccgggtaccccggtacccttaccgtaggggttaccgtacgggtaaagggtacgttacggtaaccgggtacccttaaaggttaaacccttttacgtttaccgtacgggttacgaaccggggttacccggtacgggggtacttaccggtacggttactacgggtttccgtaacgggttcccgggttaggaccccggggtaactaggtccgtacccgggttaggtccgacgacccggtccgaaccgtacccctaacgtcgttccgtcctaccggtcttcccgtaccctccgtntaaccgtacgttacctcgtcgttacggngacggtcgccggtanaccgtcgactcgatcgacnnc

SEQ ID NO: 54907 - DNA, 770 bp, Homo sapiens
  misc_feature: GYAE6OF02IYA95.29.78.H01.1.454.CMB.1.raw
  modified_base (154)..(154): a, c, t, g, unknown or other
  misc_feature (154)..(154): n is a, c, g, or t
  modified_base (221)..(221): a, c, t, g, unknown or other
  misc_feature (221)..(221): n is a, c, g, or t
tcagatagagtactcacgaccggtgctcgatttagtgtgagtagtttgggtttggggtccgagccatggtgcagactccccagagctctcctcctcctccactgcacagggtctctctcccagcctgtgctgactcaatccgccctctcgcctntcgcctccgtgggagctacggtcaaggtccaccgtgtactctgagacaggtcgacacagcagctacnccatcgtcgttggcactcgagcgacggacggccaggtacccggaccggtcccctttgttacgtgaatcgactagtaaccaaagtaacgtgagtcggatacgtaccaacggtagggaaccgggaaacgggggtccggaacttcccgtacggtacttccggttacctcgtaccgtcgtcccgtacccgtaggtcccgtcggttacggggctaggtacccgtcccgttaacccgtaccctaaccgtaacgtacccgggttccctacccgggtcctaaaccgtcggtagtacgggacggtagttacgggaacttccgttacggaaccttttacgttacggtccgtacgtaccggaccgggtaggaccgtacgttggtacccttggttaccgcgggtttaacccgtccgggaaaccggggttataccgggttacccgtaccgggttcggggtaaccctaacccgggacgtaaccccccggaaccggttaaccccccaacccggtttgtaccccgtaccggtttaaccccgttccggttacccccgttcccccgg

SEQ ID NO: 54908 - DNA, 809 bp, Homo sapiens
  misc_feature: GYAE6OF02GH982.29.78.H01.1.454.CMB.1.raw
  modified_base (805)..(805): a, c, t, g, unknown or other
  misc_feature (805)..(805): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctagttagtggcagtggtggcgctatatattatgcagacgccctagaacgggtccggttcacctatttccagacgaacaagttacgaagaacacgctagtactctgacaaagtcggaagacgcctagacgactcggacgacgaccggtccgtacttattagttggtaagttaacggcgtagtcgtaggaacggtaccggggacccgggtacccacgttacggaaccctacggtcgggggacccggtaacggggaccgtccggttacggtcccgaacccggtttcgtaccctcggaaccgtccccttaccccgaaaccggtaacccggggacccccttacggttaccccgggtttccccctttaccccccgggtacgggtccccccttaaacccccgtttccccggtaaacccgaacgggtacccgtacccgtaaccccggtttcgggtacccggggggttacccaaaccggtacggtcccggtaaccgtaccccgggttggggtacccttcggggtacccgttacgggaccgtaaaccgggttccttaaccgttacccgtagttacccgtactacgtcgttaacggacgggtccggcggtggaccgacggtcacgtacgttacgntacg

SEQ ID NO: 54909 - DNA, 660 bp, Homo sapiens
  misc_feature: GYAE6OF02JUEFB.29.78.H01.1.454.CMB.1.raw
  modified_base (113)..(113): a, c, t, g, unknown or other
  misc_feature (113)..(113): n is a, c, g, or t
  modified_base (181)..(181): a, c, t, g, unknown or other
  misc_feature (181)..(181): n is a, c, g, or t
  modified_base (208)..(208): a, c, t, g, unknown or other
  misc_feature (208)..(208): n is a, c, g, or t
  modified_base (266)..(266): a, c, t, g, unknown or other
  misc_feature (266)..(266): n is a, c, g, or t
  modified_base (271)..(271): a, c, t, g, unknown or other
  misc_feature (271)..(271): n is a, c, g, or t
  modified_base (313)..(313): a, c, t, g, unknown or other
  misc_feature (313)..(313): n is a, c, g, or t
  modified_base (472)..(472): a, c, t, g, unknown or other
  misc_feature (472)..(472): n is a, c, g, or t
tcagatagagtactcacgaccggtgctcgatttagtgtgagtagtttgggtttggggcagggtgtacacctgtggttctcggggctgccctttggctttggagatggttttcncgatgggggctgggaggctttgtggagaccttgcacttgtactccttgccattcagccagtcctggtncaggtacggtgaggaccgctaggaccncgaacggtctgccttgttgtactcgctccctccgtcggtctttgtcgttaggctattncgacncctcaaccgccgtacacgtactgtataacttgcctgcggttnttcgtgcctacgcgtcccacccactccgctatcgtacgaccgcgaggggtcccgagactctaagcggtaggtcggttcggttggggttaggggaaagtaacggacgtacgttaccggtacccgacccccgtaggtaaccgggtctcggggtatccgggnggtacggtacgggtggtcctaggttggtcggttaggtcgtttgtacgaacgttaggttcgttcggtactccgttaactttccgtacgggtttccctagtttggtcgtttggtccggtaggttgtgttagtcttggttcgtactggtaagtccggttgtagttccgaaggtccgacgtagtcgtgtcgg

SEQ ID NO: 54910 - DNA, 730 bp, Homo sapiens
  misc_feature: GYAE6OF02GMF8M.29.78.H01.1.454.CMB.1.raw
  modified_base (275)..(275): a, c, t, g, unknown or other
  misc_feature (275)..(275): n is a, c, g, or t
  modified_base (728)..(728): a, c, t, g, unknown or other
  misc_feature (728)..(728): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgcaggctccagggaaggggctggagtgggtctcggctattagtggcagtggtggcgctatatattatgcagacgccctgaagggccggttcaccatttccacgagacaattcgaagaacacgctgtatctncaaatggagagcctgagactcgacgaccacggccggtactattagtttcgttaggttaaaaggcgtagaccgtagggtaaagttaccgggggaacccggggcccgtacgtttgaacccgtaacgtagggggcccgaacggggggaccgccggtgggtacctacccggttctcctccgtacgcccgtacccgaaccgaacgggtcccctaaagttcccgggttccttacccccccgttcgggaccctaacccccttcccgtacccaaaccggacgtacccctaacccgttccgtcggggggacctaaccgacggtacccaacggtccccgtggggccgcgttcccgtcgggttaccgaaacgggtccttaaaccgttcccgtaagttccctacttacgttactcgggaacgggtccgggtccgtaggtaccgaacgggccggaccagttacggntc

SEQ ID NO: 54911 - DNA, 769 bp, Homo sapiens
  misc_feature: GYAE6OF02HWKEU.29.78.H01.1.454.CMB.1.raw
  modified_base (575)..(575): a, c, t, g, unknown or other
  misc_feature (575)..(575): n is a, c, g, or t
tcagatagagtactcacgaccggtgctcgatttagtgtgagtagtttgggtttggggtctgagagaggagtccacccctgggatcttcaggttgttttcatttggtgatcaggacggaacagagagaactcaccatggagtttgggctggagcgtggtctttttcgttgtggtcttaagttttaaaaggtgtcctagtgtgacgtgctagttggtggagtcgtggggcgccgtgggggtacgggccgggggggttcacgtggacgacctctccgtggtcgccggtcctagtaggtatttaaggttttaggacgttcgtatcgacctagtagtaacgtcgggtccgcgaggtcctaccggagggaacggggtcgtagggtacggtagggttccgtcggtacgtagtttaggtcggtcgtgggttaggtggtcgtacgttagtaattagttaacgtgacgtacgtaccgacccggttagggaaccgggtccggttaccaccgttacgttacgagtaacgacgtaattaacggaacgaaacgcgtacttggtactacgtacgaacgaagtcgggaacncgtacgtacgaacgtaccgtacgggaacccgtaaccggtcggtaccttacgttaaggtttcgttaggttaaacggttaagggcgtacggtcgtaagggtacccggtaaaccggggtccccggtaccgggtacccgttccggaacccggtaccgggaccgggaccggacggggtaccgtccggtaccgggttccc

SEQ ID NO: 54912 - DNA, 760 bp, Homo sapiens
  misc_feature: GYAE6OF02IOV9M.29.78.H01.1.454.CMB.1.raw
  modified_base (428)..(428): a, c, t, g, unknown or other
  misc_feature (428)..(428): n is a, c, g, or t
  modified_base (753)..(753): a, c, t, g, unknown or other
  misc_feature (753)..(753): n is a, c, g, or t
tcagatagagtactcacgaccggtgctcgatttagtgtgagtagtttgggtttgggggcgcctgggtacggccggggggggtcgctgagactctcctgtgcggcctctggattaagttttaggagtcatgccatgaactgggtccgccaggctccagggaaggggctggagtgggtctcggctattagtggcagtggtggcgctatatattatgcagacgcctggaagggccgttcacctatttccagagacaattacgaagaacacgctgtactctgacaagtggagagcctgacgactacgacgacgacggccgtactattattgtagtaaaggcgagtcgtaggaacgtaccggggaccgggcccgtacgttcgaccgacggtcggggaccgagggggaccgtcgtcggtaccgaccgtctcccncgacgaccctaccaacccgaacgggccctagtacccgggtccttcccccgtaggcccctaccccgtccctaaccgaacgaccgtacccgaaccgttccgggtacgggggacccaacgtaccgaccgtaacccggtcccgtaccggggtcctccggtacccggtttacgggtaaccgggttaaaccggtaccccgtttaacccgtttacccggtaaccggtttaccccgttacgtttaccggttaacccggttagggtacccgggggtacccgggttcgggtacgggaacccggaaccgggtccggtaaccgtaacgggttaccgngtaaccg

SEQ ID NO: 54913 - DNA, 794 bp, Homo sapiens
  misc_feature: GYAE6OF02I5ASO.29.78.H01.1.454.CMB.1.raw
  modified_base (109)..(109): a, c, t, g, unknown or other
  misc_feature (109)..(109): n is a, c, g, or t
  modified_base (272)..(272): a, c, t, g, unknown or other
  misc_feature (272)..(272): n is a, c, g, or t
tcagatagagtactcacgaccggtgctcgatttagtgtgagtagtttgggtttggggtccgagccatggtgcagactccccagacgctctcctcctcctccactgcacngggtctctcctcccagcctgtgctgactcaatccgccctctcgcccttctcgtcccctcccggtggggacggtccgttcggtacgaacggtcctaccgttgtactcgtgagctaggtcgaacacgaggactacgacctaccggctacgtccgtcgttagaccngtccaagcgaggcggaccacgaccgaccgggtccctttacggttacctagtagtacgaactacgtaacaaactaagtcgtaagtcggactaagtaccgaacggagggaaccgggaacgggggtaaccggtacgttaccctaggtaaccgtccgttcttcgtccgtacgtacctaccgactccggtccgtcggccgtacgtcgtacccgtactacccgtacctaaccgtaaccgttcccgccccggtaccgtccgtacgttacggtacggaacggtagtacgggtccgtaccgtaagttaaccgttattaaccgttacgttccggtacggaccgggttacgtaccgttacggaccggttacttacggttaccggtaccgggtttccgggtaccgggaacccggttacggaccggtttacccgacggtttaccgggtccgtaaccgaaccgggtaacccgttaacccgtacccgtacccgttacgtacccgttaccgtcccggtttccttacccccgttccccg

SEQ ID NO: 54914 - DNA, 723 bp, Homo sapiens
  misc_feature: GYAE6OF02I2CTZ.29.78.H01.1.454.CMB.1.raw
tcagatagagtactcacgaccggtgctcgatttagtgtgagtagtttgggtttgggggcgcctggggtacggccggggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaaggggccggttcaccagtttccagagactaattcgaaagaacacgactgtatctgacaatggagacgcgtgagacgtcgacgacacggccgtctattagttgtagtaaaggcagcgtaggaagtaccgggaccggggcccgtactcgacgacgtcggggccgaggggacgcgtcggtaccgaccggttcctcctcaccgaccctcccgaacccgaacgggcccgtaaccgtcccggttccccgtttacccccgtccgggtccctacccccgttcccgtaacccgaacggtacccgtacccaaccgtcccggggtacgggggtcccaaccgtacgccgaaccggtcccggtccgggacccgtaccgggccgttacgggtaccgtaaacggttacccgttaaccgttaccgtaccgttaccgttcttaacgtcggttacggcgggtaccggggtccggtacgggtaccgaacgggacccgtacgtaacgtaggctagg

SEQ ID NO: 54915 - DNA, 758 bp, Homo sapiens
  misc_feature: GYAE6OF02F49JK.29.78.H01.1.454.CMB.1.raw
  modified_base (212)..(212): a, c, t, g, unknown or other
  misc_feature (212)..(212): n is a, c, g, or t
  modified_base (275)..(275): a, c, t, g, unknown or other
  misc_feature (275)..(275): n is a, c, g, or t
  modified_base (295)..(295): a, c, t, g, unknown or other
  misc_feature (295)..(295): n is a, c, g, or t
  modified_base (303)..(303): a, c, t, g, unknown or other
  misc_feature (303)..(303): n is a, c, g, or t
  modified_base (621)..(621): a, c, t, g, unknown or other
  misc_feature (621)..(621): n is a, c, g, or t
  modified_base (725)..(725): a, c, t, g, unknown or other
  misc_feature (725)..(725): n is a, c, g, or t
  modified_base (754)..(754): a, c, t, g, unknown or other
  misc_feature (754)..(754): n is a, c, g, or t
tcagatagagtactcacgaccggtgctcgatttagtgtgagtagtttgggtttgggggcgcctgggtacggccgggggggtcgctgagactctcctgtgcggcctctggattaagtttaggagtcatgcatgaactgggtccgcaggactccagggaaggggctggagtgggtctcggctattagtggcaggtggtggcgctagtatattangcagacgccctaggaacgggccggttcaaccatttccgaagagacaattcgaaagaacgacgntagtatctgacaaagtgganacgctganactgacgacgacggcctcgtaattagttcgtaagttaaggcgtagctagggaaactacggggaccggggcccctaagttgaacccgtacgtggggggaccaacgggggaccacgttgggtccgtaaacccggttccttacccgtacaccgggtaccccttacccgaaacccgtaaacggggaccccgtaacggttacccggttaccccgtttcccccccgtacgggccccctaaccccgttaccccgtaacccgaaaacggaaccgtaccctaacccggtccgaccggggggttaccaaaccgaccgtaccggaaccncccccggttaggggcccgtacgacccggttaggggtaccgtaaaccggacttaacccgttaccgtaacggtaccttaactacgtcctaaggacgacccggggtntacggaccggaaggtacgacgtacgacgntacg

SEQ ID NO: 54916 - DNA, 705 bp, Homo sapiens
  misc_feature: GYAE6OF02JNLDC.29.78.H01.1.454.CMB.1.raw
tcagatagagtactcacgaccggtgctcgatttagtgtgagtagtttgggtttggtggtctctctcccagcctgtgctgactcaatccgccctctgcctctgccctcccgtgggaggctcggtcaaggtcacctgtactctgagcagtggacacagcagctacgccatcgcttggcatcagcaggcgccagacaccgggccctgttactgatgacagtacaaacaatgagtggcagtcacgaggacggaagggggacggtactcccgtagactccgtcttccgtatacgtcctccgaacggtcctaccggtcgggccgtcggacgaccgtaccgtaccctacgaacctaaccgttccgtaccccggccctccgtacgtcggtaggaacggtacggtcggaacggtccgtaggtacttaacgttcgtacgtacgacggtccggtagggcctagtcggtactacgttacgtacggtacgtaccggggaaccggtaccgaacggtaccgtacggtccgtaccggtacgaccggtacccggtaaccgacccgtaaccctacgttccgtacctacccggtacccgtttcccgtccccgttacccgtacccgttacccgtaccgttaccttaccgtacgttccggtaccgggtaccggccgggtaccggtaccggaccggtaccggtacgtaaccgacggtacgtgacgtg

SEQ ID NO: 54917 - DNA, 765 bp, Homo sapiens
  misc_feature: GYAE6OF02GOV9U.29.78.H01.1.454.CMB.1.raw
  modified_base (290)..(290): a, c, t, g, unknown or other
  misc_feature (290)..(290): n is a, c, g, or t
  modified_base (297)..(297): a, c, t, g, unknown or other
  misc_feature (297)..(297): n is a, c, g, or t
tcagatagagtactcacgaccggtgctcgatttagtgtgagtagtttgggtttgggggcgcctgggtacggccggggggggtcgctgagactctcctgtgcggcctctggattaagtttaggagtcatgccatgaactgggtccgccaggctccagggaaggggctggagtgggtctcggctattagtggcagtggtggcgctatatattatgcagacgccctgaacgggccggttcacctatttccagagactaattcgaagaacacgctgtattctgacaactggagngcctganactcgacgacacggcctctattattggtagtaaaggcgagtcgtagaacgtaccgggaccggggcccgtacttcgaccgtacggtcggggccgacgggggacgacgttggtaccgtaccgttctccgtacgacgtccctacccgaaccggaaaccgggccctaacgttacccggttcccgtttccccccgtcgggtacccctacccccgttaccctaacccgaacggtacgtacccgacccgttaccggtcggggggtacccaccggtacgacccggacccggtcccggtaacggggtcccgtacggtacccgttacggggtaacccgtaaacgggtaaccctttaacccgttacccgttaacccgttaccgttaccgtttaacggtacccgttaccgggtacggggtcccggggtaccggttaccggggaccggtacggggtaaccgacggttaacgacggactacg

SEQ ID NO: 54918 - DNA, 633 bp, Homo sapiens
  misc_feature: GYAE6OF02HO750.29.78.H01.1.454.CMB.1.raw
tcagatagagtactcacgaccggtgctcgatttagtgtgagtagtttgggtttgggggtccgagccatggtgcagactccccagagctctcctcctcctccactgcacagggtctctctcccagcctgtgctgactcaatcgccctctgcctctcgcctccgtgggaggctcggtcaaggtcacctgtactctgagcagtggacacagcagctacgccatcgcttggcatcagcaggacgccagacgacggcctcgttactgatgacagtacaaacaatgatcggacagtacaacgaggacggaagggggacggtacgtcccgtagactcgtcttcgtacgacgtctactacgtctcgtcggcgtgacgtccgacctaccctacacctaacgtcccgtcccggacctaccgagttcgtaggaggtatggacggttctataacgttatacgttgtaccgaggtaccggtggggacctacggttcggactaacgttcggaccggttccggtaaccggggaaacccggggaactaaccgggtcccgtacgggttaccggtccggtaccaccggaacccgtaaaccggaccccaaacccgtcgtacttacccgtaccgttccgtcccgttaaccccc

SEQ ID NO: 54919 - DNA, 682 bp, Homo sapiens
  misc_feature: GYAE6OF02GFWRJ.29.78.H01.1.454.CMB.1.raw
  modified_base (193)..(193): a, c, t, g, unknown or other
  misc_feature (193)..(193): n is a, c, g, or t
  modified_base (681)..(681): a, c, t, g, unknown or other
  misc_feature (681)..(681): n is a, c, g, or t
tcagatagagtactcacgaccggtgctcgatttagtgtgagtagtttgggtttgggggcgcctgggtacggccgggggggtcgctgagactctcctgtgcggccctctggatttaagttttaggagtcatgccatgaactgggtccgccaggctccgaggggaaggggctggaggtgggtctcggctattagnggcaggtggtggcgctatatattatgacagaccgccctaggaacggggccggttacacctatttccagagacaattcgaaagaaccacgctagtatctgacaaagtaggagacgaccgtagagactacgacgacacggccgtcgttattattagtagttaaggacgagcgtaggaagtacgggaccgggcccgtacgttcgaccgttttttttacgcgggaccggacgggacgcgtcggtacgtaccgtccgtcctccgacgaccctacccaaccgaacgggacccgtaccgtcccggttacccttcccccgtccggaccctaccccgtaccctacccgaacggacgaccctaccgtccgttcgggccgaaccgacgaccgaccgcccgtccgggccgtacgtccgtacggtacgtaacgtacgtacctaccgtacgtactctacgtctacgcggtcggtcgtcggacgacggtacgacgtagtacgnc

SEQ ID NO: 54920 - DNA, 729 bp, Homo sapiens
  misc_feature: GYAE6OF02FWT5I.29.78.H01.1.454.CMB.1.raw
  modified_base (221)..(221): a, c, t, g, unknown or other
  misc_feature (221)..(221): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccgaggctccagggaaggggctgggagtgggtctcggctattagtggcagtggtggcgctatatattatgcagacnccctgaagggtccggttcaccatttccagagacaattcgaagaacacgctgtatctgacaaagtggagacgtcctgaacgacgtcgacgaaccgaccggccgtactagttagttgttagttaaaggacgagcgtaggtaaacgtacggggacccggggccccgtaacgttcggaacctacggtcgggggcccggaagggggaccgccgttcgggtcctacccgtcctcccgttacgaccgtccctacccgaaccgaaccgggccctaacggtcccggttcccgttcccccgtcggccctacccctccccgtaccctaacggaccgtaccgtaaccgttccggttcgggggaccaaccgacgtaccgaaccgtcccgtacgggtcccgtcgaccgtccggtaccgaacggtacccgttaacccgttaccgtaacggttaccttaccgtacgttccgtacggtaccgggaccgggtcgtacggaccggacggtaccgacgtaagcgatcg

SEQ ID NO: 54921 - DNA, 759 bp, Homo sapiens
  misc_feature: GYAE6OF02I3EM9.29.78.H01.1.454.CMB.1.raw
  modified_base (624)..(624): a, c, t, g, unknown or other
  misc_feature (624)..(624): n is a, c, g, or t
tcagatagagtactcacgaccggtgctcgatttagtgtgagtagtttgggtttgggggcgcctgggtacggccgggggggtcgctgagactctcctgtgcggcctctggattaagtttaggagtcatgccatgaactgggtccgccaggctccagggaagggctggagtgggtctcggctattagtggcagtggtggcgtctatagtattatgcagaccgccctgaacgggccggttcacctatttccagacgacctaattcggaagaacacgctagtatctgacaagtggagacgcctagacgaccttacgaacgaccgaccggcctacttactttagttcggttaggttaaaacggcgtaacgtcgtaggtaacgtaacggggacccggggtacccggaccgttacggtaccgaaccggttacggggaccggaccggggacggtcggtaccggtacgtacccgtaccgttccctacgaccgtcccgttacccgtacccgtaaacggaccgtacccgttaacggttccccgtttaacccccgtccgggtacctacccccgttaccctaccgtaaaccgacgtaaccccgttcccgtaaccgggttccggggtacccgtaaacnccggtaccctaccgggaccgttaccgggccgttaccgaccgttcgggttaacgaacccgtacgtaacccttcgtaccgtaagttccttacgtacgtggacggcggttccgtcggtacgacggccgcgtatcgctg

SEQ ID NO: 54922 - DNA, 638 bp, Homo sapiens
  misc_feature: GYAE6OF02H93SN.29.78.H01.1.454.CMB.1.raw
  modified_base (287)..(287): a, c, t, g, unknown or other
  misc_feature (287)..(287): n is a, c, g, or t
  modified_base (473)..(473): a, c, t, g, unknown or other
  misc_feature (473)..(473): n is a, c, g, or t
tcagatagagtactcacgaccggtgctcgatttagtgtgagtagtttgggtttgggggcagggtgtacacctgtggttctcggggctgcctttggctttggagatggttttctcgagtggggggctgggagggcttttggtggagaccttgcacttgtactccttgccattcagccagtcctggtgcagggacggtgaggacgctgaccacacggtacgtgctgttgtactgcctcctccgcggtctttgcttggcattatcgcacctccacgccgtccacgtaccngttagaactcacctcgagggtcttcgtcggtctccgacgtccaccaccacgcatcgtcgtaccgtcggacggggtccgggagagtcagtagacgggttgttcggttggggttttggggggaagaggaaaggtcgtcgtaccgggtccccgaggtacgttcgaggtgcgtcgggcgtacgggtcggntagtggtgtggttagtttcggtactacgtaagttagtttcgggcttactacgttttcgtcgttcctacgttggttcgttcgtcgtggtcgttgtgtacttcgtacgttgacgtagtagttacggtggttcggttcgggtccgtacccgtaggtaccgtggtacgg

SEQ ID NO: 54923 - DNA, 733 bp, Homo sapiens
  misc_feature: GYAE6OF02J1LQY.29.78.H01.1.454.CMB.1.raw
  modified_base (241)..(241): a, c, t, g, unknown or other
  misc_feature (241)..(241): n is a, c, g, or t
  modified_base (555)..(555): a, c, t, g, unknown or other
  misc_feature (555)..(555): n is a, c, g, or t
tcagatagagtactcacgaccggtgctcgatttagtgtgagtagtttgggtttggggtctgagagaggagtccacccctgggatcttcaggtgttttcatttggtgatcaggacggaacagagagaacctcaccatggagtttgggctgagctggtcttttctgtggctatttaaaggtgtccagtgtgacgtgcagttggtgagtcgtggggccgccgtggggtacgggccggggggtcncgtgacgaccgtctcctggtcgccggtccttgttagggtattttaacggtttttaaggaacggttaccaggttacgacccgtagtacgtaaccggttcgggggtaccccgccggaacggtccgtaccccggtaaggggaacgggggtcggtggttacggtgggtcttccgggcgtagtttagggtggaggtcggtgggtacggtcgtaccgtataattagttagtcgacgacgtcgtcccgtaggaacggtccgtctacccgtattccgagaacgtataacgtacgtaaaacgacaacgtcttagtactcgtanacgaagtagagtaccgcgtagtaactacgaacgtaaccgcgggtaaccgccgttacgttaagtttcgtaacgttagtaaccggtagacgtacggaggtacggtaaccgggaccggacccgttacgaccggaccggacggttaaccgggccggtaacgggtaccggacgtccggtaccg

SEQ ID NO: 54924 - DNA, 650 bp, Homo sapiens
  misc_feature: GYAE6OF02ITPTI.29.78.H01.1.454.CMB.1.raw
  modified_base (208)..(208): a, c, t, g, unknown or other
  misc_feature (208)..(208): n is a, c, g, or t
  modified_base (259)..(259): a, c, t, g, unknown or other
  misc_feature (259)..(259): n is a, c, g, or t
  modified_base (424)..(424): a, c, t, g, unknown or other
  misc_feature (424)..(424): n is a, c, g, or t
  modified_base (448)..(448): a, c, t, g, unknown or other
  misc_feature (448)..(448): n is a, c, g, or t
tcagatagagtactcacgaccggtgctcgatttagtgtgagtagtttgggtttgggggcgcctgggtacggccggggggtcgctgagactctcctgtgcggcctctggatttaagtttaggagtcatgccatgaactgggtccgccaggctccagggagggctggagtgggtctcggctattagtggcagtggtgcgctatatattangcagacgcctaggaacggccgttcaccatttccagagtaccaattcggaanaacacgctgaatcctagactaaagtcggagacgtcctagagtaccgtacgacgaaccgtcggacccgttctaactttagttggtacggtttaaaggcggtaagctaggaaacgtacgggacccggggtcccgtacttcggaccagtacggggccgtaggggaccngttacggtctaccgttcctccgtnacggtccctacccaacgaaccgggcccaacgtccggttcccttaccccgtcgtccacccgtcctaccgaacgaccgcctaacctcggtcgggccacggaccgcgaacgccgtcggactcgccgtgtaccgaacggtaccttacgtcctacgtactactcgttcgtcggtacgcggtcgaggccgagtccggacagtacggtc

SEQ ID NO: 54925 - DNA, 700 bp, Homo sapiens
  misc_feature: GYAE6OF02GRMAJ.29.78.H01.1.454.CMB.1.raw
  modified_base (199)..(199): a, c, t, g, unknown or other
  misc_feature (199)..(199): n is a, c, g, or t
  modified_base (696)..(696): a, c, t, g, unknown or other
  misc_feature (696)..(696): n is a, c, g, or t
  modified_base (698)..(698): a, c, t, g, unknown or other
  misc_feature (698)..(698): n is a, c, g, or t
tcagatagagtactcacgaccggtgctcgatttagtgtgagtagtttgggtttgggggcgcctgggtacggccgggggggtcgctgagactctcctgtgcggcctctggattaagtttaggagtcatgccatgaactgggtccgcaggctccagggaagggctggagtgggtctcggctattagtggcagtggtggcgntatatattatgcagaccgccctgaagggccggttcaccatttccagacgacaattcgaaagaacacgctgtatctgacaaatggagagcctgagactcgacgacaccgggcctctagttacttggtagttaaaaggcgagtctggaagtaccggggaccgggccgtaccgttagaccctacggtcgggggaccagggggacctcgtacgggtcacccgtcctccgtccacgccccttacccgaacccgaacggggcccaacgttccggttccccgttcccccgtcgggcccctaaccccgtccctacccgaaacggtccgaccctaacccgttcgggtacggggcctaaaccgacggccgaaccggcccgtacggggtcccgtcgcccggttacgggtaaccaaccgggtaacctttaacccgtccgaacgtttacctcgttaaacgtcgttaggtaacgggcccggtagtccggtacggaacggtacgccgtaagngnga

SEQ ID NO: 54926 - DNA, 618 bp, Homo sapiens
  misc_feature: GYAE6OF02HXK2P.29.78.H01.1.454.CMB.1.raw
  modified_base (200)..(200): a, c, t, g, unknown or other
  misc_feature (200)..(200): n is a, c, g, or t
  modified_base (213)..(213): a, c, t, g, unknown or other
  misc_feature (213)..(213): n is a, c, g, or t
  modified_base (242)..(242): a, c, t, g, unknown or other
  misc_feature (242)..(242): n is a, c, g, or t
  modified_base (291)..(291): a, c, t, g, unknown or other
  misc_feature (291)..(291): n is a, c, g, or t
  modified_base (344)..(344): a, c, t, g, unknown or other
  misc_feature (344)..(344): n is a, c, g, or t
  modified_base (412)..(412): a, c, t, g, unknown or other
  misc_feature (412)..(412): n is a, c, g, or t
  modified_base (426)..(426): a, c, t, g, unknown or other
  misc_feature (426)..(426): n is a, c, g, or t
  modified_base (453)..(453): a, c, t, g, unknown or other
  misc_feature (453)..(453): n is a, c, g, or t
  modified_base (482)..(482): a, c, t, g, unknown or other
  misc_feature (482)..(482): n is a, c, g, or t
tcagatagagtactcacgaccggtgctcgatttagtgtgagtagtttgggtttggagtctgcaccatggctcggaccccactcctcttcctcacccctcctcctccactgcacagggtctctctcccagcctgtgctgactcaatccgccctctcgcctctcgccctccgtgggagctcggcaggtcactgtactctagngacagtagacacngacagccgtacgctagtcgtacgttgacntacagacgagacgccagaccgaccggtccttctaacttgaatcgaactntacaacgtatgagtcggacagtacacgacggtacggaggggtacgacctccgngacgtacgcttaccgacgtctaccgcgcgacgtcgtacggtctaggacctccgacttacactactacnccgtccacgtacgngtcgtagaagtgtagcgtacgtacgtnttaacgtacgtagtacgacggtcggcggntacgacgtcgtacgtcgtacggttccgacgggtaacggaccacggtacgtccggttacggtaccggtaccgtacccgtaaccggacccttaacccggcgtacccgtttaaccgcccgtttaccgcccgttacccgg

SEQ ID NO: 54927 - DNA, 655 bp, Homo sapiens
  misc_feature: GYAE6OF02IKQ84.29.78.H01.1.454.CMB.1.raw
tcagatagagtactcacgaccggtgctcgatttagtgtgagtagttttgggtttgggggcgcctgggtacggccgggggggtcgctgagactctcctgtgcggcctctggattaagttttaggagtcatgccatgaactgggtccgccaggctccagggaaggggctggagtggggtctcggctattagtggcagtggtggcgctatatattatgcagacgccctgaagggccggttcaccatttccagagacaattcgaagaacacgctcgtatctgactaaatggagagcctaggacgactcgaccgacgacggacccggtctatttatggttagttaaaggcgagctggaagtaccgggaccggggcccacgttacgaccacgtggggcgagggcgcgtcggtcaccgtcctacctcagccctccgacctaacgggcccacgtcggtcccttccccgtgaccctccctccctacctaacgacgacctaccgtccgtcggggccaccgtacgaccgcgaccccggtcggccgtacgccggtcgtaccgaacggtacccgttacgtttacccgagttaccttaccgttacgtaccgttcgggaacggtccgggtacgtacgggtccgaaacgggcccgtaagacgttagccgtg

SEQ ID NO: 54928 - DNA, 654 bp, Homo sapiens
  misc_feature: GYAE6OF02JA82B.29.78.H01.1.454.CMB.1.raw
  modified_base (389)..(389): a, c, t, g, unknown or other
  misc_feature (389)..(389): n is a, c, g, or t
tcagatagagtactcacgaccggtgctcgatttagtgtgagtagtttggggtttggggagagctctggggagtctgcaccatggctcggaccccactcctcttcctcaccctcctcctccactgcacagggtctctctcccagcctgtgctgactcaatcgccctctgcctctgcctccctgggaggctcggtcaaggtcacctgtactctgagcagtggacacagcagctacgccatcgcttggcatcagcagagccagacacgggcctgttactgatgacagtacaactaatgaatggacagtcacgagacgaaagggggacggatacccgtagactcgcttacgactagtcctaccagtcctcgtcgggcctgacgtcgactaccncaactaactcctcccggccttaccgagtcctaggaacggtactcggacggtcctcggtaacttactttaacgtacggtaccgtaacggtacccggttgggggaccctaacggtttcggaaccttacggtttaccgaacggggtttacccggtttacccggggaaacccgggggtaaacccgtaacggggttacccaaccccgggtttcggtaccgggttaccaccgggtaaccccgaaaccgggtacccccaaaccccgttaccg

SEQ ID NO: 54929 - DNA, 767 bp, Homo sapiens
  misc_feature: GYAE6OF02JOUB8.29.78.H01.1.454.CMB.1.raw
  modified_base (211)..(211): a, c, t, g, unknown or other
  misc_feature (211)..(211): n is a, c, g, or t
  modified_base (279)..(279): a, c, t, g, unknown or other
  misc_feature (279)..(279): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccgagggaagggctggagtgggtctcggctatagtggcagtggtggcgctatatattangcagaccgcctaggaacgggtccggttcacctactttccgaagacgactaagttcgaaagaaccacgntagtatctgacaagtggagacgcctgaacgaccgtacgacgaaccgacggtaccgttctaatttagttgtaacggttaaaggcgtagtacgtacggtaacggaccggggacccgggtcccgtacgttacgaccgacggttcggggaccgtagggggaccgtcggtcggtccgtaaccggtccgtacccgttaccgaccgtacccgtacccgaaaccgaccgggtccctaacggttcccggttaccccgttacccccgtcgggtacccctaccccgttaccgtaaccgaaccgtccgtacccgtacccggttaccggggtacccggggtcaaccgtacgaccggtacccgtacccgggttacggtccgtaccggtcccgtacgggtaccaaccggtaccttaccgtaaccgtccgtaccttccgttacgtaccggtcggacgggtaccggttcgaacggtacccggaggtaccgacgtacgacgtcgcg

SEQ ID NO: 54930 - DNA, 771 bp, Homo sapiens
  misc_feature: GYAE6OF02JDAA7.29.78.H01.1.454.CMB.1.raw
  modified_base (371)..(371): a, c, t, g, unknown or other
  misc_feature (371)..(371): n is a, c, g, or t
  modified_base (663)..(663): a, c, t, g, unknown or other
  misc_feature (663)..(663): n is a, c, g, or t
  modified_base (762)..(762): a, c, t, g, unknown or other
  misc_feature (762)..(762): n is a, c, g, or t
tcagatagagtactcacgaccggtgctcgatttagtgtgagtagtttgggtttggggtccgagccatggtgcagactccccagagctctcctcctcctccactgcacagggtctctctccagcctgtgctgactcaagtccgccctctcgcctctccgcccttcccggtggggagtccgttcggtacgtaacgggtcctaccgttgttacttccgtaggacgtcgtagtacggacacgacgactacgccgtacctacctacgtccgtcgttcggactagtacgacggctaagggaccggacaacggtaccggtacccgggttacccgtttacgttaacgttaggacgtactacgtaacgtaaccaaacgtnttaacggacgtcggtactacggtaaccgaaggacggggtaacgggggtaaccgggggtacggtacccttaacccggtacgtaccggttcctccgtttaccttaacggtccttcccgtaccgtcggtacgtttcgggtaaaccgggccttaaggacccgttcccttaacccgtaccggtacaacctttccgtacccgtacccgtacccgtacgtacgttcgtacgtacggacgtggtacgtagtacgtagtttacttacgtaccgtacgtacggtcggtacgggtactaccgngtaccttacggcgttacgggtacggtacgggaacggcgaccggtcgcgtcggtcgaccgtacgaccgaccgtacctccgacgttccgtctccgttaccnccgttaccc

SEQ ID NO: 54931 - DNA, 700 bp, Homo sapiens
  misc_feature: GYAE6OF02HZ0XN.29.78.H01.1.454.CMB.1.raw
tcagatagagtactcacgaccggtgctcgatttagtgtgagtagtttgggtttggggtccgagccatggtgcagactcccagagctctcctcctcctccactgcacagggtctctcctcccagcctgtgctgactcaatcgccctctgcctctcgccctcccgtgggaggctcggtcaaggtcacctgtactctgagctaggtggacacgagcagcctacgacctatcgcgttacggcatcgagcgaggacggaccacggaccgaccgggtcccttcgttacgtgatcgactacgtacaaacatgacgtcggacacgtcaacgacggacgggaacgggggcgtactccgtgacgtcgtcttctacgtacgtcctacgcgtccgtcggtcgggtcctcggacgccgtaccctaaccgtacaaccgtaccgttcccggtccccggtacccttaccggtacggtttccggaagggacgggttaacgtgggaaaccggttcgttaacgtttaaccttaagtttccgacggttaaccggacggtccgggtagggacctacggttacggaccttaacggttccggtacgggttccggtaacccggggaaccgggttaaccgtacgggtcctaccgggtcggtaccggtccaaccggaccgaaccgaccctacccgtagttcccgaccctcgttccgttcccgcccc

SEQ ID NO: 54932 - DNA, 826 bp, Homo sapiens
  misc_feature: GYAE6OF02JLXIH.29.78.H01.1.454.CMB.1.raw
  modified_base (147)..(147): a, c, t, g, unknown or other
  misc_feature (147)..(147): n is a, c, g, or t
  modified_base (181)..(181): a, c, t, g, unknown or other
  misc_feature (181)..(181): n is a, c, g, or t
  modified_base (197)..(197): a, c, t, g, unknown or other
  misc_feature (197)..(197): n is a, c, g, or t
  modified_base (319)..(319): a, c, t, g, unknown or other
  misc_feature (319)..(319): n is a, c, g, or t
  modified_base (361)..(361): a, c, t, g, unknown or other
  misc_feature (361)..(361): n is a, c, g, or t
  modified_base (735)..(735): a, c, t, g, unknown or other
  misc_feature (735)..(735): n is a, c, g, or t
  modified_base (812)..(812): a, c, t, g, unknown or other
  misc_feature (812)..(812): n is a, c, g, or t
tcagatagagtactcacgaccggtgctcgatttagtgtgagtagtttgggtttgggggcgcctgggtacggccgggggggtcgctgagactctccgtgtgcggcctctggattaagttttaggagtcatgccatggaactgggtccnccgaggcctccgagggaagggctggagtgggtcncggctagttagtggcnggtggtggcgctaatagtatatggcacggtacgccctggaacgggccggttcaaccgtatttccagacgactaagttccgaaagaaccacgtacttgtactcgttgactaaagtggagtacnctcggaagacctacgaacgaccgtacggaccgttctaagttntacggtaaggtttaaacggcgtaacgtctacgggtaaacggttccggggacccggggttcccgtaacgttaaccgggaacccctcggggttaccgggggacccgtacgggggtactaccgggtttcggaacccggtaaccggtttcctacccgtaacgccgtacccttccccggaaacggtaaacccggggtacccgtacgttccccgggtttaccccgttcccccggtaccgggtaccccctaacccgttcccccgtaaccgtaaaccggcccttcccggtaaaccggtcgggttcccggggaactaacccggcgaaccgccgttcccgggtacggcctaacccgggtcgtaaccggaacaaaccccggtttntaacccgttccgaacgtttccccgtttacgtaaccggtggtaccgggacggtttcccgaggaaccgtaggggtaccncgtacgtacgactg

SEQ ID NO: 54933 - DNA, 827 bp, Homo sapiens
  misc_feature: GYAE6OF02H4HKO.29.78.H01.1.454.CMB.1.raw
  modified_base (325)..(325): a, c, t, g, unknown or other
  misc_feature (325)..(325): n is a, c, g, or t
  modified_base (706)..(706): a, c, t, g, unknown or other
  misc_feature (706)..(706): n is a, c, g, or t
  modified_base (763)..(763): a, c, t, g, unknown or other
  misc_feature (763)..(763): n is a, c, g, or t
tcagatagagtactcacgaccggtgctcgatttagtgtgagtagtttgggtttgggggcgcctgggtacggccgggggggtcgctgagactctcctgtgcggcctctggattaagtttaggagtcatgccatgaactgggtccgccaggctccagggaagggctgggagtgggtctcggctattagtggcagtggtggcgctatatattatgcagacgccctgaggccgttcacctattccagtagaacaattcgaagaacacgctagttatcttggcaaaagtggagaactccgtgagacctcggacacgaccgggccccgttntaagttttacttgtaggtttaaaaggcgaagtcgtagggtaaacggaccggggtaccccggggacccgtaccgttacgaccctaggtccggggggacccgaaaggggggcccgtccggtttgggtacccgaacccgtttcccgtaccccttctaaaccggccccgttaccccgaaaacccgaaccggggggcccccctaaacggtttccccggggttccccctttttcccccccggcggggtaccccccttaaaccccccggtttcccctaaaccccgaaacgggaaccggtccccgttaacccctttcgggaccgggggggacccttaaccgaaacgccccgtaccggaccccccgttgggggccctcggttaacccccnggggtttaaccaaacgggttcctttacccggtacctaacggtttacctttaaccgtnttaccgttaacggcgggcccggtcgtaaccggccggaaacgggtccgtaacgaaggttgacgag

SEQ ID NO: 54934 - DNA, 702 bp, Homo sapiens
  misc_feature: GYAE6OF02ITLJV.29.78.H01.1.454.CMB.1.raw
  modified_base (219)..(219): a, c, t, g, unknown or other
  misc_feature (219)..(219): n is a, c, g, or t
  modified_base (249)..(249): a, c, t, g, unknown or other
  misc_feature (249)..(249): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacnccctagaagggccgttcaccatttccaganacaattcgaaagaacacgctgtatcctgactaaagtcgggaagacgtccgtagaacgtacctaccggaacggaaccaccgggtcccgttacttaatttagttcggttaggttaaaaggcgtagcgtaggaacggtacggggacccggggtcccgtagttcgaccacgtcggggccgaggggacgcgtggtccaccgtctccgtacgcgtccctaccaaccggaaccggacccgtacgtcccggttccccttcccccgtcggccctacccgtccctaccgaacgaccgcctacccgtcgggtacggggaccacgacgccgcggtacccgtcgggtcctcggtaccgtacgggtaccgaacggtaccgtaccttaccgtaacgtaccttacgtacgtcgttacggacgggtccggtacggtacggaccggacgggccgtacgtacgtacgtgacg

SEQ ID NO: 54935 - DNA, 806 bp, Homo sapiens
  misc_feature: GYAE6OF02IT8BX.29.78.H01.1.454.CMB.1.raw
tcagatagagtactcacgaccggtgctcgatttagtgtgagtagtttgggtttgggggcgcctggggtacggccgggggggtcgctgagactctcctgtgcggcctctggattaagtttaggagtcatgccatgaactggtccgccagctccagggaaggggctggagtgggtctcggctattagtggcagtcggtggcggctatatattatgcagaccgaccctggaagggccggttcaccctatttccacgagaacaattcgaacggtaacacgctgtactcttgactaaactggaagagcctgtaagactacggaacgacgacggaccgtctacttagttggttacgttaaagggccggaaggctagggaacgtaccgggggtaccggggaccccgtacgtttacggacccgtacgtacggggggtccgaacgggggtaaccggcgtttacgggtcgaacccgttcgtcccgttaccgacgtacccgttcccaaaccgaaccggggtacccgaacccgttccgggtttcccccgttacccccccggtttacgggtcccccgtaacccccttccccggtaaccccgtaaacggacccggtacccgtacccggttccggtaccggggggtaccaacccggtaccggaccgacggtaccccggtgggaacccttccgtccggttacggtaccggtaacggtaaccgttacccgttaccgtaaccgggttaccttacctaacgttcggtacggaccgggtcgggacccgtcggggaacgtacgggcccaccggtacgttaggacagg

SEQ ID NO: 54936 - DNA, 784 bp, Homo sapiens
  misc_feature: GYAE6OF02GM5SF.29.78.H01.1.454.CMB.1.raw
  modified_base (249)..(249): a, c, t, g, unknown or other
  misc_feature (249)..(249): n is a, c, g, or t
  modified_base (457)..(457): a, c, t, g, unknown or other
  misc_feature (457)..(457): n is a, c, g, or t
tcagatagagtactcacgaccggtgctcgatttagtgtgagtagtttgggtttggggtctgagagaggagtccacccctgggatcttcaggtgttttctatttggtgatcaggacggaacagagagaactcaccatggtaggttggctgagctggtcttttctgtgcttatttaaaggtctcagtgtgacgtgctaggttggtggtaggtcggtgggggcgccggtggggtaccggggccggggggtcncgtgacgctcgtccgtgtcgcggtcctcgtaggtaattaaggtttaggagttcagtcgcagtcgacgtcggtcccgcgtacggctaccgggaggggaagggtcggtagggtgggttcgggtcgtcggtactttaacggttaggtcggtcgtagggttcgggtggaccggtacttaaggttaattagttagtcggtacaacggggtccncccggtaagggtaccggggtcccggtttaaacacccgtttacttaccggaagaaccgtaactaaagtacccgaaaagtaacccacggtacgttactactacggtacgtaacgtaaaggtagggtaaaccgttacggaccagggtaaccgtacgtacgaaaccgccgaccggtacccttagttacttagttaacggtaaggttaaacgcggttaaccgacggtagggtaaaccgggcccgggggaccgggtaaccccgttacggtaaccgtaccgggaccggtaccggggtacccggaagggggttcccgacggtccggtaaccccgg

SEQ ID NO: 54937 - DNA, 690 bp, Homo sapiens
  misc_feature: GYAE6OF02JQUE6.29.78.H01.1.454.CMB.1.raw
  modified_base (274)..(274): a, c, t, g, unknown or other
  misc_feature (274)..(274): n is a, c, g, or t
  modified_base (411)..(411): a, c, t, g, unknown or other
  misc_feature (411)..(411): n is a, c, g, or t
  modified_base (690)..(690): a, c, t, g, unknown or other
  misc_feature (690)..(690): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgactgggtccgcaggctccagggaaggggctggagtgggtctcggctattagtggcaggtggtggcgctatatattatgcagacgccctgaagggccggttcacctatttccagagacaattcgaagaacacgctgtatcngacaaagtggagagacctagagactacgacgaacgaccggacccgtattattacgttagtagttaaacggcgaagtcgtaggaacgtacggggacccggggtcccagttcgaccctagtcgggggaccaggggaccncggttggtaccaccgttctcctacgacgccctacccgaacgacggcccaacgtccggttacccttccccccgtggtacccaacccgttccctacccgaacgtaccgaccgtaacccgttcggtacggggaccacgacgtaccgacgtcccggtacggtccgtcgtacccgttcggtaaccgtaacggtaaccttaaccgttacccgtagtaacccttcgttaacgtacgttacggtaacgggtccggcgtacggacgaacggccgacgaacgttcgacn

SEQ ID NO: 54938 - DNA, 778 bp, Homo sapiens
  misc_feature: GYAE6OF02GS1RR.29.78.H01.1.454.CMB.1.raw
  modified_base (238)..(238): a, c, t, g, unknown or other
  misc_feature (238)..(238): n is a, c, g, or t
  modified_base (739)..(739): a, c, t, g, unknown or other
  misc_feature (739)..(739): n is a, c, g, or t
  modified_base (773)..(773): a, c, t, g, unknown or other
  misc_feature (773)..(773): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgcctgaacggccgttcactntttccagacgactaattcgaagaacacgctgtatctgacaaagtggagacgtcctagagtacctacggaacaacgaccgggccgttaccgttaagtttagttaggtttaacggttaaaacgggcggtaagtccgtaagggtaaacggtaccggggggaaccccgggggtaccccgtaacggttccggaaccgacggttaccgggggaccgggacgggggacgtacggtcgggtacctaacccgggttcctcccgttcgaaccgtcccgtacccgtaccgaaaccggggccctaacggttcccggttacccgttcccccgtcgggaccccctaccccttcccgttacccaacggacgtacccgtaccctccgggtacggggcctaaccgacggtccgaaccggtcccgacggggtccctcggttaccccgtggttaccgaacgggtaaccctttaccgttacctaccggttaccttctacgttacggtcgacggggtcccgnggttacggaacggtaccgggcgtaacgtaggacnggtac

SEQ ID NO: 54939 - DNA, 979 bp, Homo sapiens
  misc_feature: GYAE6OF02ION40.29.78.H01.1.454.CMB.1.raw
tcagatagagtactcacgaccggtgctcgatttagtgtgagtagtttgggtttgggtgggtactctactcccagccgtcgtgcctaggactcaatccgccctctaggccttcgtcgaccgtccctggggtaggtctccggttcgaaggtcctaccgttcgtacctcctggacgtcgtagttaggaccgacgacgtccgacgaccgttaaccggccctaagttccggtaccgtttcgggacgtaacttccggaacgaccgaaccggaacggggaaccgaacggtaccggaccggggtacccttacgttttaccgtagaacgttacgtaacgtacgtacaaacgacgtacggtaactcggacctaccgttaccgaacgaacggtaaccgggaagggggaccggtaacctacccgtagtacgtaccggtacttaccgtaacgtacccgttaccgtaacccgtacgttcccgtttaccggtaccgggtaaccgtacggtaccggtaccgtttaccttaacccgtacgtaaacccggtacccgtttacccgggaaccccggttacccttaccgggtaccggtttaccgtaacgggttaaccgggtacggttacggggtaacgggtaaccgttaacggttaacccggtttaacggttaacccgttacggttaaccgtaccgggtaccgggtttacgggtacccgtaccgggtacggtaaccgttaccggttacggtaccggttaccgggtacccgggtaacccggtacggttaccgtacccgttaccggttaccgtaccggtaccgaccgtaccgtaacccgtcccgttaacccgtcgtaccgtaccgtaccgttaccgtacccgttaccccgtaccgtacccgtaccgttaacgtaccgtacgtaacgtccgtacggtacccggttaccgggtaccgtaggtacccggtacggtaccgtaacgtaccgtacgttccgaactcgg

SEQ ID NO: 54940 - DNA, 772 bp, Homo sapiens
  misc_feature: GYAE6OF02JZX1K.29.78.H01.1.454.CMB.1.raw
  modified_base (361)..(361): a, c, t, g, unknown or other
  misc_feature (361)..(361): n is a, c, g, or t
  modified_base (759)..(759): a, c, t, g, unknown or other
  misc_feature (759)..(759): n is a, c, g, or t
  modified_base (768)..(768): a, c, t, g, unknown or other
  misc_feature (768)..(768): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgcatgaactgggtcccgccaggtctccaggggaaggggctggagtgggtctcggctattagtggcagtggtggcgctatatatttactcgcacgacgccccgtggtaacgggcccggttctacccatttacccgagacggaacaagttccgaaacggaaccacggtctgttacgtctaggaccaaagtcggagtacgcctgaacgaccgtacgaccacgtaccggtaccgttntaacgttattggttaaggttaaacggcgaaggtcgttagggaaaccggtacccggggggtaacccgggtccccgtaaccgttacggaacccgtacgggttcggggggaccgaaggggggtaccccgtagttccgggtaccgacccgttccgttccgtcccggaactcccggacccgtaaccgaccggggtcccgtaaccgtccggttaccccgtttcccccgacgtaccctaccccgtaccctaccgaaccggtacgccctacccggttccggtaccggggcctaacgcggaccgtacgaccccgtgggacccgtacgtccgtaccggtagaccgtcgtacttccctaagtctaccgtactcgtcgtacggccggtcgtacggaccgtagggtacccngtaacgtcngtac

SEQ ID NO: 54941 - DNA, 780 bp, Homo sapiens
  misc_feature: GYAE6OF02IVSSC.29.78.H01.1.454.CMB.1.raw
tcagatagagtactcacgaccggtgctcgatttagtgtgagtagtttgggtttggggtccgagccatggtgcagactccccagagctctcctcctcctccactgcacagggtctctctcccagcctgtgctagactcaatccgccctcgtgccttcgtcgtccctcccgtgggacggcttcgggtacaaggtccaaccgttggtacttcgtggagtccagggtacggaccaacgacgacgacgccgtaaccgcccagttccgtcgttacggacctaacgtcgaagaccgaggaccggacccaacggaacccggaccggggtcccctttacggtttaaccttggaccgttaggaaaccgtacggtaaccaaaactaagtggtacgtacgggctaacggtaccgaacggtaacgggaccggggtaacggggggaccgtacctacccggtgtaaccgtcgtaccttccgtcgtaccgtccttacacggtcgttccggtcggtacctggaccgtcccgtaccttaccgaacctacgtaccttaccccggtcccgtacccgtacgtacgtcggaggtaagacgtcggtaccgtacgtagttacgttaacgtacgttcacggaccgggtaccggtgggaccttaggccggtatacgggttcgaccgggttaccggtacccgggaaaccggtcttaccgggtacccggtcggttacggtccgtaccggaccggtaacccaaccggtcccaactcgttccctacaccggtttcccgaccgttaccccg

SEQ ID NO: 54942 - DNA, 626 bp, Homo sapiens
  misc_feature: GYAE6OF02FNE19.29.78.H01.1.454.CMB.1.raw
  modified_base (147)..(147): a, c, t, g, unknown or other
  misc_feature (147)..(147): n is a, c, g, or t
  modified_base (196)..(196): a, c, t, g, unknown or other
  misc_feature (196)..(196): n is a, c, g, or t
  modified_base (228)..(228): a, c, t, g, unknown or other
  misc_feature (228)..(228): n is a, c, g, or t
  modified_base (244)..(244): a, c, t, g, unknown or other
  misc_feature (244)..(244): n is a, c, g, or t
  modified_base (368)..(368): a, c, t, g, unknown or other
  misc_feature (368)..(368): n is a, c, g, or t
  modified_base (403)..(403): a, c, t, g, unknown or other
  misc_feature (403)..(403): n is a, c, g, or t
tcagatagagtactcacgaccggtgctcgatttagtgtgagtagtttgggtttgggggtccgagccatggtgcagactccccagagctctcctcctcctccactgcacagggtctctctcccagcctgtgctgactcaatcgccctntgcctctgccctccgtgggagctcggtcaaggtcaccgtgtactctgancagtggacacgagcagcctacgccagttccgnttggctagtcagcagnggccagtaccgaccgggtcccttcgttacgttcgagtagacacgtcaaacgtatggtaacgtggactacgtcgaacgacggaccgggaaggggggtaccgactcccgtagacgtcgtctttacnctacgtacctccgacgtcgtcgacgggtctggacncgtacctacctcaacctactccgtaccgcctacccgtagtcgtaggacgtagtcggacgtaccttgtaacctactttcgacgtacgacggtacgttcgggactacgcgtactcgtagtaccggtcgtaacgggaccgtacgtacgtaccgcggtcgtccggtacgaaccggcccgacgacccctaccgtacgtcgtaccgtaccgttccgttacccgtacccg

SEQ ID NO: 54943 - DNA, 723 bp, Homo sapiens
  misc_feature: GYAE6OF02I0MNT.29.78.H01.1.454.CMB.1.raw
  modified_base (719)..(719): a, c, t, g, unknown or other
  misc_feature (719)..(719): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccgagggaaggggctggagtgggtctcggctattagtggcagtggtggcgctatatattatgcagacgccctggaacgggccggttacacctatttccagagacaattacgaagaacacgctgtatctgacaaagtggagacgctgacgactcgacgacacggccgtactatttagttagtaggtaacggcgagtcgtaggaacgtaccggggaccgggcccgtacttacgacccgtacggtcggggaccggaggggaccgtcgtcggtacctaccgtccgtccctacgaccgtacccgtacccgaaccgaaccgggcccctaacggttcccgggtccctttccccccggtacggtcccctacccttcccgtaaccgaaacggtaccgacccgtacccgttccgggtcggggaccaaccgtacgacccggacgtcccggtcgggcctccggtcccggttacggaccgtaaccggtaccgttaccctacgtaccgttaccttacgttaccgtcggtacggtaccgggtcgggtccgtacggaccggtacggaccgtacgtaagtacgngtcg

SEQ ID NO: 54944 - DNA, 975 bp, Homo sapiens
  misc_feature: GYAE6OF02H5TT9.29.78.H01.1.454.CMB.1.raw
  modified_base (150)..(150): a, c, t, g, unknown or other
  misc_feature (150)..(150): n is a, c, g, or t
  modified_base (974)..(974): a, c, t, g, unknown or other
  misc_feature (974)..(974): n is a, c, g, or t
tcagatagagtactcacgaccggtgctcgatttagtgtgagtagtttgggtttgggggcgcctgggtaccgggccggggggggtcgctgagactctcctgtgcggcctctggatttaagttttaggagtcatgccatgaacgtgggtccnccaggcctccgaggggaaggggctgggaggtgggtctcggctagtttagtggcaggtggtggccgctatattatttatcgcaggaccgccccgtaggaacggggtcccgggtttaccacctacgttttcccgagaacgaacgtaaacttccggaaaaaaaaaaaaagccgaccgtccgttagttacttccgtacgtacgtaaaaacgttggggaacggacgtcccgtagggaacgtaccgttaccggaaccggtaaccacccggggtcccgttttacctttaagttttaaggttttacggttaggtttaaaacggggccgtaagggtccgttaggggaaacccgtacccggggggaccccggggggtaacccccttagtttaccggaacccgtacggtaccgggggggacgaacggggggtaccgacggtttcgggtacccgacccgttacccgtaccctttcggacccggtcccccttaacccgaaccccggggtaaaccggggaccccgtaaccgggttttcccgggttacccccccgttttaccccccgggtacccggtaccccgtacccccgttcccccgtacccgtaacggacccgtaccctaacccggtttccgggccgggggtaccctacggaccgtacccgaccgggtcccccgtacgggggtaccttcccggtaccgtacggggttaccgtaaaccgggtacccgttaaccgttacccgtaacgtttacccgttcgtaccgttccggtaccggtacggtaccggggttcccggaagggtacccgggaacggccggttaacccgtaggtacggtanc

SEQ ID NO: 54945 - DNA, 592 bp, Homo sapiens
  misc_feature: GYAE6OF02JIL63.29.78.H01.1.454.CMB.1.raw
  modified_base (183)..(183): a, c, t, g, unknown or other
  misc_feature (183)..(183): n is a, c, g, or t
  modified_base (244)..(244): a, c, t, g, unknown or other
  misc_feature (244)..(244): n is a, c, g, or t
  modified_base (410)..(410): a, c, t, g, unknown or other
  misc_feature (410)..(410): n is a, c, g, or t
  modified_base (467)..(467): a, c, t, g, unknown or other
  misc_feature (467)..(467): n is a, c, g, or t
  modified_base (519)..(519): a, c, t, g, unknown or other
  misc_feature (519)..(519): n is a, c, g, or t
tcagatagagtactcacgaccggtgctcgatttagtgtgagtagtttgggtttggggtctgagagaggagtccacccctgggatcttcaggtgttttcatttggtgatcaggacggaacagagagaactcaccatggagttttgggctgagctggctttttcttgtggctattttaaaaggtntccagtgtgacgtgcagttggtggagtctgggggcgccgtgggtacgggccgggggggtcncgtgagcgtctcctgtgcggcctgtggattaagtttaggagtcatgcatgaacgtgggtccgccaggctaccgagggaaggggctggaggtggtcgtcggctagttaggtgcgtagtggtggcgctatatattagtgcacgacgccgtggacgggtccgtcacctntttccagtacgactaagtccgaaagaccacggacttgtatcgtgacgaaagttgganacgctgacgatcgaacgacgaccggccgtatacttgttgtagtaagcgtagntagggacgtacggggacccggtcggacgttccgacgtacgccggggaccgaggggaccgtcggtcggtacccg

SEQ ID NO: 54946 - DNA, 615 bp, Homo sapiens
  misc_feature: GYAE6OF02FWB0Q.29.78.H01.1.454.CMB.1.raw
  modified_base (518)..(518): a, c, t, g, unknown or other
  misc_feature (518)..(518): n is a, c, g, or t
tcagatagagtactcacgaccggtgctcgatttagtgtgagtagtttggggtttggggagagctctggggagtctgcaccatggctcggaccccactcctcttcctcaccctcctcctccactgcacagggtctctctcccagcctgtgctgactcaatcgccctctgcctctcgccctcccgtggggacggtctcggtcaaggtccacctgtactctgagcagtggacacagcacgctacgccagtcgcttggcatcagcaggacggccagaccgaccgggcctacgttactgatgacacgtacaacaatgagtggacagtacaacgagacggaacgggggacggacgtaccctgaactcgtcttctcgtacgtccgtacctacgtcgttcggtacgggcctggaccgcgtcccgtactccaactaacgtcccgtcccgccctaccgtcgtcgtgacggagtcggacggtctacgtaccttacttacgtacgcgacgtccggtaggtacacggtcgnttacgttcggttacgtccggtccgggtaaccgggtaccgtacggtccgtaccgtcggtccggaccgtaccggacccgaccgacccgtacccgtaccg

SEQ ID NO: 54947 - DNA, 723 bp, Homo sapiens
  misc_feature: GYAE6OF02H5YFI.29.78.H01.1.454.CMB.1.raw
  modified_base (246)..(246): a, c, t, g, unknown or other
  misc_feature (246)..(246): n is a, c, g, or t
  modified_base (353)..(353): a, c, t, g, unknown or other
  misc_feature (353)..(353): n is a, c, g, or t
tcagatagagtactcacgaccggtgctcgatttagtgtgagtagtttgggtttgggggcgcctgggtacggccgggggggtcgctgagactctctgtgcggcctctggattaagtttaggagtcatgccatgaactgggtcccgcaggctccgaggggaggggctggagtgggtctcgggctattaggtcggcaggtggtggcgctatatattagtgacagtacgcccgtaggaacgggtccgttnacctattccgagacgtactaacttcgaaacgacacgtctagttacgtctacgacaaacgtgggagaacggtcctaggacgtacgtcgaacgaacgaccggtcccttntagtttatggtagttaaaggcgacgtacgtaggaacggtaccggggacccgggcccgtacgtcggacccgtacggtcggggacggacggggacgtcggtcggtccacccggttctaccctgaccgtccctaccgaacccggaccggacccgtacgttcccggttaccccgtttcccccgtcccggtacccgtacccttcccgtaacccgtaacgacgcccgtacccggtccgggtccgggaccacgccgaccgtacccggtccggtaccggtcgtccggtccgtacggtacgaacgtcctaccgtacgtacgtactcgttacgctacgggacggcggtacggcggacgtacggcggtacgacgtgacgtg

SEQ ID NO: 54948 - DNA, 1009 bp, Homo sapiens
  misc_feature: GYAE6OF02HAWA0.29.78.H01.1.454.CMB.1.raw
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgcaggctccgagggaaggggctggagtgggtctcggctagttagtggcaggtggtggcgcgtaatatattagtgcacgaccgcccgtaggaacgggccgttcacctatttccagagacaagttcgaaagaacacgctagtatctgaactaaagtggagacgtccgttaggaagaccgtccggaaccgaaccgtaccgggtacccgttacctttaagtttaacgttttcgggtaaaggttaaaacgggtccggtacggtacgttaggggaaaaccggtaccgggggggacccccggggtaccccgtaaccggtttaccggaacccgtaaccggggttcgggggaccccgggtaaggggggtacccggtaccgttaccggggttacccgtaaccccggtttcccgtttccccgttaacccggaccgggtacccccccgtttaaacccccgggaaacccgggtaaacccccgggggtacccccgtttaaccgggtttccccggggtttaaccccccgtttttccccccccgggttacccgggtacccccgtttaaccccccgttacccccgtaacccgttaaaacccggggtaccccgtaaccccgttaacccccggttcccgggggttacccgggggggtaaccctaaaccgggtaacccggtacccggttaacccgggtcccccgggttaaccgggggtccccgtttaaccgggttcccgggttaaccgggttaccggttaaaccgggttaacccgtttaacccggttaacccgttaccggttacccgttaccttacggttacgtaccgggtacgggtccggtacggttaccggaccggttacgggaccgtacgaggtacgacgtg

SEQ ID NO: 54949 - DNA, 732 bp, Homo sapiens
  misc_feature: GYAE6OF02GELZR.29.78.H01.1.454.CMB.1.raw
  modified_base (317)..(317): a, c, t, g, unknown or other
  misc_feature (317)..(317): n is a, c, g, or t
tcagatagagtactcacgaccggtgctcgatttagtgtgagtagtttgggtttggggtctgagagaggagtccacccctgggatcttcaggtgttttcatttggtgatcaggacggaacagagagaactcaccatggagtttgggctgagctggtctttttcttgtggcttaattttaaaaggtgtccagtgtgacgtgcagttggtggagtcgtgggggcgccgtggggtaccgggccgggggggtcgcgtgagtacctctcctgtcgcggcctctggatttaagtttggatcatgccatagacgtcggtccgccnggcctccgaagggagggctggagtgggcgtcggacttagtaggtggactaggtgggtggacgtgtatattattatcgacaggaccgtcccgtagggaacgggtcccgttacaaccgttactttccgaagtaagtaaccgtaaagttcgaaaacgtaaccgacggtacttaggacttcgtaacgactaaaagggttggaacgacggtccgtagaccgtaaccgtaccggaacggacccgttaccggtcccgtttactttaacgtttaggttttacggttaaggtaaaaccggggcgttagtacgggtaacgggtaaaccgggtccccgggggaaccccggggtaccctaaccgttaccgggaaaccgtccggggtcggggacccgggaacggggtccgttaccgtccgggtacccg

SEQ ID NO: 54950 - DNA, 716 bp, Homo sapiens
  misc_feature: GYAE6OF02FKW1A.29.78.H01.1.454.CMB.1.raw
  modified_base (715)..(715): a, c, t, g, unknown or other
  misc_feature (715)..(715): n is a, c, g, or t
tcagatagagtactcacgaccggtgctcgatttagtgtgagtagtttgggtttgggggcgcctgggtacggccggggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctggaagggccgttcacctatttccagagacaattcgaagaacacgctgtatcgtgactaaagtggagacgcctgagtactacgaccgacgaccggccgtcttattacgtttaggtagttaaacggcgtaggtacgtagggtaaacggtaacccgggggacccggggtccccggtaacgttccggaacccgtacggtcggggggacccgacggggggtacgtccggttcgggtccgtacccgggttcctcccgtacgaccgccccgtacccaacccggaacgggtccccacgttccggtcccttcccccggtccggacccctaccccgtcccctaccgaacggacgacccgtaccgtaccgggtcggggacccacggtacgccgtaccgcccgtacgggtccgtccgtccgtcgtacgaacgtaccttaccgtccgtacgtactcttacgtcgtaggcggtccggtcgtacggacggacggcgacctagtcgnc

SEQ ID NO: 54951 - DNA, 1025 bp, Homo sapiens
  misc_feature: GYAE6OF02GBQWV.29.78.H01.1.454.CMB.1.raw
tcagatagagtactcacgaccggtgctcgatttagtgtgagtagtttgggtttgggggcgcctgggtacggccgggggggtcgctgagactctcctgtgcggcctctggattaagtttaggagtcatgccatgaacgtgggtccgcgaggctccgaggggaagggctggaggtgggtcgtcggacttagttaggtggctaggtgggtcggcgtactatattattagtgacagaccgtcccgtaggaacgggtccggttaccaccgtactttaccgaagacgtaacctaaagtttacggaaaagtaaaccgtacggtaccttaaggttacttccgtagaaccgtaaaaggttacgggaagaacgtaccgttacggaggtaaccgtttaccggaaccgtaacccggaaccgggttacccggttacctttaacgttttaacggtttacgggtttaaacgggttaaaacggggtaccggtaacgggtaccggttaacggggtaaacggttaacccgggggggaaacccccgggggttccccgggttaaacgtttaccggtaaccccggttaacgggttacccgggggggacccggaaacggggggtaccggtcccgggtttaacggggtaacccgtacccggtaccctttacccggttaccgtaacccggtcccccgttaccccgaaaacccggtaaccccggggacccgttaacccggttaccccgggttttcccccgttaccccccggttacgggtaccccccggtaacccctttaccccgtaacccggtaaccggtaaacccgtacccgttaaccccggttcggggttaacccgggggaaacccgtcccggtaaaccggtaccggaaccccggttacccgggtccgggtacccggttaccggttccccggtaacgggttaacgtaacccggtaaactttacccgttacctaccgttaccctcgttacgttacgaacggtcggtacggtaccggacgtacggacggaccgtactaggtcgtatacgg

SEQ ID NO: 54952 - DNA, 180 bp, Homo sapiens
  misc_feature: GYAE6OF02GAAKU.29.78.H01.1.454.CMB.1.raw
  modified_base (168)..(180): a, c, t, g, unknown or other
  misc_feature (168)..(180): n is a, c, g, or t
tcagatagagtactcacgaccggtgctcgatttagtgtgagtagtttgggtttgggggtctccactcccgccttgacggggctgccatcagcccaaggccaaccccactgtcactctgttcccgccctcctcagtactctatctgagcgggctggcaaggcgcatagnnnnnnnnnnnnn

SEQ ID NO: 54953 - DNA, 828 bp, Homo sapiens
  misc_feature: GYAE6OF02H2JRO.29.78.H01.1.454.CMB.1.raw
  modified_base (219)..(219): a, c, t, g, unknown or other
  misc_feature (219)..(219): n is a, c, g, or t
  modified_base (235)..(235): a, c, t, g, unknown or other
  misc_feature (235)..(235): n is a, c, g, or t
  modified_base (259)..(259): a, c, t, g, unknown or other
  misc_feature (259)..(259): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacnccctgaagggccgttnaccatttccagagacaattcgaanacacgctgtatctagcaaaatggagagcctgagactccgacgaacacggcccggtcttaatttattcgttagttaaacggcgaaggactagggaaagtaaccggggacccgggggaccctacgttaccgaaccgaccgttgggggacccaagggggtacgcgtcgggtaccgaccggttcctaccgttaccgaacgtacccttacccgaacccgtaaaccggggtacccctaacgttacccgggtttccccgttttacccccccggtcggtaacccgttaacccccgtaccctttacccggaaaacggtaacgggttaccctaaaccccggtttccgggtaaccgggggggttaccaacccggtaaacgtccgaaccggtaccccccggtttggggaccccgtttccggaacccggtttacgggtaacccgtaaacgggtaaacccgttaacccgtttaacccgtaacgttaccccttaccggttaacttccgttacggtaccgggtaacccggggtaccttacggggtaacccgtaaaccgggttcccgacgttaacgtacggtcacg

SEQ ID NO: 54954 - DNA, 747 bp, Homo sapiens
  misc_feature: GYAE6OF02I0112.29.78.H01.1.454.CMB.1.raw
tcagatagagtactcacgaccggtgctcgatttagtgtgagtagtttgggtttggggtccgagccatggtgcagactccccagatctctcctcctcctccactgcacagggtctctctccagcctgtgctgactcaatccgccctctgcctctcgccctcccgtaggggacggcgtcggtcaaggtccaccttgtactcgtgacgcgaggtcggaacacagcacgcctaaccgccatccgcgttacggacactcgacgacgaaggacggaccaacggaccgtacccgggtccttacggttacttgatcgactacgtacaaactaatggagtcggactacgtaccaacgaacggacggggaaacgggggaccggtaactcccgtaggtaccttccggtcctttaccgtaccgtaccgttcccgtacccgtaggttccgttccgggtccggtaccgttaggaaccgtcccgtaccttaaccctacgtaaccctacggttccccgtaccgggtacccttccggaacggttcgtaggagggtacgtcgggacgtcttaacgtaactttcgttaccgacgtacggacggtaccggtacgggtactaccgtcggtacttacggttcggtacggttcccgggtaacgggacccgggtaactaccgggttcccgtacggtccggtccgtaaccgaaccggtacccgaaccggaccctaccgacgttcacccgttaccctccgttaccctcccccg

SEQ ID NO: 54955 - DNA, 854 bp, Homo sapiens
  misc_feature: GYAE6OF02HHWRM.29.78.H01.1.454.CMB.1.raw
  modified_base (217)..(217): a, c, t, g, unknown or other
  misc_feature (217)..(217): n is a, c, g, or t
  modified_base (242)..(242): a, c, t, g, unknown or other
  misc_feature (242)..(242): n is a, c, g, or t
  modified_base (315)..(315): a, c, t, g, unknown or other
  misc_feature (315)..(315): n is a, c, g, or t
tcagatagagtactcacgaccggtgctcgatttagtgtgagtagtttgggtttggggtctgagagaggagtccacccctgggatcttcaggtgttttcatttggtgatcaggacggaacagagagaactcaccatggagtttgggctgagcgtggtcttttctagtggctattttaaaaggtgtccagtgtgacgtgcagttggtgagtctggggcnccgtgggtacgggccgggggggtcncgtggacgacgtctccgtgtgcggcctcgtggtatttaaggttttaggagttcatgccatgaacgtgggtccnccgaggctcgagggaaggggctagggaggtgggtcgtcggcttagttagtggctaggtggtggcgtctatatattatgactagaccgcccgtagggaacgggtccgttacaccgtacgttttacccgaaggtaacgaaccttaaagtttaccggaaaaagtaaacccgtaacgggtacttacggtttaaacgttccgttaacggaaaccgttaaaaaggttcggggaaacggtacccggtaacccgttagggtaaaccggtaaacccgttaccgggaaacccggtaaccgtaacccggggtaccccggttttaacttaaaccggtttttaagttttaacggggtttaacgggtttaaaaaaccggggccgggttaaacggtaccggtttaacgggggtaaaccggtttaaccccgggggggaaccccggggggtaaccccgttaacccggttttacggaaacccccggttacggggttaccgggggggtaccccgtaaacggggggggtacccttaccggggttaccgggtaaccccgg

SEQ ID NO: 54956 - DNA, 744 bp, Homo sapiens
  misc_feature: GYAE6OF02J124J.29.78.H01.1.454.CMB.1.raw
  modified_base (739)..(739): a, c, t, g, unknown or other
  misc_feature (739)..(739): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaagggctggagtgggtctcggctattagtggcagtggtggcgctatatattatgcagaccgccctggaacgggccggttcacctatttccagagacaattcgaagaacacgctgtatctgactaaagtggagacgtcctagacgactcgacgacgaccggtcctacttattacgttgtaggttaaaggcgtagacgtaggaaacgtaccggggacccggggtacccctagttcgaaccacggttccgggggaccgacgggggacgtcgttcgggtacctaccgttccgtacctccgacgtacccgtaccaaccggtaacggcccgtacgtcccggttcccttaccccccggtcggtaccctaccccgtaccctaacccgaacggtaccgacccgttacccgttccgggttccggggaccacgaccgtaccgaccggtccccggtcgggtccgttaccggtcccggtacggttacccgaacggttacccgttaccgtttacccgtacgttaccttacgttacgtaccggtaggtaccggtccgggtacgtacggaaccgtaccgggccgtaccgtagtacgngtacg

SEQ ID NO: 54957 - DNA, 682 bp, Homo sapiens
  misc_feature: GYAE6OF02GDKXN.29.78.H01.1.454.CMB.1.raw
  modified_base (245)..(245): a, c, t, g, unknown or other
  misc_feature (245)..(245): n is a, c, g, or t
  modified_base (368)..(368): a, c, t, g, unknown or other
  misc_feature (368)..(368): n is a, c, g, or t
  modified_base (471)..(471): a, c, t, g, unknown or other
  misc_feature (471)..(471): n is a, c, g, or t
tcagatagagtactcacgaccggtgctcgatttagtgtgagtagtttgggtttggggtctgagagaggagtccacccctgggatcttcaggtgttttcatttggtgatcaggacggaacagagagaactcaccatggagtttgggctgagctggtctttttcttgtggctattttaaaaggtgtccagtgtgacgtgcagttggtggagtcgtgggggcgccgtgggtacgggccgggggggtcnctgagactctccgtgtcgcggcctcgtggatttaagttttaggagtcagtgccagtgaactcgggtccgccgaggcctccgaagggaaggggctgggtagtgggtctcgggcttagtttaggnggcagtggtggcgtctattatattatgcgagaccgccctggaacgggtccgttacaacctatttccgagagactaatacgaaagaacacgcgtagtatcgtanacgaaagttggagtacgtccgtgacgtaccgtacggaaccgaccgaccgggtcccgttattaacgtttagttacgttaaggttaaaaggcgtaacgtcgtaacggggaacggtaacccgggggacccggggtaccccgttaacggttacggaacccggtacgggtacggggggccccggaaggggggtccgtaccggttgggttaccccgg

SEQ ID NO: 54958 - DNA, 631 bp, Homo sapiens
  misc_feature: GYAE6OF02IJ0TE.29.78.H01.1.454.CMB.1.raw
  modified_base (347)..(347): a, c, t, g, unknown or other
  misc_feature (347)..(347): n is a, c, g, or t
  modified_base (629)..(629): a, c, t, g, unknown or other
  misc_feature (629)..(629): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcacctatttccagagacaattcgaagaacacgctgtatctgactaaaatcggagtacgccttagagactcgaacgaccgtacggccgtactattaattggtagttaaaggcnggactggaacgtacgggaccgggcccacgttacgaccacgtcggggccagggggacgcgtggtctaccgtctcctcgaacgccctccaaccgaacgggcccagtccgtcccgttcccccgtcggccacccctaccgaccctaacggacgccaaccgtccgtcggggacacgacgtcgacgtccgtggcgtcgtccgtacggtcgaaaggaccgttaccgttacctacgttacgtctagtcctggacggcggtactacggacgaacgggccgacgacgtacgncg

SEQ ID NO: 54959 - DNA, 701 bp, Homo sapiens
  misc_feature: GYAE6OF02HQ4TW.29.78.H01.1.454.CMB.1.raw
  modified_base (699)..(699): a, c, t, g, unknown or other
  misc_feature (699)..(699): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccaccaggctccgagggaaggggctggaggtgggtctcggactagttaggtggcagtggtggcgctatatattatgcagaccgcccgtaggaacgggtccggttaccaccgtactttcccgagacgaactaacgttacgaaagtaaccacgtctagtactctgacaaagtggagacgctagacgacgtcgacgacgaccggcttactatttacgtaggtagtaacggcgatcgtaggacggtacggggacccgggtccgtacgtacgaccgtacggtcgggaccgacgggctacggtcggtaccgtaccgttccgtaccgcgacccgcctaccgaaccggaccggtccgtacgttcccggttaccccttcccccgtccggtcccctaccccgtttaccgaccgaaacgtccgtaccgttacccggtaccgggtccggggaccctacggaccaccggtccggtcccggtacggtcccgtcgtaccggtcgtacgtaacgtacttaccgtctacgtactcgtacttcgcgtagcggtcgacggcgacggcacgagcgancg

SEQ ID NO: 54960 - DNA, 682 bp, Homo sapiens
  misc_feature: GYAE6OF02JGO2A.29.78.H01.1.454.CMB.1.raw
  modified_base (146)..(146): a, c, t, g, unknown or other
  misc_feature (146)..(146): n is a, c, g, or t
  modified_base (568)..(568): a, c, t, g, unknown or other
  misc_feature (568)..(568): n is a, c, g, or t
  modified_base (647)..(647): a, c, t, g, unknown or other
  misc_feature (647)..(647): n is a, c, g, or t
  modified_base (656)..(656): a, c, t, g, unknown or other
  misc_feature (656)..(656): n is a, c, g, or t
tcagatagagtactcacgaccggtgctcgatttagtgtgagtagtttgggtttgggggcgcctgggtacggccgggggggtcgctgagactctcctgtgcggcctctggacttaagttttaggagtcatgccatgaactgggtccnccaggctcccagggaaggggctggagtgggtctcggctattagtggcagtggtggcgctatatagttatgcagacgccctgaagggccgttcaccatttccagtacgacaattcgaaagacacggctgtaatctagacaaatggagacgtcctagagacctcgaaccgacaccggcccgtactattagttcgtaggttaaaggcgagtcgtagggaacttacggggacccgggaccgacttcgaccgtaacggtcggggccgaggggaccgcgtacggtccgtaaccggttctccttacgacgtcccgtacccaaccggtaaccggggacccaccggttcggttacccccgtttcccccgtaggcccttacccccgttcaacccgaagtacccgctaacccgtggtcgggaccaacgtaccncgtaccgccgtacggtctgcccgttaggaccgtaaggtaccttaccgttcaaggttccctagtactacgtggtaaccgngggtttacncggcgaacgggctaacggtctagctg

SEQ ID NO: 54961 - DNA, 808 bp, Homo sapiens
  misc_feature: GYAE6OF02HM0R5.29.78.H01.1.454.CMB.1.raw
  modified_base (447)..(447): a, c, t, g, unknown or other
  misc_feature (447)..(447): n is a, c, g, or t
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgccaggctccgagggaggggctggagtgggtctcggctattagtggcagtggtggcgctatatattatgcagaccgcctaggaagggccgttcaccgtatttccgagacgaacctaattaccgaaagtaaaccgacggtccttagtaacttcgtgacaaatggtagaacgccgttagcgaactcggaacgacaccggccgtacttattacgttgtagttaaacggcgagtccgtagggtaacgtaccggggacccggggtcccgacgttcggaccgtaacggtcggggaccgaggggggaaccnccggtttagggccgtaaccggttcctaccctacgaccgtcccctaccctaacccgggaacggggtcccaaccggtttcccgggtttacccctttccccccggtccggtaccccggtaaccccttcccggtaccccgaaacggtaccgacccttaacccggtccggtcgggggaaccctaacggtacgcccgacgtcccggtaccggggccgtcgtacccgttcggaccgtaaaccggttaccgttaaccttacccgtacgggttaaccttttcccgtaacgttacccggttcgggacgggtaaccgggtccggttaaccggacggtaaccgggtaccgacgtaaccgtaaggccgtaacgg

SEQ ID NO: 54962 - DNA, 794 bp, Homo sapiens
  misc_feature: GYAE6OF02HP6Z9.29.78.H01.1.454.CMB.1.raw
  modified_base (787)..(787): a, c, t, g, unknown or other
  misc_feature (787)..(787): n is a, c, g, or t
tcagatagagtactcacgaccggtgctcgatttagtgtgagtagtttgggtttgggggcgcctgggtacggccgggggggtcgctgagactctcctgtgcggcctctggatttaagttttaggagtcatgccatgaactgggtccgccaggctccgaggggaaggggctggagtgggtctcggctattagtggcagtggtgcgctatatattatgcagaccgccctaggaacgggccgttcacctatttccagagactaattacgaagaacacgctgtatctagacaaagtggagacgcctagacgacgtcgacgacgaccggccgtctattagttgttagtaaggcgtagcgtaggaagtaccggggacccgggccctacgttcgaacccgacggtcgggggccgagggggaccgcgttacgggtacctacccgtccgtccctcgacgtcccctacccgaaccggaaccgggtacccgtaccgttcccgggtttaccccctttccccccggtccgggtaccccctaaccccttccccgttaacccgaaaccgggacccgtacccgtaccccggttccgggggtacccgggggggtacctaaccggacccggaccggtaaccggtccccgggttaccggggtccgttaccgggtcccgtaaccgggtaaccgtaaaccgggttaccttaacccgtttacctaccggtttaccttaccgttacggttaccgtcgggacgggtcccgggtaccggtacggtaaccgggacggtacccggtacgaacggngtacggc

SEQ ID NO: 54963 - DNA, 845 bp, Homo sapiens
  misc_feature: GYAE6OF02HPZ19.29.78.H01.1.454.CMB.1.raw
tcagatagagtactcacgaccggtgctcgatttagtgtgagtagtttgggtttggggtctgagagaggagtccacccctgggatcttcaggtgttttcatttggtgatcaggacgaacagagagaactcacatggagtttgggctgagctggtctttttcttgtggtcttaagttttaaaaggtgtccagtgtgtacgtgctaggttggtaggagtcgtgggggccaccggtgggggtaccgggaccgggggggtcgcgtggacgtacctcctccgtgtcggccggtcctcgtggtaattttaaggttttaggagtacagttcgacctagtacgaacgttcgggtcccgaccgaggtcctaccggagggggaacgggtcgtagggagggttcggggtacctcgggtacttaggttacggtcggacgtaggtgggtcgggcgtacttagttattacgttagcggtacgacgtacccgtccgtaagggtacgggtcccgttaaccaccttacgtttaccgaagtacgtaactaacgttaacggaaacgaacgtaccgtacgttagttacgtaccgttacggaacgttaaaggtacgggaacgtaccggttacccgtagggaaccgtacccggtaacgggaacccggacccggttaaccgggtccctttaacggtttaacgttttacgtttagggttaaaacggtttaaaccggacgttacggaaccgggtttaacgggtaaacccggggtaacccgggggacccccgggttacccggttaaggtttacccggacccggttacgggaccgggggaccggtaccggggtactccggttaccggtcccgg

SEQ ID NO: 54964 - DNA, 767 bp, Homo sapiens
  misc_feature: GYAE6OF02J171L.29.78.H01.1.454.CMB.1.raw
  modified_base (269)..(269): a, c, t, g, unknown or other
  misc_feature (269)..(269): n is a, c, g, or t
  modified_base (273)..(273): a, c, t, g, unknown or other
  misc_feature (273)..(273): n is a, c, g, or t
  modified_base (282)..(282): a, c, t, g, unknown or other
  misc_feature (282)..(282): n is a, c, g, or t
  modified_base (293)..(293): a, c, t, g, unknown or other
  misc_feature (293)..(293): n is a, c, g, or t
  modified_base (323)..(323): a, c, t, g, unknown or other
  misc_feature (323)..(323): n is a, c, g, or t
  modified_base (345)..(345): a, c, t, g, unknown or other
  misc_feature (345)..(345): n is a, c, g, or t
tcagatagagtactcacgaccggtgctcgatttagtgtgagtagttgggtttgggggcgcctgggtacggccggggggtcgctgagactctcctgtgcggcctctggattaaggttttaggagtcatgccatgaactgggtccgcaggctccgagggaagggctggagtgggtctcggctagtagtcggcaggtggtggcgctatattacttatgcagaccgccgtggaacgggtccgtcactcttccgagtagactatcgaacaaccncgtntgtatacgngacaagtgganacgctgacaccgtgaccgactccgtccgtnttatacgttggtaagtaacggngacgtccgtaaggaacggtaccggggacccgggtaccgtacgtaccggtaccgacgggtcgggtaccggaacgggtccggtccgttacggtacccggtaccgtcccgtaccgtaccgtaacccggttccccgacccgtaaccggaacccgggtacccgtaacccggtcccggttacccccgtttcccccggtaccggtaccccgtacccctacccgttacccgaaaccggtacgcccgttacccggtaccggtcgggggtaccaccgaccggacccgtacccggcccgtacggtccgtaccgtccggtacggtaccgaaccggtacccgttacctaccgtacccgttactaccgttacgtccggtacggaccggtcggtaaccggtcggaaccgtacgggacctccggtaagcccgtagccg

SEQ ID NO: 54965 - DNA, 963 bp, Homo sapiens
  misc_feature: GYAE6OF02H5P7U.29.78.H01.1.454.CMB.1.raw
  modified_base (173)..(173): a, c, t, g, unknown or other
  misc_feature (173)..(173): n is a, c, g, or t
  modified_base (177)..(177): a, c, t, g, unknown or other
  misc_feature (177)..(177): n is a, c, g, or t
  modified_base (551)..(551): a, c, t, g, unknown or other
  misc_feature (551)..(551): n is a, c, g, or t
tcagatagagtactcacgaccggtgctcgatttagtgtgagtagtttgggtttggagtctgcaccatggctcggaccccactcctcttcctcaccctcctccctccactgcacagggtctctcctcccagcctgtgctagactcaatccgccctctcgcctctcgccctccgngggnggcctacggtacaaggtccactgtactctgaacgctaggtcggaacctacacggacacggccttaacccgacgtaacgtccggacgtttcgggactacggtccggaagaccgaacgggacggtaccccgaaacggaaccccggtaaccccgggtcccccgttttaacggttttaaccgtttaggaacgttacggaacccgtaacggttaaacaaaacgtaagttacgggtagtacggactaggtaaccaaccggaaggggaaccggggaaacggggggtaaccgggtaccgttaccggagttaccgaccgttcctttcgacccggtaactttcgacccggtacgtaccgttcggacgggtcctggggtaaaccncccggttaccctaacctccgtaaaccgttcgtcccgtaccccggtcgttccgtaacggttacgtagggtaaacggtcggttacggtaacggttaccgttacgtttaaccttaacggtttaccgtacgttaaccgggtaacccggttaacggggttcccggggaaccttaaccggttacgtttaccggtccgtttttaaccgggccggggggttttaaacccggggtttaacccgggggaaccccgggggttaaacgttaccccgggggtacccggttaacccgggggttaccgggtttaccccgggtacccgggtaaaccccgtaaccccggaacccgggtaaccccccttaaaccgggtccgtttacccccgggtaaaccctttcccgggtttaccccggttacccccggg

SEQ ID NO: 54966 - DNA, 655 bp, Homo sapiens
  misc_feature: GYAE6OF02H5U9H.29.78.H01.1.454.CMB.1.raw
  modified_base (201)..(201): a, c, t, g, unknown or other
  misc_feature (201)..(201): n is a, c, g, or t
  modified_base (461)..(461): a, c, t, g, unknown or other
  misc_feature (461)..(461): n is a, c, g, or t
  modified_base (494)..(494): a, c, t, g, unknown or other
  misc_feature (494)..(494): n is a, c, g, or t
  modified_base (498)..(498): a, c, t, g, unknown or other
  misc_feature (498)..(498): n is a, c, g, or t
  modified_base (513)..(513): a, c, t, g, unknown or other
  misc_feature (513)..(513): n is a, c, g, or t
  modified_base (537)..(537): a, c, t, g, unknown or other
  misc_feature (537)..(537): n is a, c, g, or t
  modified_base (558)..(558): a, c, t, g, unknown or other
  misc_feature (558)..(558): n is a, c, g, or t
  modified_base (608)..(608): a, c, t, g, unknown or other
  misc_feature (608)..(608): n is a, c, g, or t
  modified_base (645)..(645): a, c, t, g, unknown or other
  misc_feature (645)..(645): n is a, c, g, or t
  modified_base (653)..(653): a, c, t, g, unknown or other
  misc_feature (653)..(653): n is a, c, g, or t
tcagatagagtactcacgaccggtgctcgatttagtgtgagtagtttgggtttgggggcgcctgggtacggccgggggggtcgctgagactctctgtgcggcctctggattaagttttaggagtcatgccatgaactgggtccgccaggctccgagggaaggggctgggagtgggtctcggctattaggtggcaggttggnggcgctatatattatggctaggacgtcccgtaggaacggggtccggttcacctatttccaaggacgtaactaacgttcgaaaagaacacgtcttaggtactctacgacaaagtggagacgccgtagacgactcgaccgacacggtcctactattagtgtagtaaagcgagtcgtaggaacgtaccgggggacccggccgtagttacgaccacggttcggggaccggagggacgtcgtagtccaccgtctccagcgtaccnccgaccgacgcccgtagtcccggtccttcccgngccncctcccgacacggcnccgtaccgtcggtcgggactacgngaccgcggttccgcgggtacncggtaccgtacggtacgacgtacctacgtaccgtacgtccttactacgtntacgggcgtaccggtcgtacggacgtacggccgaacngttacggncg

SEQ ID NO: 54967 - DNA, 1023 bp, Homo sapiens
  misc_feature: GYAE6OF02ISICZ.29.78.H01.1.454.CMB.1.raw
  modified_base (255)..(255): a, c, t, g, unknown or other
  misc_feature (255)..(255): n is a, c, g, or t
tcagatagagtactcacgaccggtgctcgatttagtgtgagtagtttgggtttggggtctgagagaggagtccacccctgggatcttcaggtgttttcatttggtgatcaggacggaacagagagaactcaccatggaggtttggctgagctggtctttttcttgtggcttaagttttaaaaggtgtccagtgtgacgtgctaggttggtggagttcgtgggggcgccgttgggggtaccgggccgggggggtcncgtaggacgtacgtccttccgtggttcgccgggtcccttagtagggtaacgtttttaaaggttttagggagttaccgaagttcggcctaagttacggtaaccgttcgggtttccccgaccgaacgggtccgtacccgggaagggggtaacgggggcgttaagggtacgggttcggggttccgttacgggtaccgtttaaggttttaacgggtcggggtagtaaccggggttggggttcggggaacccgtactttaaacggtaatttacgttttaaaggttcgggaaccgaaccgggtaacccgtcccggtaagggaaacccgggggttcccggtttaaccgaacccgttacgtttacccgaacggtaagtaaccgtaaagttaacccgaaaaggtaacccgaacggttaccttagggtttaaccgttaaccgttacggaaaccttaaagggtaccggtaaacgggacggtaccccgtaggtaaaccgggttaacccgttaacgggtaaacccggaacccggttacccggggtaccccgtttaccgtttaaacggtttttaacgttaaccgggttaaacgggttttaaaaccgggaacgggtaaccgggttacgggtaaacgggttaaccgggtaaacccccggggggttacccgggggaaccccgtttaaccggtttaacccgggaaccccggttaaacccgggggtaccggggaccccggttaaacggggggtaaccccgttccggggttaccggttaacccccggg

SEQ ID NO: 54968 - DNA, 752 bp, Homo sapiens
  misc_feature: GYAE6OF02G263D.29.78.H01.1.454.CMB.1.raw
  modified_base (144)..(144): a, c, t, g, unknown or other
  misc_feature (144)..(144): n is a, c, g, or t
  modified_base (247)..(247): a, c, t, g, unknown or other
  misc_feature (247)..(247): n is a, c, g, or t
  modified_base (256)..(256): a, c, t, g, unknown or other
  misc_feature (256)..(256): n is a, c, g, or t
  modified_base (264)..(264): a, c, t, g, unknown or other
  misc_feature (264)..(264): n is a, c, g, or t
  modified_base (271)..(271): a, c, t, g, unknown or other
  misc_feature (271)..(271): n is a, c, g, or t
  modified_base (278)..(278): a, c, t, g, unknown or other
  misc_feature (278)..(278): n is a, c, g, or t
  modified_base (443)..(443): a, c, t, g, unknown or other
  misc_feature (443)..(443): n is a, c, g, or t
  modified_base (703)..(703): a, c, t, g, unknown or other
  misc_feature (703)..(703): n is a, c, g, or t
tcagatagagtactcacgaccggtgctcgatttagtgtgagtagtttgggtttgggggcgcctgggtacggccgggggggtcgctgagactctcctgtgcggcctctggattaagtttaggagtcatgccatgaactgggtccnccaggctccgaggggaaggggctaggagtgggtctcggctattagtggcagtggtggcgctatactattatgcagacgcctgaacggccgtcactattcaganacatcgaanacacgtcngtatctnactaagnggagagcctgacgacttcgacacgacggtcccgttataactttattacggttaaggttaaacgggacgtaggtaccgttagggaaaacgttaccggggggaaccccgggtcccggtaacgtttacggaacccgtacggttccgggggaccggtacggggggaccncggttacggtacccgaacccggttctccccgttcgaacggtcccctacccgaacccggaaacgggtcccctaacggttcccggttaccccttccccccgggtaagggtccccaacccgtcccttaacggaaaccgtaactcccgttaaacccgtcggggtacggggacccaacgtaccacggaacgtcccggtcggtccgtaccgtcggtacggtaccgaacggtaaccttaacgttccgtaagttctcgtaagttccgnggacggtccggtacggtacggtacgacgggtccgaagtactaggctaac

SEQ ID NO: 54969 - DNA, 814 bp, Homo sapiens
  misc_feature: GYAE6OF02IZ8W7.29.78.H01.1.454.CMB.1.raw
  modified_base (243)..(243): a, c, t, g, unknown or other
  misc_feature (243)..(243): n is a, c, g, or t
  modified_base (270)..(270): a, c, t, g, unknown or other
  misc_feature (270)..(270): n is a, c, g, or t
  modified_base (286)..(286): a, c, t, g, unknown or other
  misc_feature (286)..(286): n is a, c, g, or t
  modified_base (315)..(315): a, c, t, g, unknown or other
  misc_feature (315)..(315): n is a, c, g, or t
  modified_base (358)..(358): a, c, t, g, unknown or other
  misc_feature (358)..(358): n is a, c, g, or t
tcagatagagtactcacgaccggtgctcgatttagtgtgagtagtttgggtttggggtctgagagaggagtccacccctgggatcttcaggtgttttcatttggtgatcaggacggaacagagagaactcaccatgggagtttgggctgagcgtgtcgttttctaggtggctattttaaaaggtgtccagtgtgacgtgcagttggtggagtcgtggggacgcctgggacggccggggggtcncgtgagactctcctagtcgcggcctcnggtattaagtttaggntcatagcagtgaactcggaccgcgaggcncgtaggagggctaggagtcgggtcctcggtacttaagttaggngactaggtggtacggcgtatactagtacgttatcggacaaggtacccgcctagggaacggggtacccgtttacgaacccttgtttaacccgagaacgtaacctaagtttaacgaaacgaaccgtaccggcttaagttactacccttagaacctaaaaggtcgggaaacgtaacggttacgtacggtaacgtaaccgttaccgggaaccgggtaaccctaccggggtaaaccccttacggtttaacgtttaacggttttacgggtttaaaacggtttaaacggggtacggaaaccggttcggttaaaccggggtaaaccgggtttaaaccccggggggtaaccccggggggttacccttaaaaccggggttttaacccgaacccggggtttaaccggaccggggggtaaaccccgggtaagggggtacccgggttacccggtttaacgggtaccccg

SEQ ID NO: 54970 - DNA, 766 bp, Homo sapiens
  misc_feature: GYAE6OF02IV00V.29.78.H01.1.454.CMB.1.raw
  modified_base (145)..(145): a, c, t, g, unknown or other
  misc_feature (145)..(145): n is a, c, g, or t
  modified_base (763)..(763): a, c, t, g, unknown or other
  misc_feature (763)..(763): n is a, c, g, or t
  modified_base (766)..(766): a, c, t, g, unknown or other
  misc_feature (766)..(766): n is a, c, g, or t
tcagatagagtactcacgaccggtgctcgatttagtgtgagtagtttgggtttggtggtctctctcccagcctgtgctgactcaatcgccctctgcctctcgccctcccgtgggaggctcggtcaaggtcacctgtactcgtgancagtaggacacagcagctaaccgccagtcgtcttggctatcagacaggacgcagaccgacgggcccttacgttactcgaatcgaactagtacaaacaatcgagtaggactacgtccaacgacggacgggaaggggggtacgacttacccgtaggtactccggtacttccgagtaacccgttccttccgaacggttccttaacgggttccggaactcgggtacgtcccgtaacctaacccttcaaaccgtaacctttccgaccccgtacctacctaagttccggtagaacggtctaggtacgtctaataccttaagttccgtaggacgtaaacccggtcggttacgggacgtaccgtacggtaactttacgtaccggtacggttaccgggttaccgggaaaccgggttaccggaaccggttaccggttaacccggttccggttaaaccggttcccgaaaccggaaccccgtaccgtaaccccgtaacccgtaacccgttcgttacccgtaaccgttcccgttcccggtccccgttaacccgtcctaccggtcttaaccgtccttacgtacgtccggaaccggtcggcctacggaacgtccggccgttaacgggtactancgn

SEQ ID NO: 54971 - DNA, 881 bp, Homo sapiens
  misc_feature: GYAE6OF02I51PA.29.78.H01.1.454.CMB.1.raw
  modified_base (244)..(244): a, c, t, g, unknown or other
  misc_feature (244)..(244): n is a, c, g, or t
  modified_base (261)..(261): a, c, t, g, unknown or other
  misc_feature (261)..(261): n is a, c, g, or t
tcagatagagtactcacgaccggtgctcgatttagtgtgagtagtttgggtttggggggagagaggagtccacccctgggatcttcaggtgttttcatttggtgatcaggacggaacagagagaactcaccatggagtttggctgagctggtctttttcttgtggtcttaattttaaaggtgtccagtgtgacgtgcgagttggtggagtcgtgggggcgccgtgggtacgggcccggggggtncgtgagactctccgtgngcggcctcgtggtatttaaggtttaggagtctagtgacctagtgaacgttcggggtcccgtccgacggtaccgtacccggaagggggtaacgggggtccgttagggggtaacggggtttcggggttaccggttccgggtaccgttttaaggttttaaggggtaccgggtacgtacggggtttgggttacgggtccggtaacgttacgttaaacttaagttagtacggtacgtaacgggccccgtacccggtagggaaaccggggttccccggttaccgtaacccttacgttttacccgaacggtaacgtaacccgtaagtttaaaccgggaaaacggtaaccaaccgggtacttacggttacttacgtacgtaacggtaaagttacgggaaggtaccgtaccggtaggtaaacggtacccgttaccggaaccggtacccgtacccgggtacccgtttagttaagtttacgtttaggttaacgggttaaagggtacgtaacggtcgtaaggggtaaccggtccggggaccccgggtacccgtaacggttaccggaaccgtaccgggtccgggggtaaccggtcggggtaccggtcgttccggtacccggtcccgttacccg

SEQ ID NO: 54972 - DNA, 802 bp, Homo sapiens
  misc_feature: GYAE6OF02IDVCX.29.78.H01.1.454.CMB.1.raw
  modified_base (143)..(143): a, c, t, g, unknown or other
  misc_feature (143)..(143): n is a, c, g, or t
  modified_base (800)..(800): a, c, t, g, unknown or other
  misc_feature (800)..(800): n is a, c, g, or t
tcagatagagtactcacgaccggtgctcgatttagtgtgagtagtttgggtttggggcgcctgggtacggccgggggggtcgctgagactctcctgtgcggcctctggattaagtttaggagtcatgccatgaactgggtccnccaggctccgagggaagggctggagtgggtcgtcggctattagtggcagtggtgcgctagtatattatgcagaccgcccgtagaacgggccggttacacctactttaccgagtacgacaagttaccgaaagtaacacgccgtgtacgtctacggactaaagtgggaacgacgtcctaggaacgtaacctccggaaccgacgaacccgggtccgttactaacgtttaacgtttggtaacggtttaaacggtacgtaaggtcggttaaaggaaaccggttaaccgggggtaccccggggtaaccccggttacgttacgaacccgtaccggttcggggacccgggaacgggggtaccgtccgtgggtacctaccgttcccgtacccgtccaacccggtcctacccgaaccgaaccgggtaccctagttcccggtcccccttttaccccggcggtccctaaccccggttcctacccgtaacggacctaccggtacccgttcgggtaaccgggggcctaaccggcgtaccggtacgtaccgggtccggtactccggtaccgttagggtacccgaacggtacctaccgttacccgtacgttacgttacttaccggtcgtacggcggttccggacgacggtacgtacggccgacgggtatgtancg

SEQ ID NO: 54973 - DNA, 733 bp, Homo sapiens
  misc_feature: GYAE6OF02F4XL3.29.78.H01.1.454.CMB.1.raw
  modified_base (180)..(180): a, c, t, g, unknown or other
  misc_feature (180)..(180): n is a, c, g, or t
  modified_base (325)..(325): a, c, t, g, unknown or other
  misc_feature (325)..(325): n is a, c, g, or t
  modified_base (383)..(383): a, c, t, g, unknown or other
  misc_feature (383)..(383): n is a, c, g, or t
  modified_base (402)..(402): a, c, t, g, unknown or other
  misc_feature (402)..(402): n is a, c, g, or t
tcagatagagtactcacgaccggtgctcgatttagtgtgagtagtttgggtttggggtctgagagaggagtccacccctgggatcttcaggtgttttcatttggtgatcaggacggaacagagagaactcaccatggagtttgggctgagctggctttttcttgtggctatttaaaggtntccagtgtgacgtgcagttggtggagtcgtgggggcgccgtggggtacgggccgggggggtcgcgtagacgactcttcctggtcgcggtcctcgtggtaattaaggttttaggagttcaatgccataggtaaccgttgggtcccnccgaggcctaccggaggggaagggggcgtgggaggtgggtctcgggacttagttaggnggtcgaggtgggtggcgtntatagtattagtgcaagccgccgtagggaacggggtccgtaccaaccgttatttccgaagacaaccgtaattacggaaaacgaacctacgggtacttacgtacttcgtacaacgtaaagttcgggaacaacggtcctaggacggtacctccggaaaccgaacgtaccgggtcccgttatttaacgtttacgttaggttaaagggtaaaggccgtaggccgtaaggggtaacccggtaaccgggggggtaaccccggcccgtaaccggttacggaacccggtacgggtacggggggacccggagggggacccgtacgggtacgggtaccccg

SEQ ID NO: 54974 - DNA, 632 bp, Homo sapiens
  misc_feature: GYAE6OF02F8JES.29.78.H01.1.454.CMB.1.raw
  modified_base (347)..(347): a, c, t, g, unknown or other
  misc_feature (347)..(347): n is a, c, g, or t
  modified_base (419)..(419): a, c, t, g, unknown or other
  misc_feature (419)..(419): n is a, c, g, or t
  modified_base (426)..(426): a, c, t, g, unknown or other
  misc_feature (426)..(426): n is a, c, g, or t
  modified_base (435)..(435): a, c, t, g, unknown or other
  misc_feature (435)..(435): n is a, c, g, or t
  modified_base (472)..(472): a, c, t, g, unknown or other
  misc_feature (472)..(472): n is a, c, g, or t
tcagatagagtactcacgaccggtgctcgatttagtgtgagtagtttgggtttggggtccgagccatggtgcagactccccagagctctcctcctcctccactgcacagggtctctctcccagcctgtgctgactcaatcgccctctgcctctgcctcccgtgggagctcggtcaaggtcacctgtactctgagcaggtcggaacacgagcagctacgcatcgcgttggacatcagacaggacggccaagaccgaccgggtcccttgttacttgatgacagtacaactatgatcggctagcagaggacggaaggggacgtactccgtagacgtcgctactcagtccncgagtcctggtcgggctacggacgtccgtaccttaccgactacgtactcccgtcccggcttaccgagttcgnggaacgntaggacgtntagtaaccttgttacgcgtacacggcggtagggaccncgggtgtacgttcttacgggtacgggttacccaccgggggaaccggtactacgggtttccgaaccggttccggttaaccggcccaaaccgggtccccaacgggtaacccccaccggtagttcccgttaacaccggttttccccgtaccccgttacccccg

SEQ ID NO: 54975 - DNA, 809 bp, Homo sapiens
  misc_feature: GYAE6OF02H2KB0.29.78.H01.1.454.CMB.1.raw
  modified_base (83)..(83): a, c, t, g, unknown or other
  misc_feature (83)..(83): n is a, c, g, or t
  modified_base (143)..(143): a, c, t, g, unknown or other
  misc_feature (143)..(143): n is a, c, g, or t
  modified_base (148)..(148): a, c, t, g, unknown or other
  misc_feature (148)..(148): n is a, c, g, or t
  modified_base (245)..(245): a, c, t, g, unknown or other
  misc_feature (245)..(245): n is a, c, g, or t
  modified_base (670)..(670): a, c, t, g, unknown or other
  misc_feature (670)..(670): n is a, c, g, or t
  modified_base (707)..(707): a, c, t, g, unknown or other
  misc_feature (707)..(707): n is a, c, g, or t
  modified_base (785)..(785): a, c, t, g, unknown or other
  misc_feature (785)..(785): n is a, c, g, or t
tcagatagagtactcacgaccggtgctcgatttagtgtgagtagtttgggtttgggggcgccctgggtacggccggggggtcnctgagactctcctgtgcgcctctggattaagtttgcgtcatgccatagaacgtgggtccncaggntcccgaggggaaggggctagggcggttggtcctcggacttaagtttagtggcgtagtgggtcggcgacttatattaatacgtgacgtacggtaaccncccgtagggtaccgggtaccgtttccaaccttaacgtttccaaagacgaaaccgtaaacgtttcccggaaaaaggacccgtacgaccgtttagtaaacgttccgtagtaacctaaagttacgggaggtaccgtaccgtaaggtaacgtaaccgtacgtaccggaaccgtaaccggcccgtttattaaccgttaggtttacggttacggtaaacggtaccggtaacggtcgtaacggggttaaaccgtaacccggggggaccccgggttacccccgtaaaccggtttaccggaaccccggtaggtcccggggaacccggaggggtactccgggtaccgtaaccgtcgtccctacgtaccacgtaccgccgaaccggtacggaccctctcggttcccctaccccgtacgaccctccacctaccgtanccgtacctaacgtccgtacggcctagaaccgcgaccnggacggctcgcgtcgtaacgatacgttacgactacgttactcgttacgacgttcgacgggaccgttacgaccggttanaccggggttccaacgttagtgcag

SEQ ID NO: 54976 - DNA, 1143 bp, Homo sapiens
  misc_feature: GYAE6OF02H3DOU.29.78.H01.1.454.CMB.1.raw
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgcaggctccaggggaagggctggagtggtctcggctattagtggcagtggtggcgctatatattatgcagaccgccctaggaacgggccggttacaccgtacttttacccagtacgaactaaacgtttaccggaaagaaaccgtacgtcctaggttaactccgttagacctaaaaggttgggaaggaacgtcccgttaggaacggtacccgttaccggaaccggtaacccgacccgggtaccccggtttaccttaagtttttaagttttcggttaagggtttaaaacggggccggtaacggtaccggtttaaaggggtaaacgggttaaccccggggggggtaaccccgggggcccccgttaaccgggtttacggaaccccgttaaccgggttaccgggggggaacccggtaacgggggggaaccggttcccggtttacgggttacccgttaaacccccgggttcctttaccccgttaccgacccggtttaccccgtaacccccggtaaaccccgggtaaacccgggggtacccccgttaaacccggttttcccccgggtttaaacccccccggtttttcccccccccgggtttaacggggtaccccccctttaaccccccgtttaccccggttaacccccggtaaacggggttaaccccggtaaccccgttaccccgggttttacccgggggtacccggggggggtaacccccttaaacccggggaaccggttaaaccccgggtcccgggttaaccccccgggggtttaccggggggttaccccgttcccgggttaaccccgggttttaaccgggttaacccgggttaaaacccggggttaacccctttaaaccccggttttacccgtaaccggtttacccctttaacggtttacccgtttaaccggttacgggttaacccggggcccgggggtttaccggtaaccgggggtacccggttaaccgggacccggttaccgtaaacggttccgtagaccg

SEQ ID NO: 54977 - DNA, 836 bp, Homo sapiens
  misc_feature: GYAE6OF02HJKLB.29.78.H01.1.454.CMB.1.raw
  modified_base (208)..(208): a, c, t, g, unknown or other
  misc_feature (208)..(208): n is a, c, g, or t
  modified_base (246)..(246): a, c, t, g, unknown or other
  misc_feature (246)..(246): n is a, c, g, or t
tcagatagagtactcacgaccggtgctcgatttagtgtgagtagtttgggtttgggtctgagagaggagtccacccctgggatcttcaggttgttttcatttggtgatcgaggacggaacagagagaactcaccatggaggttggctgagcgtggtctttttcgtgtggcttaatttaaaaggtgtccagtgtgacgtgctagttggnggagtcggtggggcacgtggggtacgggccggggggtnactggacgtacttcctcgtggcgccggtcctcgttagggtaattttaaagggttttaggagttcgtaatacggtccctaagtacggaaccggtcgggtacccgccgtaacgggtcctaaccggagggggaacggggtccgtaggtacgggtcggtaccgtcggtacttagttaaggcggtacgtaggttcgggtcggtcgtaacttagtaattacgttaagcggtaccacggtacccgtaccgttagggaaccgggttccgttaacccaaccgttaaccgttaccgaaggtaacgttaaacgaacgtttaacggaaaaccgttaaaccgacggtttaacgttacgtttaacgtacccgttaaaggtaacctaaaacggtggaaacgttaccggttacgtaagggaccgttaaccgaaccgggaacgtaaacccggtaccggtcgttaccgttaagtttaccggttaagttaaacgggtaaacgtacgacgtttaacggaggtaaaccgggtaaccggggacccggtccgtaacgtacgaacccgttacgggtaccgggaccggtaacgggtactccggtaggtaaccccg

SEQ ID NO: 54978 - DNA, 823 bp, Homo sapiens
  misc_feature: GYAE6OF02G1UHS.29.78.H01.1.454.CMB.1.raw
tcagatagagtactcacgaccggtgctcgatttagtgtgagtagtttgggtttgggggcgcctgggtacggccggggggtcgctgagactctcctgtgcggcctctggattaagtttaggagtcagtgccatgaactgggtcccgcgaggctccgaggggaaaggggcgtaggagtgggtcttcgggacctagttagtcggctaggtgggtggcgctatatattacgtgacgacggacgccctaggaagggcccgggttaccgaacctaattttacccaaggaacgtaaccgtaaaccgtttacgaaaacgaacctaacggtccttagtaacttactacggtactaaaacgttgggagtacgtccgtagagtaccgtacgacggtaacctacgggctacgttaagttacgtttaggtaaggtaaacgggtcacggtacttaagggtaacggtaccgggggtaaccccggggacccgtacgttaacggtacccgtaacggttaccggggaccggaaacggggggacctaaccgggtttcgggaccctaaccggtccgtacccgtacgtaccgccccgtttaccgaaaccggtaaccggtaccctacggttaccggttccccgtttaccccgtccggtacccgtacccgttacccgtaaccgaaccgtacggacctaaccggttcggacggggacctacgaacgtcgacgtaccgcggctcgtccgtcggacgtaaccgtaaccttaccgtacgtaccgttactcgtaacggtctacgtacggcgttaccgcggtaccgtaacggccgtagtacggtactgtaac

SEQ ID NO: 54979 - DNA, 752 bp, Homo sapiens
  misc_feature: GYAE6OF02JOC1O.29.78.H01.1.454.CMB.1.raw
  modified_base (220)..(220): a, c, t, g, unknown or other
  misc_feature (220)..(220): n is a, c, g, or t
  modified_base (507)..(507): a, c, t, g, unknown or other
  misc_feature (507)..(507): n is a, c, g, or t
  modified_base (535)..(535): a, c, t, g, unknown or other
  misc_feature (535)..(535): n is a, c, g, or t
  modified_base (549)..(549): a, c, t, g, unknown or other
  misc_feature (549)..(549): n is a, c, g, or t
  modified_base (679)..(679): a, c, t, g, unknown or other
  misc_feature (679)..(679): n is a, c, g, or t
tcagatagagtactcacgaccggtgctcgatttagtgtgagtagtttgggtttggggtccgagccatggtgcagactcccagagctctcctcctcctccactgcacagggtctctctccagcctgtgctgactacactccgccctctcgcctcgtcgccgtccggtagggcgtctcggtcaacggtccactcgtactcgagacgcgaggtcgacacgacncgacggcctaccgtccacgttccgtacgtcggactaacgtcgacgacgacggaccggaacctagggaaccggtacccgggtcctttacggttacttacggacgttacgagaccggtacaaaacttaagtacggtacgacgtacgaacgtccaacggtaccgggagggggaacgggtaccggtacctaccggttacgactttccgggtaccttacacgtacccgttacgtacccgtcggtaccggtcggttcgggactcgacgtctcgtaaccacgtactcggtcccnccgggtaccctgtacggtcagggtacgngtacgggtcgtacncgttacttacggtaacgtccgaagtcgggacgttacgtccgacgtagccgtaaggttccgtaaccgggtcccgggtaaaccgggcggtaaaccgtggttaacccggtagggtcccgaaaccgggttaccnccgggtaaccccgtaacccgtccgtaacccgtttgacccgttacccggttcctaccggttacccccgttccgg

SEQ ID NO: 54980 - DNA, 851 bp, Homo sapiens
  misc_feature: GYAE6OF02HGFF3.29.78.H01.1.454.CMB.1.raw
  modified_base (204)..(204): a, c, t, g, unknown or other
  misc_feature (204)..(204): n is a, c, g, or t
tcagatagagtactcacgaccggtgctcgatttagtgtgagtagtttgggtttgggagcgcctgggtacggccggggggggtcgctgagactctcctgtgcggcctctggatttaagttttaggagtcatgccatgaactgggtccgccaggctccgagggaaggggctggagtgggtctcggctattagtggcagtggtggcnctatatattatgcagacgccctggaacgggccgttcacctatttccagagaacaattcgaagaaacacgtctgtatcgtagacaaagtggagacgtcctagagacgtcgaacgacgaccgggtaccgttctaatttagtttacggtaggtttaaaagggcgtaaggtcgttaagggaaacgtacccggggggaaccccgggggtccccggtaacgtttccggaaaccctaccgggttacgggggggacccgaagggggggtaacccggtcggttacggggtacccgtacccggttacctttaccccgtccgtaccggtaccccttcccgaaccccgggaaaccgggttaccccgtaacggtttccccgggttacccccgttttcccccccggtacgggtacccccttaaccccgttccccgttaacccgaaaaggttccggaccccgtaacccggttccgggtccggggaaccgtaaccgaccggactaccgggtccccgttacggggtccttaccgggtccgttacgggttaaccggtaaaacggtaacctttaccccgttaccgttaccgttaaccttaccgtagtttcgtagggtaccggtacggggtccgtacggggaccctaagggggaccacgtacgtagc

SEQ ID NO: 54981 - DNA, 655 bp, Homo sapiens
  misc_feature: GYAE6OF02HDGU5.29.78.H01.1.454.CMB.1.raw
  modified_base (130)..(130): a, c, t, g, unknown or other
  misc_feature (130)..(130): n is a, c, g, or t
  modified_base (378)..(378): a, c, t, g, unknown or other
  misc_feature (378)..(378): n is a, c, g, or t
tcagatagagtactcacgaccggtgctcgatttagtgtgagtagtttgggtttggggtccgagccatggtgcagactccccagagctctcctcctcctccactgcacagggtctctctcccagccctgtnctgactcaaatccgccctctcgccctctcgccctcccgtgggacgcgtcggtacaacggtcaccgttgtactctgagcagtggacacagcagcctaccgcagtcgacgttggactatcgacgcaaggacggccaagaccgaccgggtcccttacgttactgatcgaacgagtacaacaatgagtggtaccagtacaagaggacggaagggggacgactcccgtgaactccgtcttctcgtactctccngtccgtgtcggctcgacgccgtaacctaccgtacgactaactcccgtacccggtccctaaccgtaggttcgtacgaaggtacgtggacgtcgtaagtacttacgtttcgaccgtacgacgtaccggtcgcgtaccgtggacttagttaccggtacggttccgttaaccgggacccggtaacgtaccggtaccgtaccgtccgggtacgtaccgaccgaacccgtaacccgaccctaacccgtactaccgtccctacgttcccttccgttaacccccc

SEQ ID NO: 54982 - DNA, 716 bp, Homo sapiens
  misc_feature: GYAE6OF02H88O0.29.78.H01.1.454.CMB.1.raw
  modified_base (300)..(300): a, c, t, g, unknown or other
  misc_feature (300)..(300): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctcccagggaaggggctggagtgggtctcggctattagtggcagtggtggcgctatatattatgcagacgccctgaagggtccggttcaccatttccagagaacaattcgaagaacacgctggtatctgacaaatcggagacgcctaganacgtcgaacgaacgacggccgttacttatttacgttgttaggttaaaggcgtaggcgtaggaacggtaccggggaccgggccgtacgtcgaccgtcggtcggggcggtaggggacctcggtacggtccgtaccgtccctctacctacggcccctacccgaacccggtaacggggacccctacggttccggtttaccccgttcccccggtcggtacccctacccttccccgtacccgaaacggacgtacccaacccgttcgggtaccgggggacaccgacggccgaaccggtcccgtgggccgtccggtccggttacggtaccgaacggtaccgttaccttaccgtacgtacctttcaacgttcggaccggtacggccggttcgtacggacggtaccggctaaccgtagtagtcgag

SEQ ID NO: 54983 - DNA, 877 bp, Homo sapiens
  misc_feature: GYAE6OF02JI9K3.29.78.H01.1.454.CMB.1.raw
  modified_base (224)..(224): a, c, t, g, unknown or other
  misc_feature (224)..(224): n is a, c, g, or t
  modified_base (263)..(263): a, c, t, g, unknown or other
  misc_feature (263)..(263): n is a, c, g, or t
  modified_base (859)..(859): a, c, t, g, unknown or other
  misc_feature (859)..(859): n is a, c, g, or t
tcagatagagtactcacgaccggtgctcgatttagtgtgagtagtttgggtttggggtctgagagaggagtccacccctgggatcttcaggtgttttcatttggtgatcaggacggaacagagagaactcaccatggaggtttggctgagcgttggtctttttcgttgtggtcttaacgttttaaaaggtgtaccaggttgtgtacgtgctaggttggtacggnggtcgtgggggcgtcgtggggtacggggtccggggggcncgtgacgcctgtccgtggtcggccggtccttcgtaggtaattttaacggttttaggacgtctaagtcgacctagttacggtaaccggttgggggtacccaccggtagggtcccgtaccgggaagggggaaccggggtcgtaggggtacggttcgggtcgtcggtactaggtttaggtcggacgtagggttcgggtggaccggttataacgtagttagttacggtcgaacgaccggtacccgcccgggttaaggaaccggggtcccgtttaaccgaccgttacgtttacccgaagtaccaaacgttaacgaaacgggtaaaccggacgtacggtacttagtaacgtcggtacgtaacgttaaggaacggggtacacggttactacggtaaccaccggtaaacccgccggttaaccgaacccgggtttacctaaagttttaccgttttaagtttaacgggttaaacgggttaaacggcgttaacgggtacgttaaaccgggggtaaaccgggtaccccggggggtaacccgggtacccttaacgtaccccgggtaacggttacgggggtaccggtacccccgggagggtttacccggnggtttaccgggtaccccc

SEQ ID NO: 54984 - DNA, 664 bp, Homo sapiens
  misc_feature: GYAE6OF02IZYES.29.78.H01.1.454.CMB.1.raw
  modified_base (251)..(251): a, c, t, g, unknown or other
  misc_feature (251)..(251): n is a, c, g, or t
  modified_base (307)..(307): a, c, t, g, unknown or other
  misc_feature (307)..(307): n is a, c, g, or t
  modified_base (376)..(376): a, c, t, g, unknown or other
  misc_feature (376)..(376): n is a, c, g, or t
  modified_base (393)..(393): a, c, t, g, unknown or other
  misc_feature (393)..(393): n is a, c, g, or t
  modified_base (407)..(407): a, c, t, g, unknown or other
  misc_feature (407)..(407): n is a, c, g, or t
  modified_base (419)..(419): a, c, t, g, unknown or other
  misc_feature (419)..(419): n is a, c, g, or t
  modified_base (456)..(456): a, c, t, g, unknown or other
  misc_feature (456)..(456): n is a, c, g, or t
  modified_base (529)..(529): a, c, t, g, unknown or other
  misc_feature (529)..(529): n is a, c, g, or t
  modified_base (534)..(534): a, c, t, g, unknown or other
  misc_feature (534)..(534): n is a, c, g, or t
  modified_base (543)..(543): a, c, t, g, unknown or other
  misc_feature (543)..(543): n is a, c, g, or t
  modified_base (591)..(591): a, c, t, g, unknown or other
  misc_feature (591)..(591): n is a, c, g, or t
tcagatagagtactcacgaccggtgctcgatttagtgtgagtagtttgggtttggggtctgagagaggagtcccaccccctggatcttcaggtgttttcatttggtgatcaggacggaacagagagaactcaccagtggagtttgggctgagcgtgtctttcgtaggtgcttaagtttaaaggtgtaccagtgtcgacgtgcgtagttggtggcgtcggtggggctacgtgggtaccgggtccggggggtntcgtgagcctctcctggtcgccggtcctgttaggaatttaacgttaggacgtgatnctgtacgaacgtcgggcccgactcggactccggaggggaaggtccgtggacggtggtcctcgaaagttntgtcggctagtcgggtnacgtcctaaagttntaccgttaggtnaccgtagaaccgtcccgtagggtaacgtcccgtttanaccgtttaactccgaaggtacgaacgttacgtaacgtaaacgaacgtacacggttatactacttgtaacaagnggaancgactagancgaactacgactcgtacgtacttattacgttagagttaaagcgtaacnccgaaggttacccggcgggtaccggacctacgttaccgacgtcggtacggccggagggtacctcgaggtaccc

SEQ ID NO: 54985 - DNA, 831 bp, Homo sapiens
  misc_feature: GYAE6OF02HHLYU.29.78.H01.1.454.CMB.1.raw
  modified_base (485)..(485): a, c, t, g, unknown or other
  misc_feature (485)..(485): n is a, c, g, or t
tcagatagagtactcacgaccggtgctcgatttagtgtgagtagtttgggtttgggggcgcctgggtacggccgggggggtcgctgagactctccgtgtgcggcctctggattaagttttaggagtcatgccatgaactgggtcgcaggctccgagggagggctggacgtgggtctcggctagttacgtggcagtggtcggcgctatattacgtaatggacagacgccctaggaacgggtccgtcaccgatttccagtacgactaagttacggaacgtaacacgtccgtagtactctaggacaaaacgttggaaacgcggtcctaacggaacgtaacgttacgaaccggaacaaccgggtccgtaccgttaaagtttagttacggtaacgtttaaaaggccggtagtaaccgtggtaaaactaaccgggggaccgggaccccgtaagttcgaacccgtagttacgggggaccaacggggggtacncgttacgggtacctaacccggttctacccggttaacacgggtaccccctttacccgaaaccggtaaccggggtaacccctacggtttacccggtaccccgtttcccccggttaaccgggtaaccctaaaccccgttccgtaacccgtaacgtaccgaaccgttaaccgtaccggtacggggaccctaacgtacggacccgtaacgtcccggtacggtaccgtcgtacccggttacggttaccgtaaacggtaccttacggtacctaagtaacctacgttacgtaccgtaggtaccggtccggggaccgtacggaacggtaccggacgacccgtagtacggtacacg

SEQ ID NO: 54986 - DNA, 799 bp, Homo sapiens
  misc_feature: GYAE6OF02FP7S8.29.78.H01.1.454.CMB.1.raw
tcagatagagtactcacgaccggtgctcgatttagtgtgagtagtttgggtttggggtccgagccatggtgcagactccccagagctctcctcctacctccactgcacagggtctcgtctccagcctgtgctgactcaactcgcctctgcctctacgccctccgtgggagccgtcggtacaaggtccactgtactcgtagagctaggtcgacacgtagcaggtacctacgccagtcggcttggacagtcagacgtaggacggccaggaccggtacgggaccccttaggtttactacggagtcgtaacgaggtaaccaacgaacgttagacgtacggtcgaacgttacgaacgtacggacggtaaacggggggaccgttacttccccggtaggtactttaccccggtctttccgacgttaccgggttacccgacgtacggtttcccgtaccgggttcggggaacccgtttaggaacccggtacccttaaccgtttaaaccgtaccgtaaaccgtaacccgttcccggttacccgggaccccgttttacgaaccggtttccggtaacggtagggttaaaccgtgggtaaactcgggtttaactacggttaacttcgtacggttacggtaccgccggtcgggtaccacggtcgtacggttaacgttcgggtaccgtccggttaaccgggaaccggtaccgtaccggttccgacccggttacgggtccaccggaacccgtaaccggacccgtacccgacccgttacgcccggttaacctacccgttcccgttcctaacccccg

SEQ ID NO: 54987 - DNA, 689 bp, Homo sapiens
  misc_feature: GYAE6OF02HK3XT.29.78.H01.1.454.CMB.1.raw
  modified_base (352)..(352): a, c, t, g, unknown or other
  misc_feature (352)..(352): n is a, c, g, or t
  modified_base (513)..(513): a, c, t, g, unknown or other
  misc_feature (513)..(513): n is a, c, g, or t
  modified_base (538)..(538): a, c, t, g, unknown or other
  misc_feature (538)..(538): n is a, c, g, or t
  modified_base (598)..(598): a, c, t, g, unknown or other
  misc_feature (598)..(598): n is a, c, g, or t
  modified_base (603)..(603): a, c, t, g, unknown or other
  misc_feature (603)..(603): n is a, c, g, or t
tcagatagagtactcacgaccggtgctcgatttagtgtgagtagtttgggtttggggggagagaggagtccacccctgggatcttcaggtgttttcatttggtgatcaggacggaacagagagaactcaccatggagtttgggctgagctggtctttttcttgtggcttaattttaaaaggtgtccagtgtgacgtgcagttggtggagtcgtgggggcgccgtggggtacgggccgggggggtcgcgtgagcctctcctgtcgcggcctgtggatttaagtttaggagtcagtgaccagtgaacgtgggtccgccgaggcctccgaggggaagggtcgtggaggtgggtcncggtacttagtttaggtggcgtaggtgggtcggcgtacttaagtattagttaatgacgacggaccggtacccgtagggtaaaaccggggtcccggttaacctaaccgttaacttttccgaacgtaacgaaccgtaatttaccggaaaccgaacaaccggtntacgttaatctacggaataaacggnggacgacgtcgagagcctaggaccgacgtccgcgttcttaagttctttagacgttaaggngagtntaggacgtaccggggaccgggccgtaccgttcggaacctcggtccggggtacggacccggggtgccggtacggtccgcccgttacc

SEQ ID NO: 54988 - DNA, 682 bp, Homo sapiens
  misc_feature: GYAE6OF02G1GO7.29.78.H01.1.454.CMB.1.raw
  modified_base (458)..(458): a, c, t, g, unknown or other
  misc_feature (458)..(458): n is a, c, g, or t
  modified_base (678)..(678): a, c, t, g, unknown or other
  misc_feature (678)..(678): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtggcagtgggtggcgctatatattatgcagacgccctgaagggccggttcacctatttccagagacaattcgaagacacgctgtatctgacaagtggagagcctgagactcgacgacaccggctactattattagtaggttaaggcgagctaggaagtaccggggaccggggacccgacttcgaccacgtcgggggccaggggaccgcgtggtcaccgtccgtcctcgacgtccctacccaccgacggcccagtccggttcccttccccgnggccctaccctcccgtacaacgacgaccaccgtcggtacgggggccaaccgtacgaccgtaccgtacccgtcggggaccttcggaccccggttgggttacccgaaacgggtaaccctttacccgtacccgtaggttacccttacgttaaccggtcttaccgggtaccgggaccggggtcccgttagggaacccggtaacggggcctacggaacgttaggntacg

SEQ ID NO: 54989 - DNA, 834 bp, Homo sapiens
  misc_feature: GYAE6OF02GQH9A.29.78.H01.1.454.CMB.1.raw
  modified_base (195)..(195): a, c, t, g, unknown or other
  misc_feature (195)..(195): n is a, c, g, or t
  modified_base (268)..(268): a, c, t, g, unknown or other
  misc_feature (268)..(268): n is a, c, g, or t
tcagatagagtactcacgaccggtgctcgatttagtgtgagtagtttgggtttgggggcgcctgggtacggccgggggggtcgctgagactctcctggtgccggcctctggattaagtttaggagtcatgccatgaactgggtcccgccaggctccgagggaagggctggaggtgggtctcggctattagtggcngtggtgcgctatatatatgcagcgccgtagacgggtccgttcacctattaccagagactaagttcgaagaacncgacttgtatctagacaaagtggaagacgcctagacgtaccgtcggaccaacgtccggaccgtacttagttacgttggttaaacggttaaagggcgtaacggtacgtagggtaaaccggtacccgggggtaccccgggtacccgtaccgttaaccggacccgtacggttaccggggggaccggtaacgggggcccgtacggtttccgggtaaccctaccccgggtttacccctacccgttaccccggaacgtccccctaaccccggaacccggaaaccggggaccccttaaccggtccccgggtttacccccgttccccccggtaggtacccctaaccccgttaccccgtaaccccgaaaggtacccgacccggttacccgtacgggttaccggggaacccaacgtacgacccggaaccgtcccggacgggtaccgtccggttcccggtaacggtaccgtaaacgggtacccttacgtacccgtaaggtttaccctaccgttacgtcggaccgtacggggtcccgtcggtaacggaccgtaccgggacgtaccgtagtacgcgtag

SEQ ID NO: 54990 - DNA, 833 bp, Homo sapiens
  misc_feature: GYAE6OF02H6CN7.29.78.H01.1.454.CMB.1.raw
tcagatagagtactcacgaccggtgctcgatttagtgtgagtagtttgggtttggggcgcctgggtacggccggggggtcgctgagactctcctgtgcggcctctggattaagtttaggagtcatgccatgaactgggtccgccaggctccagggaagggctggagtggtctcggctattacgtggcagtggtggcgtctatatattatgcagacgccctagaacgggtccggttcaccgtatttccgagagacctaaagttcgaataacgacgtctagtactctgacaaattcggacgacgccgtaggacgtaccgttcgacgtaaccgaccggcccggtttactagttttaacgttggttaacggtttaaacggccgtacgtaccgttaagggaaaccgtaccgggggaacccggggtccccgtaaacggttcggtaaccccgacggttaccggggggacccgtaaggggggtacccgtcgttacggggttccctaacccggttcctaccccggttaccgaccggtacccccgttaccccgaacccggaacccggggaccccgtaaacccggttcccgggttaccccttttaccccccgggtacggtacccctacccccgttaccgttaccccgaaacggtaccgtacccgtacccgttaaccgggtcgggtaccgaacgtcgaaacctccggtacccgtacggtccgtccggtacccgtacggttacgaaacggtacccgtttacgtacccgtacggttacctcgtttaccgtagttaccgcggtaccgggtcaacggtacgtaccgggtcaccgtaacggtgtagtacg

SEQ ID NO: 54991 - DNA, 1002 bp, Homo sapiens
  misc_feature: GYAE6OF02F2SYS.29.78.H01.1.454.CMB.1.raw
  modified_base (183)..(183): a, c, t, g, unknown or other
  misc_feature (183)..(183): n is a, c, g, or t
  modified_base (252)..(252): a, c, t, g, unknown or other
  misc_feature (252)..(252): n is a, c, g, or t
tcagatagagtactcacgaccggtgctcgatttagtgtgagtagtttgggttggggggaagaggaagactgacggtccacccctgggatcttcaggtgtttcatttggtgatcaggacggaacagagagaacctcaccatggagtttggctgagctgctttttctgtggctaattttaaaggngtccagtgtcgacgtgcagttggtggagtcgtgggggactccgtggggtaccgggccggggggggttcncgtaggacggtactctccgtgtggccggcctcgtaggtaatttaaaggttttaggacgttacagttcggaccctagttacgtaaaccgttcgggggttaccccggaccgtacgggtaccccgtaccgggaacgggggaaacgggggggtaccgtaggggtaacgggttacggggggtttccgttccggggtaccgtttaaggtttaaccggggttgggtaccgtaacgggttggggttcggggtaccggtaccttttaaagttaacgtttaaagttttacgttacgtaccgttaaccgggaaacccggttcccccggttacggggaaaaccggggggttcccccggggtttaaccctaaacccccgtttaacccggtttttaacccgaaacgggttaaaccggtaaacccgtttaaaaccgttttaacggggaaaaccggtaaacccgttaaacccgggtaaccgtttacggttaaacgtttacccgttaacgggacccgttaaaaagggttacccgggtaaaggtcccgggttaaaccgtaacggtaccgtaacccgggttaaccggaaaccggtacccggtaacccgggtaacccggttacgtttaacggtttacgttaacgggttaaacggttaaacggggtacggtacggttaccggtaagggaaccggttaaccggggacccggggtacctaccggtacgacccgtacgtccggggaccgaccggggacaccgtccggtacccgg

SEQ ID NO: 54992 - DNA, 720 bp, Homo sapiens
  misc_feature: GYAE6OF02F5333.29.78.H01.1.454.CMB.1.raw
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaagggctggagtgggtctcggctattagtgcagtggtggcgctatatattatgcagacgcctggaagggccggttcacctatttaccagagacaattacgaagaacacgctagtatctgacaaagtggagacgcctgagacctacggacgacaccggccgtcttattagttggtagttaaacggcgtagcgtaggaacgtaccggggaaccggggcccgacgttcgaccgtacggtcggggaccggtaggggaccgtcgtacggtaccgacccgttccgtaccctccgacgtccccgtacccgaaccgaacgggtcccctacgttcccggttcccttcccccgtacggcccctaccccgtaccctacccgtaacgaccgtacccgttacccgtcggttacggggacccaacgtaccgacgaccgtcccggtcggccgtcggtacccgtcggtaaccgaacggttaccttaccgttaaccgaccgttaccgtaaccgttacgttccgtacggacgggccggtcgtaacgggaccgtacgggacgtacgtacgtacgtgtaacg

SEQ ID NO: 54993 - DNA, 832 bp, Homo sapiens
  misc_feature: GYAE6OF02HLISP.29.78.H01.1.454.CMB.1.raw
  modified_base (142)..(142): a, c, t, g, unknown or other
  misc_feature (142)..(142): n is a, c, g, or t
tcagatagagtactcacgaccggtgctcgatttagtgtgagtagtttgggtttggggcgcctgggtacggccggggggtcgctgagactctcctgtgcggcctcgtggattaagtttaggagtcatgccatgaactggtccnccaggctccagggagggctggagtgggtctcgctattagtgcagtgtggcgctatactattatcgcaggacccgcccgtggaacgggtcccggtttcaacctatttcccaggagaccaagttccgaaagtaaccacgtcgtagtactctacgaactaaagtcgggtagacgtaccgtaggtacgacgttaccgtaaccggaaccgtaacccggggtacccgttcgttttaaattttaggtttacggtttacggttaaaaccgggccggaaaggttcccgttaagggaaaccggtaaccgggggtaccccgggaccccggttagtttaccgaccggtcggtacggggccggtacggggacgtccgtaggccctacccggtctcccgtacgccgtaaccgtcccgaacccggaacggtccctaacgggtttccccgttaccccgtttccccccggtacgggaccccttaaccccgttcccgttaacccgaaccggtaccgaacccgttacccgttcggggtcccggggtaccaccgtaccggacgtacccggcccggttacgggcctccggtccgttacggtaccggtaaacggttacccgttacccgttacgtaccgtacgttaccttacgtcctacgggtcgggtccgttccggtacggtaccggtacgtaccgagtaacgtccgatcgg

SEQ ID NO: 54994 - DNA, 898 bp, Homo sapiens
  misc_feature: GYAE6OF02GVR67.29.78.H01.1.454.CMB.1.raw
tcagatagagtactcacgaccggtgctcgatttagtgtgagtagtttgggtttgggggcgcctgggtacggccggggggtcgctgagactctcctgtgcggcctctggattaagttttaggagtcatgccatgaactgggtccgcaggctccagggaagggctggagtgggtctcggctattagtggcagtggtggcgctatatattatgctagaccgccctaggaacgggtccggttacaccgtacttttcccgaaggtagaacctaagtttaccggaaagaaccacgcgttagtactcgtagaacgtaaagtagggaagtaccgtccgtagacgtaccgtacggaaccgaaccggtacccggtacccgtttaacgttaagtttacggtttacggttaaacgggttaaacgggacgtaacggtacggttaacgggtaaaccggtacccggggggaccccggggtacccctacggttaccgacccggtacgggtacgggggacccgggaacggggtccgttaccggtaccggtaccgtaacccggttcctaccccgttaccgtaccgtaccccgtaacccgaacccgggtaaccggtaccccgttaaccggttccccggtttacccccgtttacccccggtaccggtacccccgtaaccccgttacccgtaacccgtaaccgacccggtaacccgtacccggttaccggggtacgggtacccaccggtaacggacccgtccgggtacccgtacggtccgttaccggtacccggttaccggtaaccgtaaccggtaccgttaacccgttacccgtaacgttacccttaacgttacgtcccgtaggtaccggtcggtaaccgtcgggaacccggtacggaccgtacgtaacgtccgagtc

SEQ ID NO: 54995 - DNA, 850 bp, Homo sapiens
  misc_feature: GYAE6OF02JWH8B.29.78.H01.1.454.CMB.1.raw
  modified_base (304)..(304): a, c, t, g, unknown or other
  misc_feature (304)..(304): n is a, c, g, or t
  modified_base (312)..(312): a, c, t, g, unknown or other
  misc_feature (312)..(312): n is a, c, g, or t
  modified_base (762)..(762): a, c, t, g, unknown or other
  misc_feature (762)..(762): n is a, c, g, or t
tcagatagagtactcacgaccggtgctcgatttagtgtgagtagtttgggtttgggggcgcctgggtacggccgggggggtcgctgagactctcctgtgcggcctctggatttaaagttttaggagtcatgccatgaactgggtcccgccaggctccgaggggaaggggctgggagtgggtctcggctattaggtggcaggtggtggcgctaatatattatgcacgaccgcccgtaggaacggggcccgttacacctactttacagacgacaacgttacgaaagaacgacgcttatagttctanactaacgnggtacgacgacctggtagcctaccgacggtaacgaccggtcccggtacttactttagttagttacggttaaaaggtcggacgtacgttagggaaccggtaacccgggggtccccgggggtccggtaaccgtcgtaacgacccggtcgggggtaacccgagggggtacgtccgtagggtccccgtaccgttacgtcccttacgaccgccccgttacccgaccgggtaaccggaccccgtaccggttcccggtttaccccggttcccccgtccccgggtacccctacccccttacccgtaacccgtaccgaaccgtaccgtccccggtaccgggtacggggtacccgaacccgtacgtccccgggaaccggccccggttaccggggttcccgccggttacccggttacgggttacccgaaacgggttccccgttaaccgttaaccccggttnttaaccccgtcttttaccggtccggttacggaccgggttcccggggacggtacggtaccgggaccggttaccgtaagagttccgagcg

SEQ ID NO: 54996 - DNA, 704 bp, Homo sapiens
  misc_feature: GYAE6OF02IWB8O.29.78.H01.1.454.CMB.1.raw
  modified_base (397)..(397): a, c, t, g, unknown or other
  misc_feature (397)..(397): n is a, c, g, or t
  modified_base (678)..(678): a, c, t, g, unknown or other
  misc_feature (678)..(678): n is a, c, g, or t
  modified_base (703)..(703): a, c, t, g, unknown or other
  misc_feature (703)..(703): n is a, c, g, or t
tcagatagagtactcacgaccggtgctcgatttagtgtgagtagtttgggtttgggggcgcctgggtacggccgggggggtcgctgagactctcctgtgcggcctcgtggattaagtttaggagtcatgccatgaactgggtccgccaggctccgagggaagggctggagtgggtctcggcttagttagtggcaggtggtggcgctataatattatgatagaccgccctaggaagggtcccggttacacctattttccgagtacgaacaactttcggaaacgtaaccaacggtccttagttaacttcgttagaccgtaaagttagggagaaccggtcgtacgacgtaccgtacgaccggacaccggtccgtcttagtttattggttagttaaacggngaggtcgtaaggtaaccggaccggggaccggcccgtacgttccggaccacggtcgggaccgaggggaccgtcgtcggtactaccgtcctacgcgaccgtccgcccgtaaccgaccgggacctcgtccgttaccgtccccgtcggtccctcccgtccgtacccgaccgacgacctaccgtcggtacgggcaccgacgaccgtccgacgtcgcgtccgcgtcgacgtaacgtactaccttccgacgttacctacgtactcggtcggtacggtaccggtaccgnggaccgaggtccgacgtaggacgtnc

SEQ ID NO: 54997 - DNA, 726 bp, Homo sapiens
  misc_feature: GYAE6OF02IX93K.29.78.H01.1.454.CMB.1.raw
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccgagggaaggggctggagtgggtctcggctattagtggcagtggtggcgctatatattatgcagacgccctggaagggccggttcacctatttccagagaccaattacgaagaaccacgctagtactctagacaaagtggaagacgcctagacgactcggaaccgacgacggtccgtactattatggttagttaaaggcgagcgtaggaacgtaccggggacccgggacccgtacgttcgaacccgacgtacgggggaccgaagggggaccgtcgtcggtacctacccggttcctaccctcgacgtccccgtaccccgaacccggtaacgggcccgtaccgttcccggttcccctttaccccccgtcggtacccctaccccgtacccgtaccgaaccgcgtacccacccgttcggacgggggaccacgtaccgaccgaccggtacccgtcgggtacctcgtccgttacgggtacgaaacggtaccttaaccgttacctacgttaccgttacgtacgtcgttacggtacggtcggtacggtcggaccgacgggtaccgtacacggtacgcgtac

SEQ ID NO: 54998 - DNA, 688 bp, Homo sapiens
  misc_feature: GYAE6OF02F1HGI.29.78.H01.1.454.CMB.1.raw
  modified_base (235)..(235): a, c, t, g, unknown or other
  misc_feature (235)..(235): n is a, c, g, or t
  modified_base (460)..(460): a, c, t, g, unknown or other
  misc_feature (460)..(460): n is a, c, g, or t
  modified_base (686)..(686): a, c, t, g, unknown or other
  misc_feature (686)..(686): n is a, c, g, or t
tcagatagagtactcacgaccggtgctcgatttagtgtgagtagtttgggtttgggagcgcctgggtacggccggggggtcgctgagactctcctgtgcgcctctggattaagttttaggagtcatgccatgaactgggtccgccaggctccagggaagggctggagtgggtctcggctattagtggcagtggtggcgctatatattatgcagacgccctggaagggcccggttnaccatttccagagaacaattcgaagaacacgctgtactcgtgactaaagtggtagacgcctagacgactcgaacggacaccgggtccttacgtatttagttagtaggtaaaacggtcgtaagtcgttaggtaaacgtaccggggtacccggggccctaacgttcggaaccctacggtagggggacccgagggggaaccgtccgtacgggtccaacccgttctccncggacgtccctaccgaaccgaacgggccctacggtccgttaccccttccccgtcggccctaccccgtcccgtaccgacgacgccgtaccgttcggccggggacctacgacggccgtacgacccgtcggtccgtcgtccgtgtaaccacggtacccttacgtcctacgttaccctagtcctacgttacggacgtccggagtcggaccggaaggccgacgtacggtancg

SEQ ID NO: 54999 - DNA, 647 bp, Homo sapiens
  misc_feature: GYAE6OF02GI830.29.78.H01.1.454.CMB.1.raw
  modified_base (279)..(279): a, c, t, g, unknown or other
  misc_feature (279)..(279): n is a, c, g, or t
tcagatagagtactcacgaccggtgctcgatttagtgtgagtagtttgggtttggagtctgcaccatggctcggaccccactcctcttcctcaccctcctcctccactgcacagggtctctctcccagcctgtgctgactcaatcgccctctgcctctcgcctcccgtgggaggctcggtcaaggtcacctgtactctgagcagtggacacagcagctacgccagtcgcttggcatcagcagacggccagaccgaccgggccttcgttactgactcganacgtacaacagtgagtcggcacgtcaacgaggacgggaacggggacgacgtcccgtgtactcgtcgttaccgtcgtacgttccgtccacgtcgtacggtcgggtaccgtacgacgtcctaccgtacccttactaaccgtacctcccggtcccgggtaccctaccggtcgttaccgtgggtacggtaatccgggagtaccgttaagtacctttactcgttacgaccgtacggtaccgggagtaccgtacgtcgttaactcgttacgtcggttaccggtaccgggtacggaaccgtacggtacgtccggtacggtccgacaccggcccgaaccgtaccgacccgtacgtcgaccttccgacgttccccgg

SEQ ID NO: 55000 - DNA, 970 bp, Homo sapiens
  misc_feature: GYAE6OF02IQSAT.29.78.H01.1.454.CMB.1.raw
tcagatagagtactcacgaccggtgctcgatttagtgtgagtagtttgggtttgggggcgcctgggtacggccggggggggtcgctgagactctcctgtgcggcctctggattaagttttaggagtcatgccatgaactgggtccgccaggctccgaggggaaggggctggaggtggtctcggactattagtggcaggtggtggcgctatatattatgcacgaccgccctagggaacggggtccggttcacctactttaccagtaacgaactaattacggaaagaacacgctacgtattcgtcgaacgtaaacgtgggaagacgcctggaacgacgtaccggaaccgaaccgaccggtcccgttacttaagtttagtttaggtttaaggttaaaacgggtacggtaacggtccggttaagggaaacgggttacccggggggaccccggggtaccccgtacgttaccgaccggtaccggtaccggggggaccgtaaccggggggaccgtacggttaccggtacccgtaacccggttccctaccccgtacccgtaaccgggtccccccgtaacccgaaccccggtaaccggggtccccctaaccggtttaccccgggtttacccccgttttacccccccggtaccgggtaccccctaaacccccgtttccccgtaaacccgtaaaccggtacccggtaccgtaccccggtttccggggtacgggggaccccaaacggtacccggaccgtaccccgggtacccgggttaccgggtacccgttacccgggttaccgggttacggtaaaccccgggtaaaccgggttacctttaaaccccggttacccgtaaacccgggttttaccttacccgttacgttacccgggttaaacgggcccggggttaacccggtcccgggttacgggaaccggttaaccccgggtaacgtacccggtaagttacccggtgtaccgg

SEQ ID NO: 55001 - DNA, 748 bp, Homo sapiens
  misc_feature: GYAE6OF02HQZBR.29.78.H01.1.454.CMB.1.raw
  modified_base (316)..(316): a, c, t, g, unknown or other
  misc_feature (316)..(316): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgccaggctccagggaaggggctggagtgggtctcggctattagtgcagtggtggcgctatatattatgcagaccgccctaggaacgggtccgttcacctatttccagacgaacaattcgaaagaacacgctgtaactcgtgacaaagtggagagccgtgagactcgacgtanaccggccgtacttattagttagttaggttaaaggcgagtcgtaagggaacgttaaccgggggacccgggtaccccgacgtttacggacctaacggtcggggtaccgagggggtacgcgtcggtaccgtaccgtcctccgtacacgtccctaccgtaaccgaacggggaccctacggtccggttaccccgtttacccccgtcggtccctacccgtacccgtacccgaacgacggccttacccggtccggccgggggtaaccaaccgacggtaccgaccggtacccggtacgggtccgtggtcccgttacgggttaacccgaaacggttcccgttaacccgttaccgtaacgttacccttactttaacgtacgtcggtacgggtaccgggtaccggtaggaaccggtacggaaccgtacgtacgtacgcgaagg

SEQ ID NO: 55002 - DNA, 764 bp, Homo sapiens
  misc_feature: GYAE6OF02FY3C7.29.78.H01.1.454.CMB.1.raw
  modified_base (211)..(211): a, c, t, g, unknown or other
  misc_feature (211)..(211): n is a, c, g, or t
  modified_base (261)..(261): a, c, t, g, unknown or other
  misc_feature (261)..(261): n is a, c, g, or t
  modified_base (276)..(276): a, c, t, g, unknown or other
  misc_feature (276)..(276): n is a, c, g, or t
tcagatagagtactcacgaccggtgctcgatttagtgtgagtagtttgggtttgggggcgcctgggtacggccgggggggtcgctgagactctcctgtgcggcctctggattaagtttaggagtcatgccatgaactgggtccgccaggctccgagggaagggctggaggtgggtctcggctattagtggcagtggtggcgctatatattntgcagaccgccctgaacgggtccgttcacctattccagagacaatcgaanaacacgctgtatctnaccaaatggagagcctgagacctcgacgacgacggtcccgtatattattggtagttaaacggccgaggctaggaaacgtacgggggaccccggggacccgacgttagacccgacggtcggggggacccaggggggacccgccgtttagggtcccacccgggttacctcccgtaccgaccgtcccttacccgaaccggaaccggccccgacggtcccggtttccccttcccccggttcgggcccctaaccccctacccgttacccaaacggaccgtacccgtaacccgttccggttaccggggggccaacggtaccgccgaccgggtaccccggttcgggtacccgttcgtcccggttacggtaccggtaaaccggttaaccgttaaccgtttcccgtaaggtttaccttaccgttacttccggtacggtacgggcccggggttacggtccgggtaacggaccgggtccgaccggtaagtacggcctag

SEQ ID NO: 55003 - DNA, 813 bp, Homo sapiens
  misc_feature: GYAE6OF02FHA33.29.78.H01.1.454.CMB.1.raw
  modified_base (195)..(195): a, c, t, g, unknown or other
  misc_feature (195)..(195): n is a, c, g, or t
  modified_base (212)..(212): a, c, t, g, unknown or other
  misc_feature (212)..(212): n is a, c, g, or t
  modified_base (252)..(252): a, c, t, g, unknown or other
  misc_feature (252)..(252): n is a, c, g, or t
  modified_base (336)..(336): a, c, t, g, unknown or other
  misc_feature (336)..(336): n is a, c, g, or t
  modified_base (559)..(559): a, c, t, g, unknown or other
  misc_feature (559)..(559): n is a, c, g, or t
tcagatagagtactcacgaccggtgctcgatttagtgtgagtagtttgggtttggggtctgagagaggagtccaccctgggatcttcaggtgttttcatttggtgatcaggacggaacagagagactcaccatggagtttggctgagcgtggttcttttcttggtcggtacttaagtttaaaggtgtaccagtgngtacgtgcgtagttggnggtagtcgtggggctccggtgggtacgggtccgggggtancgtgtacgactcgttccgtgtcggacgtccgtcgtacggtaatttaaggttgtaacgtcgtatcggacctaagtccggttaacnccgggtccgaccgtaggtcccgtacggaacggggtaacgggtcgttaggacgggttacggttaccgtaccggtacgttaacggttaaggtccgtaagtacggggtcggtaccgggctaacgttaagtactttaggttaacgcgtaactaacgcccgtacgtacggtagggtccctttacgaccttaggtaccacggagtaaccgtactaacggtaacgtaaanaccgttcttagtacgttacgactaacgaacgtacgtacggcgttaaccggtagtaccggtacggaccgtaaccggtaaccggaacccggttccgttacggttaacgtttaaccgggtttacgttaaacggtacggttacggtacgttaccggttaagggtaccgggtaccggggtaacccgggtaccgtaaccggtttaccggacccggtacggtcgggtacccgggtacggacgttaccggcggttaacccgg

SEQ ID NO: 55004 - DNA, 746 bp, Homo sapiens
  misc_feature: GYAE6OF02IGFL5.29.78.H01.1.454.CMB.1.raw
  modified_base (255)..(255): a, c, t, g, unknown or other
  misc_feature (255)..(255): n is a, c, g, or t
  modified_base (743)..(743): a, c, t, g, unknown or other
  misc_feature (743)..(743): n is a, c, g, or t
tcagatagagtactcacgaccggtgctcgatttagtgtgagtagtttgggtttgggagcgcctgggtacggccgggggggtcgctgagactctcctgtgcggcctctggattaagtttaggagtcatgccatgaacgtgggtccgaccaggctccgagggaagggctggagtgggtctcggctattagtggcaggtggtggcgctatagtattatgcagaccgcctaggaagggtccgttcacctagttccaganaactaatgaacgaacacgactgtatcagactaaagtggaagagcctgaacgtcctacggacgaccgtcgccgttagttagttagttacggtaagtaaggcgacgtgtaaggaacgttacccggggaccggtaccctagtacggaaccctacgggtcggggtcccggaaggggacccgtcgttacgggtacccgtaaccccggttccttacccgtacgtaccggacccctaacccggaacccggtaacccgggtaccccgtaacgttccccggttaaccccgtccccccgttaccggacccttacccccgtacccgttaacccggaaaccgacgtaacccgtacccgggttaccggtacccgggggaccacggaccgaccgacccggtcccgtacgggcccgtcggtaccgtcggtacgaacgtacccgttactacgtacgtacctacgtctcgtaggacgcggtacgacggacgtacggcacgtacgngtc

SEQ ID NO: 55005 - DNA, 780 bp, Homo sapiens
  misc_feature: GYAE6OF02IJLSL.29.78.H01.1.454.CMB.1.raw
tcagatagagtactcacgaccggtgctcgatttagtgtgagtagtttgggtttgggggcgcctgggtacggccgggggggtcgctgagactctcctgtgcggcctctggatttaagttttaggagtcatgccatgaactgggtccgccgaggctccgaggggaaggggctggaggtgggtcgtcggcttagttaggtggcgaggtgggtggcgcttatattatttatgcacggaccgccgtagggaacggggtccggtttacacccgttattttacccgaggaacgaactaaacgtttaccggaaagaaaccaccggacttagttaacgttcgtacggaactaaaggtacggaggacgtccgtagaacgacctacggaccgacgaccggccgtacttaagttattaggtagttaacggcgagtacgtaggaacgtacggggacccgggaccgtacttacgaccgtacggtcggggacggacggggacgtcggtaggtaccgtccgtacctaccgtacgtaccgcccgttacccaacccggacggtacccgtacgtacccggttccccttccccgtacggcccgtaccctcccgtaccaacgtaccgacctcccgttaccgggacgggacctaccgacgaccgtacggcccggttcggacctcggtacccggtcggtaaccgaaacgtaccttaaccgttcgtaacgttaccgtacgttaaccgtggtacggaccgggtcggtaccggtacggcggaaaccggtccgaaggtacgtcgagc

SEQ ID NO: 55006 - DNA, 603 bp, Homo sapiens
  misc_feature: GYAE6OF02H0ZES.29.78.H01.1.454.CMB.1.raw
  modified_base (185)..(185): a, c, t, g, unknown or other
  misc_feature (185)..(185): n is a, c, g, or t
  modified_base (189)..(190): a, c, t, g, unknown or other
  misc_feature (189)..(190): n is a, c, g, or t
  modified_base (193)..(193): a, c, t, g, unknown or other
  misc_feature (193)..(193): n is a, c, g, or t
  modified_base (206)..(206): a, c, t, g, unknown or other
  misc_feature (206)..(206): n is a, c, g, or t
  modified_base (210)..(210): a, c, t, g, unknown or other
  misc_feature (210)..(210): n is a, c, g, or t
  modified_base (213)..(213): a, c, t, g, unknown or other
  misc_feature (213)..(213): n is a, c, g, or t
  modified_base (223)..(223): a, c, t, g, unknown or other
  misc_feature (223)..(223): n is a, c, g, or t
  modified_base (230)..(230): a, c, t, g, unknown or other
  misc_feature (230)..(230): n is a, c, g, or t
  modified_base (232)..(232): a, c, t, g, unknown or other
  misc_feature (232)..(232): n is a, c, g, or t
  modified_base (250)..(250): a, c, t, g, unknown or other
  misc_feature (250)..(250): n is a, c, g, or t
  modified_base (257)..(257): a, c, t, g, unknown or other
  misc_feature (257)..(257): n is a, c, g, or t
  modified_base (263)..(263): a, c, t, g, unknown or other
  misc_feature (263)..(263): n is a, c, g, or t
  modified_base (288)..(288): a, c, t, g, unknown or other
  misc_feature (288)..(288): n is a, c, g, or t
  modified_base (292)..(292): a, c, t, g, unknown or other
  misc_feature (292)..(292): n is a, c, g, or t
  modified_base (298)..(298): a, c, t, g, unknown or other
  misc_feature (298)..(298): n is a, c, g, or t
  modified_base (320)..(320): a, c, t, g, unknown or other
  misc_feature (320)..(320): n is a, c, g, or t
  modified_base (353)..(353): a, c, t, g, unknown or other
  misc_feature (353)..(353): n is a, c, g, or t
  modified_base (367)..(367): a, c, t, g, unknown or other
  misc_feature (367)..(367): n is a, c, g, or t
  modified_base (408)..(408): a, c, t, g, unknown or other
  misc_feature (408)..(408): n is a, c, g, or t
  modified_base (436)..(436): a, c, t, g, unknown or other
  misc_feature (436)..(436): n is a, c, g, or t
tcagatagagtactcacgaccggtgctcgatttagtgtgagtagtttgggtttgggggtctgagagaggagtcccaccctgggatcttcgaggttgttttcatttggtgatcaggacggaacagagagaactcaccatggtagtttgggctggagcggtgtcgttacgaggcgactaagttaagntcgnngtnacgtgatgtgcgntcgnggntcgaggcggngggtcanangatgctatcgacgtatgngtacgtntaggancagtcacgagtaccgagtaggcacncggngtacgnggtaacgtgaggtacgtaacgngtcgaatagttacggatcgagttgacggtatanacgtattcggaacncacgtacggtctaacgtagcgttactacgtaattaccgaanacgtacgtaatacgacgtaactcgaagntatacgtagactacgtaagtcgataccgtatagacgaacgtacgaacgacggtacctagtacttagtattgtaaacggtcgtagtacgacgttaaccggtacgggtacggaaccgttacggaacgtaccgaggtacggtcaacgggactcggttaccgagtaacccg

SEQ ID NO: 55007 - DNA, 767 bp, Homo sapiens
  misc_feature: GYAE6OF02I8X1K.29.78.H01.1.454.CMB.1.raw
tcagatagagtactcacgaccggtgctcgatttagtgtgagtagtttgggtttgggggcgcctgggtacggccgggggggtcgctgagactctcctgtgcggcctctggattaagtttaggagtcatgccatgaactgggtccgccaggctccgagggaagggctggagtgggtctcggctagttagtggcagtggtggcgctatatattatgcagacgcccgtggaacgggtccggttcacctatttccagagacaagttacgaaagaaccacgtctagtactcgtagacgaaaagtggagacgcctgacgactcgacgacgaccggcgtctattattgtaggttaaggcgacggaccggaaagtaccgggggacccgggtacccggtacgttaccgaccgtacggtcggggacccgacgggggaccgccgtcggggtacctacccggttcctcccggtacgccgtccccgtacccaacccggaaccggccccgtacgttacccgggttaccccgtttccccccgtcgggacccctaccccgttaccccgtacccgaacgtacccgcccgtacccggttccggtacggggactaccggacgaccgacccggtcccggtcgggtccgtccggtcccgtaggtacccggtaacgtaaccttaccgtttacccgtaacgtacctttaccgtccgttaccgtacggtaaggtcccggggtcgtccgggtaaccgaaccgggtacgtacggttaccgacggtacgtccgag

SEQ ID NO: 55008 - DNA, 783 bp, Homo sapiens
  misc_feature: GYAE6OF02GJRPB.29.78.H01.1.454.CMB.1.raw
  modified_base (768)..(768): a, c, t, g, unknown or other
  misc_feature (768)..(768): n is a, c, g, or t
tcagatagagtactcacgaccggtgctcgatttagtgtgagtagtttgggtttggggtctgagagaggagtccacccctgggatcttcaggtgttttcatttggtgatcaggacggaacagagagaactcacatggagtttgggctgagctggtctttttcttgtggcttaagtttttaaaaggtgtccagtgtgacgtgcagttgggtggagtcgtggggggcgccgttgggggtacgggccggggggggtccgttgacgactctcctggtgccggtcctcgtggtaagtttaggttttaggagtctagtcgccatgtaacgtcgggtacccgcgacggtcctaccggaaggggaacgggggtccgtagggggtacggttcgggggtccggtccgggtactttaacggtttacggtgggccgtagggttcggggtcggtccgtacttagtagttattagtcggactaggaaccccgccggtagggaacgggtcccggttaaccaacccgttactttacccgaaggaacgttaaccgtaacgtttaaccggaaaaggaaacccgtaccgacgttacgttactacgtacgtaaccgtaaaaggtacggtacgacgtaccgtgaacgttaccgtacggaccgaaccggccggtaccttacgttacgtttaggttacgttaggtaaaggtcacggtcgtaaggtaacgggtaacccggggcccggttaacccggtacggtacaccggtacggcgggaccggacgggtaccncgggttagtccccgg

SEQ ID NO: 55009 - DNA, 776 bp, Homo sapiens
  misc_feature: GYAE6OF02GXMC7.29.78.H01.1.454.CMB.1.raw
  modified_base (225)..(225): a, c, t, g, unknown or other
  misc_feature (225)..(225): n is a, c, g, or t
  modified_base (250)..(250): a, c, t, g, unknown or other
  misc_feature (250)..(250): n is a, c, g, or t
  modified_base (592)..(592): a, c, t, g, unknown or other
  misc_feature (592)..(592): n is a, c, g, or t
tcagatagagtactcacgaccggtgctcgatttagtgtgagtagtttgggtttggggtcgtgagagaggagtccacccctgggatcttcaggtgtttcatttggtgatcaggacggaacagagagaactcacatggtagtttgggctggagcgtggtcttttatgtgtcttaagttttaaaggtgtccagtgtgacgtgctaggttggtggtagtcgtgggggcncgtggggtaccgggccggggggtcncgtagagtcctcgtccgtggtgtccggtccttacggtggtaatttaaggtttaggacgttctaagtacgtccgaagtacgtaacgtcgggtaccccgaccgaggtccttaccggaaggggtacggggctagggtacggtacgggtaccgtcggtaccttaaggttacggtgggacgtaacgggttgggtcggtcgtacgttaattaacgttattacggtacgacgaacggtaccggtacccgtaagggaaccgggtccgttaaccctacggttaactttaccggaagtaaccgtaacgtaaacgttacgaaacggaactacggtaccttaggtactcggtanacgttaaagtggacggtactcgtagagaaccgtcgacgaaccgccggtactaattacgttacgttaaggtacggttaaacggcgtacgttagtaacgggtaacgtaccgggggtacccgggtaccttaaggtccgaaacggtccgggtacggggaccgaacggggtctacggtacgttacccgg

SEQ ID NO: 55010 - DNA, 630 bp, Homo sapiens
  misc_feature: GYAE6OF02GF0MP.29.78.H01.1.454.CMB.1.raw
tcagatagagtactcacgaccggtgctcgatttagtgtgagtagtttgggtttggggtccgagccatggtgcagactccccagagctctcctcctcctccactgcacagggtctctctcccagcctgtgctgactcaatccgccctctgccctctgccctcccgtgggagctcggtcaaggtcacctgtactctgagcagtggaacacgagcagctacgccatccgtcttggacatcacgcacggaggccaggaccgacggggtcccttcgttacgttgatcgacagtacaaacaatgatggactagtcacgaggacggaacgggggacggtactcccgtagtagtccgtccttccgcgtacgtcctaccgacgtctcggtacgggtccgtgacgcccgtacctaccctacgaactacgttccgacccggtcctaccgagttccggtagaggtcgtgggacgtctacgttactagtttccgtgtaccgagtaccggtggtcctaaggtcgtacgtactttcgggacgttccggtaaccggggaccgtaacgtcgggaccgttaccgcggtacggaccaccgtacccgagtaccccaacccgtgtaccgtaccacttccggtcctaccccg

SEQ ID NO: 55011 - DNA, 965 bp, Homo sapiens
  misc_feature: GYAE6OF02GYFKW.29.78.H01.1.454.CMB.1.raw
  modified_base (102)..(102): a, c, t, g, unknown or other
  misc_feature (102)..(102): n is a, c, g, or t
  modified_base (166)..(166): a, c, t, g, unknown or other
  misc_feature (166)..(166): n is a, c, g, or t
  modified_base (192)..(192): a, c, t, g, unknown or other
  misc_feature (192)..(192): n is a, c, g, or t
  modified_base (790)..(790): a, c, t, g, unknown or other
  misc_feature (790)..(790): n is a, c, g, or t
tcagatagagtactcacgaccggtgctcgatttagtgtgagtagtttgggtttgggggtctgagagaggagtccacccctgggatcttcaggttgttttctntttggtgatcaggacggaacagagagaactcaccagtggtagtttggctgagcgtcggtctttntaggtgacttaagtttaaaggtgtcngtgtgacgtgcgtagttggtggtacggttcggtgggggtcgtccggttcgggggtaccgggggtcccggggggggttctacgttggacgttccgtccgttccgttggtacggtccgggtaccctttacggtacggttaaagttttaacggtttttaaggtacgttccgtaagttacggaccccgttaagttaccggttaaccgggttacccggggtttaccccggaaccccggtaacggggttaccccgtacccggggtaaacgggggggtaaacccggggggtcgttaccgggggtcgggggtttaccgggggttcccgggttacccggggttaaccgttttaacgggttaaccggggttacggtaccggggttaacgggtttcggggtccggggtacggtaaccgtttaaattaagtttacgttaacgtacggaccgttacggaaccccgtaccggttaaccgggcccggggtttaaccccgttaccgttaaccttccgtttaccggaagtaaccgtaacgtaaacgttaaccggaaaacgtaaccgccgttaattcgtaacttcgtagaaactaggtagaaccgtacgtggttanaccggttacggaccggaaccgtacccggaccgttaccgtttaccgttaagtttcgttaacgggttaaacgtacggttacggcttaggtaaccgggtaaccggtccgggggtacccggtactaccggttagacccgacgggtcgggaccggtaggcccggttaggtccgtacccgg

SEQ ID NO: 55012 - DNA, 864 bp, Homo sapiens
  misc_feature: GYAE6OF02G2PAH.29.78.H01.1.454.CMB.1.raw
  modified_base (196)..(196): a, c, t, g, unknown or other
  misc_feature (196)..(196): n is a, c, g, or t
  modified_base (859)..(859): a, c, t, g, unknown or other
  misc_feature (859)..(859): n is a, c, g, or t
  modified_base (863)..(863): a, c, t, g, unknown or other
  misc_feature (863)..(863): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtcccgccaggcctccgagggaagggctggagtgggtctcggactagttagtggcnggtggtcggcgactagtatattagtgcgagaccgcccgtaggaacgggtccgttacaccgtacttaccgagtagaactaacgttacgaaacgaaccgaacgtccgtagttaagttcctagaaccaaaagtggaaggacgaccgtagaagcgtacgaccgtaacgacccggcccttagttattagttggttaacggttaaagggaccgacggtacgtaggaaaggttaaccgggggacccgggaccccgtacgttcgaacccgtacggtcggggaccggtaacggggaccgtacggtttacggtacccgtaacccggttctttaaccccgccgtaaccggtccccttaacccggaaccgtaaaccggggtacccccttaagggtttccccgttaccccgtttacccccccggtaccggaacccttacccccgtacccgtaaacccgaacggtaccgtaacccgtacccgttaccggggtaccgggtaccgaaacccgtacggaccccggaccgtacccggtaccggttcccgtacggtccccgtaagggttaccgaaaacggttaccggttaaccctacgggttacccgttacgtttcgttacgtaaccggtaggaccggttccgggtacgtacgggaccgtaacggaccggttacaccggtanccgng

SEQ ID NO: 55013 - DNA, 922 bp, Homo sapiens
  misc_feature: GYAE6OF02FVXP8.29.78.H01.1.454.CMB.1.raw
  modified_base (237)..(237): a, c, t, g, unknown or other
  misc_feature (237)..(237): n is a, c, g, or t
tcagatagagtactcacgaccggtgctcgatttagtgtgagtagtttgggtttgggggaagaggaagactgacggtccaccctgggatcttcaggtgtttcatttggtgatcaggacggaacagagagaacctcaccatggagtttggctgagctggctttttcttgtcggtctatttttaaaacggtgtaccgtagtcgtagaccgttgcgagtttcggtgggagtcgtgggggcnccgtgggtaccggccgggggtcgccgtgagacctactccgtagtcgccggccttacgtcggagtttaagttttaggagttccaagttcgacctatcgtaacgtacggttcccgacctagggtccttaccggaaggggtaacggggtcttcgggacggttcggggttccttccggggactttaggttaaggttggggtcctaaacgggttcggggttcggggtacccgtaccgtttaaggttaactttaaaggttttaaccgtttgggacccgtaaaccgggtccgggtaccccgtttaagggtaaaaccccggggggtttcccggtttaacccgtaaaccccgttaaccgttttttaacccccgaaagggacggttaaaccccgtaaagggttttaccgggaaaacgggtaaacccaaccggttacgttaagtttaaccgtccgttacggaacgtaaacggtacggtacggaacggtaccttacggacgtaccttacggaacctaaccggaccggtccgttacgttacgtttaacttggtttaaacggttaaggaccgttaacggtgttaacgggtacggttaacccgggggacccggggtacccgtttaacccgtaacggttacccgtacgggtttaacccgggaccggtaacgggggtacccggtcgtacgggttaaccccgg

SEQ ID NO: 55014 - DNA, 923 bp, Homo sapiens
  misc_feature: GYAE6OF02HQNJC.29.78.H01.1.454.CMB.1.raw
tcagatagagtactcacgaccggtgctcgatttagtgtgagtagtttgggtttgggggcgcctgggtacggaccgggggggtcgctgagactctcctgtgcggcctctggattaagttttaggagtcatgccatgaactgggtccgcaggctccaggggaagggctggagtgggtctcggctattagtggcagtggtggcgctatatattatgacagacgccctaggaacggggtccggttccaacctatttccagaacgtactaaacgttacggaaagaaccacgtccttaggtaactcgtacggaactaaaacggttgggaacgaacggtcccgttaggaacgtaaccgttccggaacccggaaccgtacccggggtaccccgttaccgtttaaattttacggtttacggttacggtttaaaaacgggtccggaacggtcggtaacggggtaaaccggttaacccggggggaccccgggggtaacccccgtacggttaccggacccgtacggtccggggggtaccgtaacgggggggacccgtcgtttaccggggtacccgtacccggttcccttacccgtaccgtaccggtacccccgtacccgtaacccgggaaccggggaccctaccgggtttcccgggttacccccttttcccccggcggtacccctacccccgttaccctaacccggtaaacgtaccggtccccttaaaccccggttcgggttaaccgggggaccctaaccggtaaccggtacccgtaacgggttcccccggtacgggggttaccctccgggtacccggttacgggttaaccaaccggggttaccttaacccgttacgtaaccgttacttaccgtacgtaacggtacgcgggtacggaccggtggaaccgtacgggtccgtacgtaagtctagtcg

SEQ ID NO: 55015 - DNA, 610 bp, Homo sapiens
  misc_feature: GYAE6OF02GNMVS.29.78.H01.1.454.CMB.1.raw
  modified_base (336)..(336): a, c, t, g, unknown or other
  misc_feature (336)..(336): n is a, c, g, or t
  modified_base (426)..(426): a, c, t, g, unknown or other
  misc_feature (426)..(426): n is a, c, g, or t
  modified_base (580)..(580): a, c, t, g, unknown or other
  misc_feature (580)..(580): n is a, c, g, or t
tcagatagagtactcacgaccggtgctcgatttagtgtgagtagtttgggtttggagtctgcaccatggctcggaccccactcctcttcctcaccctcctcctccactgcacagggtctctctcccagcctgtgctgactcaatcgccctctgccctctcgccttcccgtggggacggcgtcggtcgaaggtccacctgtactctgagcagtggacacagcagctacgcctatcgcttggcatcagcaggagccagacgaccggtcctcgttacttgatcgacagtaccaacaatgagtggcagtcaacgagacggaagggggacggacttcccgngtacgtcgtcgttctacgagttctcccgagtccctgtacggcctgacgtccgaccgttaccacgactacgtcccgtccgtcctactcgtntacggagtacgtggcgatacggtacttacgtgtcgactaccggacggttacgggcctaggtcgacgttcttacgtacgtcggtaacgggaccggtacgtacggtccgaccggtcggtacccgcgaaccgtacccgaaccggtacccgtaacccncgttacgtaccctacttcccgtaaccccgg

SEQ ID NO: 55016 - DNA, 863 bp, Homo sapiens
  misc_feature: GYAE6OF02IDKFV.29.78.H01.1.454.CMB.1.raw
  modified_base (60)..(60): a, c, t, g, unknown or other
  misc_feature (60)..(60): n is a, c, g, or t
  modified_base (83)..(83): a, c, t, g, unknown or other
  misc_feature (83)..(83): n is a, c, g, or t
  modified_base (145)..(145): a, c, t, g, unknown or other
  misc_feature (145)..(145): n is a, c, g, or t
  modified_base (165)..(165): a, c, t, g, unknown or other
  misc_feature (165)..(165): n is a, c, g, or t
  modified_base (192)..(192): a, c, t, g, unknown or other
  misc_feature (192)..(192): n is a, c, g, or t
  modified_base (843)..(843): a, c, t, g, unknown or other
  misc_feature (843)..(843): n is a, c, g, or t
tcagatagagtactcacgaccggtgctcgatttagtgtgagtagtttgggtttgggggcncctgggtacggccgggggggtcnctgagactctcctgtgcggcctctggattaagtttaggagtcatgccatgaactggtccgcnggctccgagggagggctggngtggtctcggctagtagtggcagtggnggctctatatattagtgacagacgcccgtaggaacgggtcccgttacaaccgttactttacccgaagacggaactaaacgttacgaaaaggaacctaccggtccttaggtactacttggaaacaaagtgggaacgacggtccttacgggaacgttaccggaacgtaccggaacccggttaaccggtacgtttacttaaagtttggttaacgttaaacggggtaacgtaacggtacggtaggtaaacggtaaccgggggttacccgggggaaccccgggttaccgacgtaaccccgtacgggtaaccgggtaccggggaccgggaaccgggtacgtcgggtacccgtcccgtaccggttcccttaacccgtacgacccgtacccccgtaacccggaacccgggttaccgaacgggtcccccgttacggtttaccccccgttccggttaccccaccccgttaccccgttacccgaaacccgtacggtacccgacccgttacccggtacccgggtaccggacgtacccgcgtacccggtacccggtcccgggttaccggtacggtccggtaccgttacgggaaccgttaacgtaccgttacgtaccgtaacccttaccgttcgtaccttcggacgtccgggtacgtccggacgnggaccgcgtagtagcgtagc

SEQ ID NO: 55017 - DNA, 769 bp, Homo sapiens
  misc_feature: GYAE6OF02IFR89.29.78.H01.1.454.CMB.1.raw
  modified_base (202)..(202): a, c, t, g, unknown or other
  misc_feature (202)..(202): n is a, c, g, or t
  modified_base (340)..(340): a, c, t, g, unknown or other
  misc_feature (340)..(340): n is a, c, g, or t
tcagatagagtactcacgaccggtgctcgatttagtgtgagtagtttgggtttggggcgcctgggtacggccggggggtcgctgagactctcctgtgcgcctctggattaagttttaggagtcatgccatgaactgggtccgccaggctccgagggaagggctggaggtgggtctcggctagttagtggctaggtggtggcncgtatatattatcgcagaccgccctggaaacgggtcccggttcacctatttccgagaagacaagttcgaaagacacggactgtaactctagacaaagtggagacgcctgacgactcgacgacacggtccgtatagttnttggtagttaaaggcgagcgtaggtaaacgtacggggacccggggaccctagttcgaaccgacggtcggggaaccgaggggtaccgacgttcggtaccgacccggttcctacccgtcaccgtacccccttcccgaaccgaccgggtacccgtaccgttcccgttccccgtttccccccgacggtacccgtaacccccgttcctacccgaacgtaccgtaacccgtacccgttccggtcggggaccctaccgaacgcccgtaccgggaccccggttgggacccgtccgtccggtccggtaaccgtaaaccggtccttaacccgttaccgaccggtttaacctcgttacccgtacggttacggcccgggttccgggtaccgttacgggtacccggtaacgggaccggttacccgaaggttccggagtccgg

SEQ ID NO: 55018 - DNA, 717 bp, Homo sapiens
  misc_feature: GYAE6OF02IUFQH.29.78.H01.1.454.CMB.1.raw
  modified_base (113)..(113): a, c, t, g, unknown or other
  misc_feature (113)..(113): n is a, c, g, or t
  modified_base (388)..(388): a, c, t, g, unknown or other
  misc_feature (388)..(388): n is a, c, g, or t
  modified_base (710)..(710): a, c, t, g, unknown or other
  misc_feature (710)..(710): n is a, c, g, or t
tcagatagagtactcacgaccggtgctcgatttagtgtgagtagtttgggtttggtggtctctctcccagcctgtgctgactcaatcgccctctgcctctcgcctccgtgggngctcggtcaaggtcacctgtactctgagcagtgacacagcagctacgccatcgcttgcatcagcagacggaccagacgccgggtcccttacgttacgttgatcgaacacgtacaaacagtgactggactgtacaacgagacgggaaggggtacgtactccgtagactcggtccttacgcgtacgtcctaccgacgtccgtcggtacggtctcggacgaccggtaccttaaccactaaccgtacgtccgtcccggtaacctcgtcgtacggtacgnggtaacgtgggtaacgtcgttacgtaacttcgtaaccgttgtaccgacgtaccggtacggtctaacggtcgtagttacgttacgtaccgggttacggtaaaccgggccggtaagtaaccggtctccgggcgttccgaaccgccgtaaaccggaccaacccgtacccgtacgtacccttaccgcctttccccggttacccgtccccgttacccctaccgggttactaaaccggtttccacccgtttaaacggtcccggttaaccgggcccgggtttaaccgggctttaaccggggaccggtaaccgtgacccggttagtaccncgcgtag

SEQ ID NO: 55019 - DNA, 669 bp, Homo sapiens
  misc_feature: GYAE6OF02ICRF8.29.78.H01.1.454.CMB.1.raw
  modified_base (413)..(413): a, c, t, g, unknown or other
  misc_feature (413)..(413): n is a, c, g, or t
  modified_base (634)..(634): a, c, t, g, unknown or other
  misc_feature (634)..(634): n is a, c, g, or t
  modified_base (667)..(667): a, c, t, g, unknown or other
  misc_feature (667)..(667): n is a, c, g, or t
tcagatagagtactcacgaccggtgctcgatttagtgtgagtagtttgggtttgggggcgcctgggtacggccgggggggtcgctgagactctcctgtgcggcctctggattaagttttaggagtcatgccatgaactgggtccgcaggctccaggggaagggctggagtgggtctcggctattagtggcagtggtggcgctatatattatgcagacgccctaggaacgggtccgttacacctatttccagacgactaattacgaagaacacgctgtatctagacaaagtggagagcctagacgacgtcgacgacgacggtccgtacttatttacgttgtagttaaaggcaggctaggaaacgtccgggaccgggtccctagttcgaccgtaggtcggggccgtaggggaccncgtcgggtaccacccgttctccctcgacgtccctaccgaacccgagggacccctacgtcccggttccccttaccccgtcggaccctacccgtccctaaccgagaccgacctacccgtgggtcgggaccacgacgccgtacggcccgtacgggctccggcgtacggtacgtaacggtaccttacgtaccacgttacctctacgtccgtaggacggtcccggngtacggaccgtaacgggcctaccgtagacggtnag

SEQ ID NO: 55020 - DNA, 713 bp, Homo sapiens
  misc_feature: GYAE6OF02JCKCJ.29.78.H01.1.454.CMB.1.raw
  modified_base (211)..(211): a, c, t, g, unknown or other
  misc_feature (211)..(211): n is a, c, g, or t
  modified_base (338)..(338): a, c, t, g, unknown or other
  misc_feature (338)..(338): n is a, c, g, or t
  modified_base (367)..(367): a, c, t, g, unknown or other
  misc_feature (367)..(367): n is a, c, g, or t
  modified_base (701)..(701): a, c, t, g, unknown or other
  misc_feature (701)..(701): n is a, c, g, or t
tcagatagagtactcacgaccggtgctcgatttagtgtgagtagtttgggtttgggggcgcctgggtacggccggggggtcgctgagactctcctgtgcggcctctggattaagtttaggagtcatgccatgaactgggtccaccaggctccgagggaagggctggagtgggtctcggctagttagtggcagtggtggcgctatatattangcagaccgcccgtaggaagggtcccggtttcaacccgtacgttttcccaaaggacgaacctaattccggaaaagaaccacgctgtaatccgtgacaaagtggagtacgcctgagactcgaacgaccncggccgtatacttagtgtaggttaaacgngaagctaggacgtacgggaccgggcccagttgaccctacggtcggggaccagggggacctcgtaggtacctaccggtactccgtacaccggtccctacccgaacggaacccggggccctaagtccccggtttcccttccccccgtacggtacccgtaccccgttacccgtacccggtaaacgacccgtaccgtaacccgtcgggttacgggggaccaacgacggtaccgaaccgtcccggtacgggccgtaccgacgttacggtacgaacggaccttacgtaccgtatacctagtacgtgtacggacgtacggtcgaggtaccgacgaccgtanaacgttagacag

SEQ ID NO: 55021 - DNA, 919 bp, Homo sapiens
  misc_feature: GYAE6OF02JCRO3.29.78.H01.1.454.CMB.1.raw
tcagatagagtactcacgaccggtgctcgatttagtgtgagtagtttgggtttgggggcgcctgggtacggccggggggtcgctgagactctcctgtcgcggcctcgtggattaaggttttaggagtcatgccatgaactgggtccgccaggctccgaagggaagggctggaggttggtcgtcggctagttaggtggctaggttggtggcgactaattagtaattacgtgcagaccgtccctaggaacgggtcccgttcaacccgttatttcccgaaggtaactaacgtaacgttaccggaaaacggtaaccgtaacgtccgttagggttaacttccgttacggaaccgtaaaagttacgggtaaggttaaccgccccgttaggaacggtaaccgtaccggaaccggaacccggtacccgggtacccgttacttaagttttacgttacgttaagggttaaacggcgtaccgtagtaagggtaaccggtaccgggggaaccccgggtaccccgtacgttaccggaacccgtacggtcggggaccgtacggggaccgtcggtaccggtacccgtacccgttccgtcccttaccggaaccgttaccctacccgaacccgggtaacggggacccctacgggtttaccccggttcccccgtttacccccggtcggtaccccctacccgtaccccgttaaccggaaccggtacccgtcccgtaaccggttccggggttaccggggaccaaccgggtaccgacccgtacccggcccgggttacgggcccttacccggggcgtaccgggtaaccgttaaaccgtaaccctttaccgtcccgtaaccgttacttacccgtattcccggacggtacgggtacggaccgttaccggaccgtacgggtacgaaccgttaccggagtcgtac

SEQ ID NO: 55022 - DNA, 844 bp, Homo sapiens
  misc_feature: GYAE6OF02JRQCH.29.78.H01.1.454.CMB.1.raw
  modified_base (183)..(183): a, c, t, g, unknown or other
  misc_feature (183)..(183): n is a, c, g, or t
  modified_base (249)..(249): a, c, t, g, unknown or other
  misc_feature (249)..(249): n is a, c, g, or t
tcagatagagtactcacgaccggtgctcgatttagtgtgagtagtttgggtttggggtctgagagaggagtccaccctgggatcttcaggtgttttcatttggtgatcaggacggaacagagagaactcaccatggtagtttgggctgagctggtcttttctgtggcttaattttaaaaggtntccagtgtgtacgtgcaggttggtggagtcgtgggggcgccgtggggtacggggccgggggggtcncgtggagtactcgtccgtggtcgccggtcctcgtggtaagtttaacggttttaggacgttactaagtcgccgagttacgaacgttcgggccgtacgaggccgtaccggaggggaacgggtccggtaggacggttcgggtcgtcgggtcttaaggttcggttcgggacgtcggtggggtgggtccgtacggttaataagttaacgttacgtcggtaacgtaacggaccggtccgttagggtaaaccggggtcccgttttaaccgaacctttacgttaacccggtaagtaacggtaaactaaacgggtttaacaaaacgggtaaccgtacgtacgttagtaacgttacgaaccgtaagaaaacggtgggtaacggtaacctcggttaacgacgtaaccgttaacgaaccggtaaccggccggtttaaccgtagttaaacgttcggttttaaacgtaaggttaaaaccgggtcgaacgtaccggttaacggtaacggggtacccgggggtaccccgggaacttccggggttaaccgaccggttaaccgggtaccgggggaccgtacgggggtaaccgtcccgggttacgttaccccgg

SEQ ID NO: 55023 - DNA, 750 bp, Homo sapiens
  misc_feature: GYAE6OF02H3990.29.78.H01.1.454.CMB.1.raw
  modified_base (713)..(713): a, c, t, g, unknown or other
  misc_feature (713)..(713): n is a, c, g, or t
  modified_base (747)..(747): a, c, t, g, unknown or other
  misc_feature (747)..(747): n is a, c, g, or t
tcagatagagtactcacgaccggtgctcgatttagtgtgagtagtttgggttgggggcgctgggtacggccggggggtcgctgagactctctgtgcggcctctggattaagtttaggagtcatgccatcgaactgggtccgcaggctccgagggaaggggctggagtgggtctcggctattagtggcaggtggtggcgactatatattatcgcagacgccctggaaacggggtccggttacacctatttccaagagtaacaattcgaaaaggaaccacgcttagtactctgacaaaagtggagacgcctgagactcgacgactaccggccgttactatttagttgtaggttaaaggccgaagcttagggaaacgtaccgggggacccgggcctaacgttcgaaccgtaacggtcgggggaccgaagggggaccgtcggtcgggtaccgaacccgttccgtaccctaccgacggttacccctacccggaaccgaaaccggggtcccctaaggttccccgggttccccttttccccccggacgggtaccctaccctacccctaacccggtaaggaccgtaccctaacccggtcggttacggggactaaccgacgtccgaccgtccgggtcggccgtacggtccgttacgggtaccgaacggtactaccgttaccgaccgtactaccttacgtcgacggtaacgggccgggttacncgggtaccgaacgggtccgttaacgcgttacggntcg

SEQ ID NO: 55024 - DNA, 764 bp, Homo sapiens
  misc_feature: GYAE6OF02GXFIG.29.78.H01.1.454.CMB.1.raw
  modified_base (189)..(189): a, c, t, g, unknown or other
  misc_feature (189)..(189): n is a, c, g, or t
  modified_base (212)..(212): a, c, t, g, unknown or other
  misc_feature (212)..(212): n is a, c, g, or t
  modified_base (428)..(428): a, c, t, g, unknown or other
  misc_feature (428)..(428): n is a, c, g, or t
  modified_base (552)..(552): a, c, t, g, unknown or other
  misc_feature (552)..(552): n is a, c, g, or t
tcagatagagtactcacgaccggtgctcgatttagtgtgagtagtttgggtttggggtctgagagaggagtccacccctgggatcttcaggtgttttcatttggtgatcaggacggaacagagagaactcaccagtggtaggttggctgagctggtcttttcttgtggtctaagttttaaaggtgtccngtgtgacgtgtgtagttggtggngtcggtcggggccgcggttcggggtacggggccggggggtcgcgtcggagactcctcgtcgtggccggtctcgtacggtatttaaggttaggtacgtctaagtgccagtagacgtcgggaccgtccaggtcccgtacggacggggtaagggtccggagggtggtacggttcgtcggccttaaggttaggttacgtacgtgtgggtcggcgacgttnttactagtttagcgacgttacgacccggtccggtaggacgggtccgttacgtaacctacgttaccgagtaacgaacgtacgttaggaaacgacgaccgttcgagtactagtctaacgttaaagnggaacgacggttacccgaggttaaacgacccttaaccgggaaccggtaacgtacccgggtaccggtttacttaaacgttttaccgttaagtaaacgggttaaccggttacgaggtcgaacgggttaccgggaaaccgggtcccgggtaaccgacggttaccggacccggtaacgggtcggaaccgggtacgggacctaccgggcgtaaccgg

SEQ ID NO: 55025 - DNA, 812 bp, Homo sapiens
  misc_feature: GYAE6OF02H0J1D.29.78.H01.1.454.CMB.1.raw
  modified_base (249)..(249): a, c, t, g, unknown or other
  misc_feature (249)..(249): n is a, c, g, or t
tcagatagagtactcacgaccggtgctcgatttagtgtgagtagtttgggtttgggggcgccctgggtacggccgggggggtcgctgagactctcctgtgcggcctctggattaagttttaggagtcatgccatgaactgggtcccgccaggctccagggaaggggctggagtgggtctcggctattagtggcagtgggtggcgctatatattatgcagacgcctgagggccgttcaccatttccaganacaattacgaagaacacgctgtatctgacaaatggagagcctgagactcgacgacaccggcgtctattacttgtaggttaaaggcgtagcgtagggaaagtaccgggggacccggggtaccccggtacgtttacggaacccaacggttcggggggaccggaaggggggaccgtcggttacgggttaccgacccgtttacctccctaccgaaccggtccctaccccgaacccgaaaccggggtaccccgaacgttcccgggttaccccgttcccccccggtacgggtcccctacccccgttccccgtaaccccgaaccggtaccggaccctaacccggttccggttacggggggccctaaaccgaccggaccgacccggtaccccggtccggggtacccgttaccgggttcccgtaccgggttaacccgaaacggggttaacccttacccgtttaccctaacccggtttaccgttactttaacgttaccgttccgggtaaccgggtccggggttaccgtcggggttaaccggacggtccggtaaaccggttaagtacggtcacg

SEQ ID NO: 55026 - DNA, 851 bp, Homo sapiens
  misc_feature: GYAE6OF02ISFQN.29.78.H01.1.454.CMB.1.raw
  modified_base (219)..(219): a, c, t, g, unknown or other
  misc_feature (219)..(219): n is a, c, g, or t
  modified_base (246)..(246): a, c, t, g, unknown or other
  misc_feature (246)..(246): n is a, c, g, or t
tcagatagagtactcacgaccggtgctcgatttagtgtgagtagtttgggtttggggggagagaggagtccacccctgggatcttcaggtgttttcatttggtgatcaggacggaacagagagaactcaccatggagtttggctgagctggtctttttcttgtggcttattttaaaaggtgtccagtgtgacgtgcagttggtggagtcgtgggggccnccgtggggtaccgggccgggggggtcncgtgagactctccgtgtgcggcctcgtggtatttaacggttttggagttctatgaccagtacgaaccgttcgggtccgcccgaggcccgttaccggaagggggaacggggtccgtaggggaggttcgggttaccgtccgggacttagttaggtggacgtaggttgggtcggcgtacttaagttacttaagttacgtacgacgtaccggaccggttcccggttacgggtaaccggggttcccgggtttaccaacccgttacgttttaccccggaaggtaaccgtaaccgttaaacggtttaccggaaaacggtaacccgtaccgttaccggttagtttaaccgttaccgttaggaaaccgttaaagggtcgggtaaggtaaccggtaccgttacgggaaccgtaaccgtaccgggaacggaacccggtaccggttccggttacttttaacgttcgtttacggttaagttaaacgggtcgaacggttcgtacgggtacggtaccggggggtacccggtcccggtaacggttccgaacccggtacgggttccggggaccgggtaacggggtccgtaccgggtttaccggtcccgtaaccggttccccg

SEQ ID NO: 55027 - DNA, 848 bp, Homo sapiens
  misc_feature: GYAE6OF02GX418.29.78.H01.1.454.CMB.1.raw
tcagatagagtactcacgaccggtgctcgatttagtgtgagtagtttgggtttgggggagagaggagtccaccctggatcttcaggtgtttcatttggtgatcaggacggaacagagagaactcaccatggtagttgggctgagcgtggtctttttcgtggtggcttaagttttaaaaggtgtaccagtgtgacgtgcaggttggtggacgtcgtggggcgtcgttggggtacgggccggggggtacgcgtgagacgtcctcgtggtcggcggtcctcgtggtacgtttaaggttttaggagtcctatcggacctacgtagtaacggttcgggtcccgaccgtacgggtccgttaccggaacggggaaggggtcgtacgggtaggtccggggtacgtaccggtgttaacggttaggtacggcggttaaggtcggggtcgggtaccgtacgttaattaagtaagtttacgtacgctacggaccgttccggtacgggaacgggttccgttaccgacttacgttccgtaagacgaccgtaacgttacgaaacgtaacgccgtacgtacgttactacggtacgtaacgaaaggtcgggaacgtacgtaacgtacggtaacgtaaccgtaccgtaaccggaccggtaaccggtacccgttacgtttaagttcgtttaacggttaacgttaaaacgggtgaacggttcgggtaaaccggtaaccggggtacccggggaacccccgggttacgggtacccgttaaaccggacccggttacggggtaccgggggacccggttaacggggggacccgttacggttaacccgggttcccgtaaacccggtttccccgg

SEQ ID NO: 55028 - DNA, 526 bp, Homo sapiens
  misc_feature: GYAE6OF01ALQAO.41.19.B08.1.454.CMB.1.raw
  modified_base (496)..(496): a, c, t, g, unknown or other
  misc_feature (496)..(496): n is a, c, g, or t
tcagtctatactatcacgaccggtgctcgatttagtgagtcagtaaggggtggggtctcaggaggcagcgctctcgggacgtctccaccatggcctgggctctgctatccctcaccctcctcactcagggcacagggtcctgggcccagtctgccctgactcagcctgcctccgtgactgggtctcctggacagtcgatcaccgtctcctgctctggctccagtagtgacgtcggtgcttataattttgtcgcctggtaccaacaacaccccggcgaagccccagactccataatttatgatgtcactgatcggccctcagggtttctaatcgcttctctggctccaagtccggcgacacggcctccctgaccatctccggcctccaggcgaggacgagggtgattatttctgcagctcatttacaaccagccacaccttgctcttcggaactgggaccacggtcatcgtcctaggtcagcccaaggcccaacccnctcgtcactctcgttcccgccctcctctac

SEQ ID NO: 55029 - DNA, 531 bp, Homo sapiens
  misc_feature: GYAE6OF01DTN9A.41.19.B08.1.454.CMB.1.raw
  modified_base (498)..(498): a, c, t, g, unknown or other
  misc_feature (498)..(498): n is a, c, g, or t
tcagtctatactatcacgaccggtgctcgatttagtgagtcagtaaggggtggggtctcaggaggcagcgctctcgggacgtctccaccatggcctgggctctgctatccctcaccctcctcactcagggcacagggtcctgggcccagtctgccctgactcagcctgcctccgtgactgggtctcctggacagtcgatcaccgtctcctgctctggctccagtagtgacgtcggtgcttataattttgtcgcctggtaccaacaacaccccggcgaacgccccagactcataatttatgatgtcactgatcggccctcagggtttctaatcgcttctctggctccaagtccggcgacacggcctccctgaccatcctccggcctccgaggcggaggacgagggtgtattatttctgcagctcatttacaaccagccacacctgctctcggactggaccacgtcatcgtctaggtccacgcccgaacgcccaaccccnctcgtccactctcgtccccgccctcctctaacg

SEQ ID NO: 55030 - DNA, 673 bp, Homo sapiens
  misc_feature: GYAE6OF01EIWZW.41.19.B08.1.454.CMB.1.raw
tcagtctatactatcacgaccggtgctcgattttagtgagtcagtaagggtagggggtacggtcgaaggaggcagcgtctcctcgggacgtactccaccgaatcggcctgggctctgtctattccctcaccctcctcactcgaggccacaacggtctgggccaagtctgccctgactcagtcctgcctccgtgactgggtctcctggacgagtcgactccaccgtctcctgcgtcctggctccgagtagtgacgtacggtgtctttataagttttcgcgcctaggtaacccaacgaccaccccggcgaacgccccagacctcattaattttatcgtatcgtcgacctgacgtcgcccctgacgggtttctaactcgtcttctcgtgggctccgaagtccggacgtacacggtcctccctagacctatccgtccggctccgagggccgaggaccgagggtgtattttagttctgtctacgcttcaatttccaacagcctaactacctttggcctttcgttacggaacgtttcggggaaccctacgggtacaagttccgttaccgtaacggttccaaacggtccccgtaaacgggcccctaaacccccgtcgttaccggtacccaaccgtttccgttccggtttaccccctaaccccgttccttcccgttaaccg

SEQ ID NO: 55031 - DNA, 527 bp, Homo sapiens
  misc_feature: GYAE6OF01A242M.41.19.B08.1.454.CMB.1.raw
  modified_base (412)..(412): a, c, t, g, unknown or other
  misc_feature (412)..(412): n is a, c, g, or t
  modified_base (495)..(495): a, c, t, g, unknown or other
  misc_feature (495)..(495): n is a, c, g, or t
tcagtctatactatcacgaccggtgctcgatttagtgagtcagtaaggggtggggtctcaggaggcagcgctctcgggacgtctccaccatggcctgggctctgctatccctcaccctcctcactcagggcacagggtcctgggcccagtctgccctgactcagcctgcctccgtgactgggtctcctggacagtcaatcaccgtctcctgctctggctccagtagtgacgtcggtgcttataattttgcgcctggtaccaacaacaccccggcgaagccccagactcataatttatgatgtcactgatcggccctcaggggtttctaatcgcttctctggctccaagtccggcgacacggcctccctgaccatctccggcctccaggcggaggacgagggtgattatttcngcagctcatttacacagccacaccttgctctcggaactggaccacggtcacgtcgtctaggtcagcccgaaggcccaaccccnctcgtcactctcgtacccaccctcctctaacg

SEQ ID NO: 55032 - DNA, 529 bp, Homo sapiens
  misc_feature: GYAE6OF01B60B8.41.19.B08.1.454.CMB.1.raw
  modified_base (431)..(431): a, c, t, g, unknown or other
  misc_feature (431)..(431): n is a, c, g, or t
  modified_base (497)..(497): a, c, t, g, unknown or other
  misc_feature (497)..(497): n is a, c, g, or t
tcagtctatactatcacgaccggtgctcgatttagtgagtcagtaagggtggggtctcaggaggcagcgctctcgggacgtctccaccatggcctgggctctgctatccctcaccctcctcactcagggcacagggtcctgggcccagtctgccctgactcagcctgcctccgtgactgggtctcctggacagtcgatcaccgtctcctgctctggctccagtagtgacgtcggtgcttataattttgtcgcctggtaccaacaacaccccggcgaagccccagactcataatttatgatgtcactgatcggccctcaggggtttctaatcgcttctctggctccaagtccggcgacacggcctccctgaccatctccggcctccagggcggaggacgaggggtgattatttctgcagctcatttacaacngccacaccttgctcttcggactgggaccacggtcatcgtcctaggtcagccccaaggccaaccccnctcgtccactctcgttccccgccctcctctac

SEQ ID NO: 55033 - DNA, 533 bp, Homo sapiens
  misc_feature: GYAE6OF01D3Q11.41.19.B08.1.454.CMB.1.raw
tcagtctatactatcacgaccggtgctcgatttagtgagtcagtaaggggtggggtctcaggaggcagcgctctcgggacgtctccaccatggcctgggctctgctatccctcaccctcctcactcagggcacagggtcctgggcccagtctgccctgactcagcctgcctccgtgactgggtctcctggacagtcgatcaccgtctcctgctctggctccagtagtgacgtcggtgcttataattttgtcgcctggtaccaacaacaccccggcgaagccccagactcataatttatgatgtcactgatcggccctcaggggtttctaatcgcttctctggctccaagtccggcgacacggcctccctgaccatctccggcctccaggcggaggacgagggtgattatttctgcagctcatttacaaccagccacaccttgctcttcggaactgggaccacggtcatcgtcctaggtcagcccaaggcccaaccccactcgtcacctctacgttccccgccctcctctaacg

SEQ ID NO: 55034 - DNA, 540 bp, Homo sapiens
  misc_feature: GYAE6OF01CTEZF.41.19.B08.1.454.CMB.1.raw
  modified_base (418)..(418): a, c, t, g, unknown or other
  misc_feature (418)..(418): n is a, c, g, or t
  modified_base (467)..(467): a, c, t, g, unknown or other
  misc_feature (467)..(467): n is a, c, g, or t
  modified_base (508)..(508): a, c, t, g, unknown or other
  misc_feature (508)..(508): n is a, c, g, or t
tcagtctatactatcacgaccggtgctcgatttagtgagtcagtaaggggtggggtctcaggaggcagcgctctcgggacgtctccaccatggcctgggctctgctatccctcaccctcctcactcagggcacagggtcctgggcccagtctgccctgactcagcctgcctccgtgactgggtctcctggacagtcgatcaccgtctcctgctctggctccagtagtgacgtcggtgctttattaattttgtcgcctggtaaccaacaacaccccggcgaaacgccccagactcataatttatgatgtcactgatcggcctgagggtttcaatcgcttctctggctcaagtccgcgacaccggctccctgaccactccgtccggcctccgaggcggaaggacgagggtgattatttcngcagctactattaccaacagccactacctgctcttcggaactcggaccncggtcattcgtcctaggtcacgacccgaaggcccaaacccntcgctactcctcgtaccccacctcctgtaacg

SEQ ID NO: 55035 - DNA, 558 bp, Homo sapiens
  misc_feature: GYAE6OF01CTRUD.41.19.B08.1.454.CMB.1.raw
  modified_base (411)..(411): a, c, t, g, unknown or other
  misc_feature (411)..(411): n is a, c, g, or t
  modified_base (420)..(420): a, c, t, g, unknown or other
  misc_feature (420)..(420): n is a, c, g, or t
  modified_base (521)..(521): a, c, t, g, unknown or other
  misc_feature (521)..(521): n is a, c, g, or t
tcagtctatactatcacgaccggtgctcgatttagtgagtcagtaaggggtggggtctcaggaggcagcgctctcgggacgtctccaccatggcctgggctctgctatccctcaccctcctcactcagggcacagggtcctgggcccagtctgccctgactcagcctgcctccgtgactgggtctcctggacagtcgatcaccgtctcctgctctggctccagtagtgacgtcggtgcttataattttgcgctggtaccaacaacacccggcgaacgccccagactcataatttatgatgtcactgatcggccctcgagggtttctaagtcgcttctctcggctaccgaagtcccggacgacaccggcctcctgacccatctcccggcctccgaggcggaggacgagggtnattattcgngcagtctactatttaccaacacgccacaccttgcttcgttacggaactcgggaccacggtcacgttccgtctacggcacgacccgaacggaccccaacccnctcgtccacttcctacgttccccaccctcctctaacg

SEQ ID NO: 55036 - DNA, 562 bp, Homo sapiens
  misc_feature: GYAE6OF01CPOY4.41.19.B08.1.454.CMB.1.raw
tcagtctatactatcacgaccggtgctcgatttagtgagtcagtaaggggtggggtctcaggaggcagcgctctcgggacgtctccaccatggcctgggctctgctatccctcaccctcctcactcagggcacagggtcctgggcccagtctgccctgactcagcctgcctccgtgactgggtctcctggacagtcgatcaccgtctcctgctctggctccagtagtgacgtcggtgcttataattttgcgcctggtaccaacaacaccccggcgaacgccccagactcataattatgatgtcactgatcggcctcgtagggtttctaatcgcttctctgctccaagtccggcgacacggcctcctgaccatcctccggcctccgagggcggaggacggagggtgtatttatttctgcagtctactatttacaaccagacccacaccttgcctcgttacggacgtcgggaccacggtcacttcgtcctacggtccacgacccgaacggaccccaaacccctctcgtaccaccttcctccgttccccgcccttccgtctaacg

SEQ ID NO: 55037 - DNA, 526 bp, Homo sapiens
  misc_feature: GYAE6OF01D8J2T.41.19.B08.1.454.CMB.1.raw
  modified_base (494)..(494): a, c, t, g, unknown or other
  misc_feature (494)..(494): n is a, c, g, or t
  modified_base (522)..(522): a, c, t, g, unknown or other
  misc_feature (522)..(522): n is a, c, g, or t
tcagtctatactatcacgaccggtgctcgatttagtgagtcagtaaggggtggggtctcaggaggcagcgctctcgggacgtctccaccatggcctgggctctgctatccctcaccctcctcactcagggcacagggtcctgggcccagtctgccctgactcagcctgcctccgtgactgggtctcctggacagtcgatcaccgtctcctgctctggctccagtagtgacgtcggtgcttataattttgtcgcctggtaccaacaacaccccggcgaagccccagactcataatttatgatgtcactgatcggccctcaggggtttctaatcgcttctctggctccaagtccgcgacacggcctccctgccatctccggcctccaggcggacggacgagggtgattatttctgcagctctatttacacacgccacacctgctcttcggactgggaccacggtcatccgtctaggtcagcccacggccaaccccnctcgtcactctcgttccccaccctcctntacg

SEQ ID NO: 55038 - DNA, 586 bp, Homo sapiens
  misc_feature: GYAE6OF01ACX62.41.19.B08.1.454.CMB.1.raw
tcagtctatactatcacgaccggtgctcgatttagtgagtcagtaaggggggggtctcaggaggcagcgctctcgggacgtctccaccatggcctgggctctgctattcctcaccctcctcactcagggcacagggtcctgggcccagtctgccctgactcagcctgcctccgtgtctgggtcacctggacagtcggtcaccatctcctgcactggagccagcggtaatattcttagtcttaactttgtctcctggtatcaacatcatccaggtaaagcccccaaactcatcatctatgaggcctataagacggccctcaggggtttctaatcgtcttcactgcctcaagtccgcaacacgcctcctgacaatctctggctcagctgagacgaggctgattacttattgttgctcgagattggttcgtcgtctatactacttagtcgttcgttacggaaggttcgggaaccgtaaacgggtccgaacccgttaccgtacgggttaccacgaccccgaaacgggacccccaaacccccgacgttaccggttacctacccttccgttccgttccccccggttaccccc

SEQ ID NO: 55039 - DNA, 551 bp, Homo sapiens
  misc_feature: GYAE6OF01AMYJT.41.19.B08.1.454.CMB.1.raw
  modified_base (405)..(405): a, c, t, g, unknown or other
  misc_feature (405)..(405): n is a, c, g, or t
  modified_base (517)..(517): a, c, t, g, unknown or other
  misc_feature (517)..(517): n is a, c, g, or t
tcagtctatactatcacgaccggtgctcgatttagtgagtcagtaaggggtggggtctcaggaggcagcgctctcgggacgtctccaccatggcctgggctctgctatccctcaccctcctcactcagggcacagggtcctgggcccagtctgccctgactcagcctgcctccgtgactgggtctcctggacagtcgatcaccgtctcctgctctggctccagtagtgacgtcgtgcttataattttgtcgcctggtaccaacaacaccccggcgaacgccccagactcataatttatgatgtcactgatcggcctcgtagggtttctaatcgcttctctgctccaagtccggcgacacggcctccctgaccatcctccggcctccgaggcggaggacgagggtnattattcgtgcagctactatttacaaccagaccactacccttgccttacgttcggaactcgggaccacggtacacttcgtacctaggtcacggcccgaacggcccaaccccntcgtcacctcgtccgttccccacccctctctacg

SEQ ID NO: 55040 - DNA, 517 bp, Homo sapiens
  misc_feature: GYAE6OF01A7P1M.41.19.B08.1.454.CMB.1.raw
  modified_base (489)..(489): a, c, t, g, unknown or other
  misc_feature (489)..(489): n is a, c, g, or t
tcagtctatactatcacgaccggtgctcgatttagtgagtcagtaaggggtggggtctcaggaggcagcgctctcgggacgtctccaccatggcctgggctctgctatccctcaccctcctcactcagggcacagggtcctgggcccagtctgccctgactcagcctgcctccgtgactgggtctcctggacagtcgatcaccgtctcctgctctggctccagtagtgacgtcggtgcttataattttgcgcctggtaccaacaacaccccggcgaacgccccagactcataatttatgatgtcactgatcggcctcagggtttctaatcgcttctctggctccaagtccggcgacacggcctcctgaccatctccggcctccgaggcggaggacgagggtgattattctgcagctctatttacaaccagccacaccttgctcttcggaactggaccacggtcatcgtctagtcagcccagccaacccnctcgtcactctcgtcccacctcctctac

SEQ ID NO: 55041 - DNA, 629 bp, Homo sapiens
  misc_feature: GYAE6OF01D5MWU.41.19.B08.1.454.CMB.1.raw
  modified_base (311)..(311): a, c, t, g, unknown or other
  misc_feature (311)..(311): n is a, c, g, or t
  modified_base (591)..(591): a, c, t, g, unknown or other
  misc_feature (591)..(591): n is a, c, g, or t
tcagtctatactatcacgaccggtgctcgatttagtgagtcagtaaggggtggggtctcaggaggcagcgctctcgggacgtctccaccatggcctgggctctgctatccctcaccctcctcactcagggcacagggtcctgggcccagtctgccctgactcagcctcgcctccgtgacgtgggtcctcctggacagtcgatccaccgtctcctgctctgctcagtagtgacgtcggtgtctttaattattttgcgcctcggtaaccaacaaccgacccggacgaaccgccccagacctacattaatttangatgtacactgactccggcctgtagggtttctatcgtcttctcgtgctacgacgtccgacgacgtaccgcctccgacgacctacgtcccgtccggcctaccggagggacggaggacggtagggtgtaacttttacgttcgcgcgtacgtcctactaactttaccgaacctacgacctaccgtaccttcgtccttaccgttaccggacgtccgggtaccctacggtctacgtccgtacgtacggtccaccgacccgacgacccctaaccctgtccgtaccnccgttccgttcccgtaccccctcccgttcctggtaacg

SEQ ID NO: 55042 - DNA, 521 bp, Homo sapiens
  misc_feature: GYAE6OF01ETAE0.41.19.B08.1.454.CMB.1.raw
  modified_base (428)..(428): a, c, t, g, unknown or other
  misc_feature (428)..(428): n is a, c, g, or t
  modified_base (490)..(490): a, c, t, g, unknown or other
  misc_feature (490)..(490): n is a, c, g, or t
tcagtctatactatcacgaccggtgctcgatttagtgagtcagtaaggggtggggtctcaggaggcagcgctctcgggacgtctccaccatggcctgggctctgctatccctcaccctcctcactcagggcacagggtcctgggcccagtctgccctgactcagcctgcctccgtgactgggtctcctggacagtcgatcaccgtctcctgctctggctccagtagtgacgtcggtgcttataattttgtcgcctggtaccaacaacaccccggcgaagccccagactcataatttatgatgtcactgatcggcctcagggtttctaatcgcttctctggctcaagtcgcgacacggcctccctgaccatcctccggcctccgaggcggaggacgagggtgtattatttctgcagctcatttacaacngccacaccttgctcttacggactggaccacgtcatcgtctagtcacgccacggcccaacccnctcgcacttctcgttccccaccctctctaac

SEQ ID NO: 55043 - DNA, 737 bp, Homo sapiens
  misc_feature: GYAE6OF01E1IGY.41.19.B08.1.454.CMB.1.raw
  modified_base (121)..(121): a, c, t, g, unknown or other
  misc_feature (121)..(121): n is a, c, g, or t
  modified_base (579)..(579): a, c, t, g, unknown or other
  misc_feature (579)..(579): n is a, c, g, or t
tcagtctatactatcacgaccggtgctcgatttagtgagtcagtaagggtaaagggggttgggtccgaggaggcagaacgtctcgggttgtcctcgaccatagggcccttggattcccgtntacttctccccctcctcgactctcctgcgaccaggctcgtagagggccgcctaatgtagggtttcgacgtacgagtaccttaacgaacgttcgggtcgtacgaggttgtacccccgagggaccaaggacgggccgaaggtactcgaaccgtggtctcgtcggagactggaattgcccaaggctaattttcgtttacttggtaccagcgacgaacgtccgagtcccacggtccctgttagttggtgtagtgtagtaacggaccagtagagtacggaccgtacggaggtacgtcccgtgacgccgtaattacctaccgtaggccgtacgaagtactaaccgaggaacctaggtactcgtacgttggaaccgtacgtacgtacgtcggacgttcccgaggacgaagaacggaaccgaggactacggacttagttagttacgtaccaagacaagtacgaacncgacgtagtacggtaccttacggtacgggttagtaccggggacggggtaccgtaaaggtccgtaccggtaccggtaccggttaagggtacggtacgaccccggtaagggtcccttacccggtaccccgttaccggttccctttacgtcgttaccccgg

SEQ ID NO: 55044 - DNA, 544 bp, Homo sapiens
  misc_feature: GYAE6OF01BKJG5.41.19.B08.1.454.CMB.1.raw
  modified_base (434)..(434): a, c, t, g, unknown or other
  misc_feature (434)..(434): n is a, c, g, or t
  modified_base (505)..(505): a, c, t, g, unknown or other
  misc_feature (505)..(505): n is a, c, g, or t
tcagtctatactatcacgaccggtgctcgatttagtgagtcagtaaggggtggggtctcaggaggcagcgctctcgggacgtctccaccatggcctgggctctgctatccctcaccctcctcactcagggcacagggtcctgggcccagtctgccctgactcagcctgcctccgtgactgggtctcctggacagtcgatcaccgtctcctgctctggctccagtagtgacgtcggtgctttataattttgcgcctggtaccaacaacaccccggcgaagccccagactcataatttatgatgtcactgatcggccctcaggggtttctaatcgcttctctggctccaagtccggcgacacggcctccctgacccatctcccggcctccaggcggaggaccgagggtgattatttctgcagctcatttacaaccngccacaccttgcttcttcggactcgggaccacggtcatcgtcctaggtccagccccaaggccccaaccccnctcgtccaccttctcgttacccccacccttcctctaacg

SEQ ID NO: 55045 - DNA, 674 bp, Homo sapiens
  misc_feature: GYAE6OF01B8UEK.41.19.B08.1.454.CMB.1.raw
tcagtctatactatcacgaccggtgctcgatttagtgagtcagtaaggggtggggtctcaggaggcagcgctctcgggacgtctccaccatggcctgggctctgctatccctcaccctcctcactcagggcacagggtcctgggcccagtctgccctgactcagcctgcctccgtgactgggtctcctggacagtcgatcaccgtctcctgctctggctccagtagtgacgtcggtgcttataattttgcgcctggtaccaacaacaccccgcgaacgccccacgactcataacttatgatgtcactgataccggtccctctaggggtttacttaataccgtcttctctcggctccgaacgtccggccgacgaccggcctccctcgaccaactccgtcccggcccgtcccgtaggggccgggaacgggaacggacgggggttagtaacgtttacgtttcctcggctacggcttaccttaactttaacccgaaaccctacggaacccctaacccttacccttggtccctttaccgttacccgggtaacgttccggggaacccaccggttacgtacttccggttccgtacgggtaccacggaccccgtaaacggacccccaaaccccgtactccggttaccacccgttctccgttaccccgcccttcgtcctaacg

SEQ ID NO: 55046 - DNA, 540 bp, Homo sapiens
  misc_feature: GYAE6OF01CNXT4.41.19.B08.1.454.CMB.1.raw
  modified_base (504)..(504): a, c, t, g, unknown or other
  misc_feature (504)..(504): n is a, c, g, or t
  modified_base (526)..(526): a, c, t, g, unknown or other
  misc_feature (526)..(526): n is a, c, g, or t
tcagtctatactatcacgaccggtgctcgatttagtgagtcagtaaggggtggggtctcaggaggcagcgctctcgggacgtctccaccatggcctgggctctgctatccctcaccctcctcactcagggcacagggtcctgggcccagtctgccctgactcagcctgcctccgtgactgggtctcctggacagtcgatcaccgtctcctgctctggctccagtagtgacgtcggtgcttatattttgcgcctggtaccaacaacaccccggcgaaacgccccagactcataatttatgatgtcactgatcggccctcagggtttctaatcgcttctctgctccaagtccggcgacacggcctcctgaccatctcccgcctccgaggcggaggacgagggtgatttattcgtgcagctcatttacacctagccacaccttcgcttcgttacgaacgtcgggaccacggtcatcgtccgtagtcacgcccgaacgcccaaacccnctcgtacaccttctcgttcccncccttcctctaacg

SEQ ID NO: 55047 - DNA, 574 bp, Homo sapiens
  misc_feature: GYAE6OF01AZSTO.41.19.B08.1.454.CMB.1.raw
  modified_base (424)..(424): a, c, t, g, unknown or other
  misc_feature (424)..(424): n is a, c, g, or t
  modified_base (434)..(434): a, c, t, g, unknown or other
  misc_feature (434)..(434): n is a, c, g, or t
  modified_base (540)..(540): a, c, t, g, unknown or other
  misc_feature (540)..(540): n is a, c, g, or t
  modified_base (561)..(561): a, c, t, g, unknown or other
  misc_feature (561)..(561): n is a, c, g, or t
tcagtctatactatcacgaccggtgctcgatttagtgagtcagtaaggggtggggtctcaggaggcagcgctctcgggacgtctccaccatggcctgggctctgctatccctcaccctcctcactcagggcacagggtcctgggcccagtctgccctgactcagcctgcctccgtgactgggtctcctggacagtcgatcaccgtctcctgctctggctccagtagtgacgtcggtgcttataattttgtcgcctggtaccaacaacacccggcgaacgccccagactcataatttatgatgtcactgactccggccctcgtagggtttctaagtcgtcttctcgtggtctcccgaagtcccggcgaccgaccggccctccctcgaccactcctccggcctccgagggcggaggacggagggtntatttattcngcagctctaattaccaaccacgcccactaccttgccttccgtacggaactcggggaccctaggtcacgtccgtacctaggtccacgcccgaacggccccaaccccntctcaccttctccgttccccnccctcctctaacg

SEQ ID NO: 55048 - DNA, 885 bp, Homo sapiens
  misc_feature: GYAE6OF01C90NP.41.19.B08.1.454.CMB.1.raw
tcagtctatactatcacgaccggtgctcgatttagtgagtcagtaaggggtggggtctcaggaggcagcgctctcgggacgtctccaccatggcctgggctctgctatccctcaccctcctcactcagggcacagggtcctgggcccagtctgccctgactcagcctgcctccgtgactgggtctcctggacagtcgatccaccgtctcctgctctggctccagtagtgacgtcggtgtcttattaagttttcgcgtccgtacggtaaccaacaaccgacccggacgaaccggccccagactactaattaaatttatgaatcgtacactcgacgtccggtaccctaggtagggtttactaacttcgtcttcgtcgtcggccttaccgaaacggtcccggacgtaaccgacccggtccctacccgtacggtaacccacgttccccgtccccgggacccttacccgggaacgggggtcgggaaacggggtaacgggtaaggggttcggttaaactttaacgttttcgtacggaccgtaggtacccttactaaacctttaaacccgaaaccgtaaccgtacccctaaacgttaccccgtttacggttacccgtttaacccgggtttacccgggtaaaacccgggtttcggggaaaacccccgttaaccggggttaccgttaaccggttaccccgggtttaacccgttaaacccgggggttacccaaacccggggttaacccccccgaaaaacccgggtaacccccccggtaaaaaccccccttacggttacccccgggttaccccttaaacccggtttcccccgttttacccccgggtttaacccccccccgtaccccccttttaaccccgttaacgttaaaacccgg

SEQ ID NO: 55049 - DNA, 692 bp, Homo sapiens
  misc_feature: GYAE6OF01DZWO3.41.19.B08.1.454.CMB.1.raw
tcagtctatactatcacgaccggtgctcgatttagtgagtcagtaaggggtggggtctcaggaggcagcgctctcgggacgtctccaccatggcctgggctctgctatccctcaccctcctcactcagggcacagggtcctgggcccagtctcgccctgactcagcctgcctccgtgactgggtctccgtggacagtcgatcaccgtctcctgctctggctccagtagtgacgtcggtgtcttataagttttgcgcctcggtaccaacaaccgacccggcgaacgccccagactacattaatttatgatcgtacacgtgtacgtccggtccctacgtacggggttttactaacgtccgtctttcctcgttcggacctaccgaacgtcccggcgaccgaccggtcctcccgtacgaccctactccgtcccgccgtaccggacgggcgggtacgggacggtagggtcgtatttactttcgcgtcacgctactactttaaccgaaccacgtacccaccttacctcgtacccgttacgtaccggtaacgtccgggtaacccgtacggttcctacgttccgtacccggttacggtaccaacccggaccccgaaacccggacccctaaaaccccgtccgttacgtaccctaaccttcccgttaccccgttacccctacccccttctaccgttaaacgg

SEQ ID NO: 55050 - DNA, 543 bp, Homo sapiens
  misc_feature: GYAE6OF01BU730.41.19.B08.1.454.CMB.1.raw
  modified_base (433)..(433): a, c, t, g, unknown or other
  misc_feature (433)..(433): n is a, c, g, or t
  modified_base (507)..(507): a, c, t, g, unknown or other
  misc_feature (507)..(507): n is a, c, g, or t
tcagtctatactatcacgaccggtgctcgatttagtgagtcagtaaggggtggggtctcaggaggcagcgctctcgggacgtctccaccatggcctgggctctgctatccctcaccctcctcactcagggcacagggtcctgggcccagtctgccctgactcagcctgcctccgtgactgggtctcctggacagtcgatcaccgtctcctgctctggctccagtagtgacgtcggtgcttatattttgtcgcctggtaccaacaacaccccggcgaagccccagactcataatttatgatgtcactgatcggcctcaggggtttctaatcgcttctctggctccaagtccgcacaccggcctccctgaccatctcccggcctccagggcggaggaccgagggtgtattagtttctgcagctcatttacaaccngccacaccttgctcttcggaactcgggacctacggtcactccgtctaggtccaggacccgaaggcccaaccccntcgtccactctccgttccccgcccttccctctaacg

SEQ ID NO: 55051 - DNA, 789 bp, Homo sapiens
  misc_feature: GYAE6OF01CE88B.41.19.B08.1.454.CMB.1.raw
  modified_base (320)..(320): a, c, t, g, unknown or other
  misc_feature (320)..(320): n is a, c, g, or t
tcagtctatactatcacgaccggtgctcgatttagtgagtcagtaaggggtggggtctcaggaggcagcgctctcgggacgtctccaccatggcctgggctctgctatccctcaccctcctcactcagggcacagggtcctgggcccagtctgccctgactcagcctgcctccgtgactgggtctcctggacagtcgatcaccgtctcctgctctggctccagtagtgacgtcggtgtctttaattattttgcgtcctacggtaaccaaacaaccgaccccggacgaaaccgccccaagtacctactaattaaatttacngtaacttgtacacgttaggaccgttcccgggacccttacggtaacggggttttctaaacgttccgtctttcctcgtcggtacctacccgtaacgtcccgggaccgtaccgacccggtccctcccgtacgaccctacgtcccgtcccggccctaccggagggaccgggaacgggacgggtacgggttagtaagtttacgtttcgtgtaccgtagtccttacttaacttaacccaaccgtacgtaccctaaccgtaacctttcgaccgtttaccgttaccggtaaccggtaccgggtaacccgtaccggttacctacgttacccggttacccgtacgggttacccgaaccggtaacccccgtaaaccgggtacccccctaaaaccccgtaccgttacccgttaccccttaacccgtttcccgttacccccgtttaaccccccctacccgtttccccgttaacgttaaaccg

SEQ ID NO: 55052 - DNA, 580 bp, Homo sapiens
  misc_feature: GYAE6OF01EPU1G.41.19.B08.1.454.CMB.1.raw
  modified_base (383)..(383): a, c, t, g, unknown or other
  misc_feature (383)..(383): n is a, c, g, or t
  modified_base (457)..(457): a, c, t, g, unknown or other
  misc_feature (457)..(457): n is a, c, g, or t
tcagtctatactatcacgaccggtgctcgatttagtgagtcagtaaggggtggggtctcaggaggcagcgctctcgggacgtctccaccatggcctgggctctgctatccctcaccctcctcactcagggcacagggtcctgggcccagtctgccctgactcagcctgcctccgtgactgggtctcctggacagtcgatcaccgtctcctgctctggctccagtagtgacgtcggtgcttataattttgtcgcctggtaccaacaacaccccggcgaacgccccagactcataatttatgatgtcactgatcggccctcgtagggtttctaatcgtcttctctggctccaagtccggcacgacggccctccctgacccatccncccggcctccaggcggaggacgagggtgtattatttctgcagcctactactttacaaccacgcccactccttcnctccgtcgaacgtcgggaccacggtcagttccgtccgtacggtccacggaccccgaaacggaccccaacccctacgtacgtcctaccgttccgttcccgttacccccgcccttccctctaacg

SEQ ID NO: 55053 - DNA, 802 bp, Homo sapiens
  misc_feature: GYAE6OF01CBS1R.41.19.B08.1.454.CMB.1.raw
  modified_base (313)..(313): a, c, t, g, unknown or other
  misc_feature (313)..(313): n is a, c, g, or t
tcagtctatactatcacgaccggtgctcgatttagtgagtcagtaagggggtggggtctcaggaggcagcgctctcgggacgtctccaccatggcctgggctctgctatccctcaccctcctcactcagggcacagggtcctgggcccagtctgccctgactcagcctgcctccgtgactgggtctcctggacagtcgatcaccgtctcctgctctggctccagtagtgacgtcggtgtcttatattttcgtcgtccttaggtaaccaacaaccaccccggacgaaccgccccagacctacaattaactttangtatgtcactgacgtccggtcctgtagggtttactaatcgtcttctcgtcggcctaccgaacggtcccggcgacaccggtccctcccgtacgacccacgttccgtcccggtcccgtccgacggggtcgggaacgggtacgggtagggttacgttaagtttcgtttcgtagccgtacgtccgtttacctaactttaacccgaaacccgtacggacccctaaccgttaacccttcgttcccgtttaccggttaaccgggtaaacccgtttccggggaaccccgttaacgggtttacccgaacgtttaccccgggttacccggtttaaacggggtacccccgtaaaccgggtaaccccccggtaaaacccggggtaaccccccctaaaccccccggttacgtttccccgtaaacccgttcccccggtttacccgtttacccccggtttacccccccggtccccccttaccccggtttaacgttaaaacccgg

SEQ ID NO: 55054 - DNA, 624 bp, Homo sapiens
  misc_feature: GYAE6OF01BLBL7.41.19.B08.1.454.CMB.1.raw
  modified_base (301)..(301): a, c, t, g, unknown or other
  misc_feature (301)..(301): n is a, c, g, or t
  modified_base (442)..(442): a, c, t, g, unknown or other
  misc_feature (442)..(442): n is a, c, g, or t
tcagtctatactatcacgaccggtgctcgatttagtgagtcagtaaggggtggggtctcaggaggcagcgctctcgggacgtctccaccatggcctgggctctgctatccctcaccctcctcactcagggcacagggtcctgggcccagtctgccctgactcagcctgcctccgtgactgggtctcctggacagtcgatcaccgtctcctgctctggctccagtagtgacggtcggtgctttataattttgtcgcctggtaccaacaaccaccccggcgaacgccccagactcataatttntgatgtcactgatccggcccttcgtaggggtttctaagtcgtcttctctggctccaaggtccgcgacaccggcctcccgtcgacctactccgtcccggcctccgacgggcgggacgggacggtagggtgtatttactttcncgctacgtctactactttaccaccacgccacctaccgttcgtccttcgttacggaacgtcggggaccacggttccacgtccgtaccgttacggtccgaccggacccgaaccggaccccaaccccgacctaccggtccctaccgttccttaccgtaccccctaccccttccctacgttaaccg

SEQ ID NO: 55055 - DNA, 606 bp, Homo sapiens
  misc_feature: GYAE6OF01CIU63.41.19.B08.1.454.CMB.1.raw
  modified_base (442)..(442): a, c, t, g, unknown or other
  misc_feature (442)..(442): n is a, c, g, or t
  modified_base (452)..(452): a, c, t, g, unknown or other
  misc_feature (452)..(452): n is a, c, g, or t
  modified_base (476)..(476): a, c, t, g, unknown or other
  misc_feature (476)..(476): n is a, c, g, or t
tcagtctatactatcacgaccggtgctcgatttagtgagtcagtaaggggtggggtctcaggaggcagcgctctcgggacgtctccaccatggcctgggctctgctatccctcaccctcctcactcagggcacagggtcctgggcccagtctgccctgactcagcctgcctccgtgactgggtctcctggacagtcgatcaccgtctcctgctctggctccagtgtgacgtcggtgtcttatattttgtcgcctggtaccaacaaccaccccggcgaacgccccagactcattaatttatgatgtcactgatccggcccttcgtaggggttttctaagtcgtcttctcgtcggtcctccgaacggtcccggccgaccgaccggcccttcccgtcgaccctactccgtccccggcctccgacggggcgggaggacggagggtntacttattcngcagtctctaacttaccaaccacnccactacctttgccttacgttcggaaccgtggaccctacggtcacgtcgtccgtaggtccacggcccgaacggcccaaaccccgtctccgtcctaccttcctaccgttacccccacccttccacgtaacg

SEQ ID NO: 55056 - DNA, 655 bp, Homo sapiens
  misc_feature: GYAE6OF01DY2KT.41.19.B08.1.454.CMB.1.raw
  modified_base (425)..(425): a, c, t, g, unknown or other
  misc_feature (425)..(425): n is a, c, g, or t
  modified_base (444)..(444): a, c, t, g, unknown or other
  misc_feature (444)..(444): n is a, c, g, or t
  modified_base (469)..(469): a, c, t, g, unknown or other
  misc_feature (469)..(469): n is a, c, g, or t
  modified_base (514)..(514): a, c, t, g, unknown or other
  misc_feature (514)..(514): n is a, c, g, or t
tcagtctatactatcacgaccggtgctcgatttagtgagtcagtaagggtggggtctcgggaggaggacaggcgctctcgggacgtcgtccaccactcggcctgggcctcgtgcttatcccttcacccttcctcaccttcacggcactagggtccgtgggcccaggttcctggcccctaggaccttcgacgtcctgcccttccggtcgtacgtcgggttcctccgttgggtacgtacgttccgaagtccaaccggttctccttcgcttctcggcctccagtacgtcgaccgtcgtgtcttagtattttcgcgttctaggtaccaacaacgacccggtacgaacgtccccagactcaactaacctttatgaattcgttacacgtgactcggtccctcgtacgggtttcaagttccgtctttccgtntcggcttccgaagtcccgngtacacggccctaccgacgaccctntacgtccgtcctcgaggtccggacgtcgagggtactattacttgngactgtctattactttcaactgccctactacctgtactcgtacgtactggacctagtccgtcgtacggtcgtacggtcaacgtccgaacggtcccaaccgtcacgtcgaaccttcgtacccgtacccctcctcgtgtaccg

SEQ ID NO: 55057 - DNA, 633 bp, Homo sapiens
  misc_feature: GYAE6OF01CJYZ3.41.19.B08.1.454.CMB.1.raw
  modified_base (236)..(236): a, c, t, g, unknown or other
  misc_feature (236)..(236): n is a, c, g, or t
  modified_base (422)..(422): a, c, t, g, unknown or other
  misc_feature (422)..(422): n is a, c, g, or t
tcagtctatactatcacgaccggtgctcgatttagtgagtcagtaaggggtggggtctcaggaggcagcgctctcgggacgtctccaccatggcctgggctctgctatccctcaccctcctcactcagggcacagggtcctgggcccagtctgccctgactcagcctgcctccgtgactgggtctcctggacagtcgatcaccgtctcctgctctgctccagtagtgacgtcggtntcttattattttgcgcctggtaccaacaacaccccggacgaacgccccagactcattaatttatgatgtcactgacgtccggcctcgtagggtttctaatcgtcttctcgtcggctaccacgtccggcgacacggccctcctcgaccacgtcctaccggcctcgagggacggacggacggagggtntagtttatttacgtgctagtcctacgtactttaaccgaaccaccgtccaacctaccttgtcccttacgttaccggaacgtcgggacccacggtctacgtccgtccgtacgtccgtacgaccccgtaacggacccccaaccccgtacgttccgtaccgtaccctttaccggtccccgtttacccccgacccccctttcgtcccgttaaacgg

SEQ ID NO: 55058 - DNA, 678 bp, Homo sapiens
  misc_feature: GYAE6OF01A39B9.41.19.B08.1.454.CMB.1.raw
  modified_base (240)..(240): a, c, t, g, unknown or other
  misc_feature (240)..(240): n is a, c, g, or t
tcagtctatactatcacgaccggtgctcgatttagtgagtcagtaaggggtggggtctcaggaggcagcgctctcgggacgtctccaccatggcctgggctctgctatccctcaccctcctcactcagggcacagggtcctgggcccagtctgccctgactcagcctgcctccgtgactgggtctccgtggacagtcgatccaccgtctcctgctcgtgctcgagtagtcgacgtcggtntctttattagtttgcgtcgtacgtaccaacaaccgacccggacgaaccgccccagacctactaattaactttatgtacttcgtacactcggacgtccggacccttaggtacgggtttctaacgtcgtctttctcgtcggtcctaccgacgtccggccgaacgccggtcctccgtacgaccctacgtcccgtcccgcctccggacgggcggagggacggtagggtactagtttacgttcgagctagtcctaacgttaacttaaccgaaccctacgaccctaacttacccgttgtacccgtttaccggttaccggtaacggttaccgggaacccgttacggttacctacggttacccgttcgtaaccggtccaccggtacccgaaccgtaccccacccgtactcgtccacttcccgttccgtcccctctcccgtataacg

SEQ ID NO: 55059 - DNA, 656 bp, Homo sapiens
  misc_feature: GYAE6OF01B92YY.41.19.B08.1.454.CMB.1.raw
tcagtctatactatcacgaccggtgctcgatttagtgagtcagtaaggggtggggtctcaggaggcagcgctctcgggacgtctccaccatggcctgggctctgctatccctcaccctcctcactcagggcacagggtcctgggcccagtctgccctgactcagcctgcctccgtgtctgggtctcctggacagtcgatcaccgtctcctgctctggctccagtagtgacgtcggtgcttatatttgcgcctggtaccaacaacaccccggcgaacgccccagactcataattatgatgtcactgactccggcctacgtaggggtttctaatcgtcttctctggctaccgaagtcccggcgacgtaccggcctccctgaccctactccgtcccggccctaccgacgggaccggagggaccggtaggggtagtagtttacgtttcgtcgacgtacgaccttcgttaactttaacccgaaacctaccgaccctaacctacccgtttcgacctttaccgttaccgggtaaaccgttcggggaaccctacgggttacctacgtaccgttcctacggtcaccgtaccccgaaccggtccccaaacccccgtctcgtaccctaccttcccgtccgtttacccccaccccttccgtctaaacg

SEQ ID NO: 55060 - DNA, 719 bp, Homo sapiens
  misc_feature: GYAE6OF01DFC2P.41.19.B08.1.454.CMB.1.raw
  modified_base (549)..(549): a, c, t, g, unknown or other
  misc_feature (549)..(549): n is a, c, g, or t
tcagtctatactatcacgaccggtgctcgatttagtgagtcagtaaggggtggggtctcaggaggcagcgctctcgggacgtctccaccatggcctgggctctgctactccctcaccctcctcactcgaggcacagggtcctgggcccagtctgccctgactcagcctgcctccgtgactgggtcctccgtggacagtcgatccaccgtctcctgctcgtggctccagtagtcgacgtcggtgtcttattagttttgccgtctacggtaaccaacgaaccgacccggacgaaccgccccaagtactctaattaaatttacgtagtatcgtactacgtgtaccgtccggcctacggttagggttttacctaacgttccgtcttcgtcgtcggtactaccgaacgtccggaccgtaccgaccgtcccgtccgtacgacccgacgtccgtccccggtaccgtaccgggacggggaccgggaacgggaacgggtacgggttaattacgtttaacgttcgtacgcgtacgtacctactaacttaacccgaaccncgtaccctacgtacccgttcgtaccgttacgttaccggaaccggttacggaaccccttacgggtacctacgtccgttaccgttacgggaccctacggaaccccgtaaccgggacccctaaccccgtagtcctaccgacccttccgtacccgtccccctctcctagtaacg

SEQ ID NO: 55061 - DNA, 630 bp, Homo sapiens
  misc_feature: GYAE6OF01AGN21.41.19.B08.1.454.CMB.1.raw
  modified_base (238)..(238): a, c, t, g, unknown or other
  misc_feature (238)..(238): n is a, c, g, or t
tcagtctatactatcacgaccggtgctcgatttagtgagtcagtaaggggtggggtctcaggaggcagcgctctcgggacgtctccaccatggcctgggctctgctatccctcaccctcctcactcagggcacagggtcctgggcccagtctgccctgactcagcctgcctccgtgactgggtctcctggacagtcgatccaccgtctcctgctctggctccagtagtgacgtcggtncttatattttgcgcctggtaccaacaaccaccccggcgaacgccccagactcataatttatgtatgtcactgatccggtccctcgtagggtttctaatcgtcttctctggcctccgaacgtcccggcgacgaccggtccctccctcgacctactccgtcccggccctccgagggcggaggacggtaggggtagtatttactttcgtcgctagtcttctaactttaccaaccacgccacctaccttcgccttaccgttaccggaacgtccgggaaccctacggtacctacgttccgtccgtaggtaccacgtaccccgaacggaccccaaacccccgtcgtaccgtacctacccgttccgttacccgttaccccctcccttcccgtactaacg

SEQ ID NO: 55062 - DNA, 686 bp, Homo sapiens
  misc_feature: GYAE6OF01B9FPO.41.19.B08.1.454.CMB.1.raw
tcagtctatactatcacgaccggtgctcgatttagtgagtcagtaaggggtggggtctcaggaggcagcgctctcgggacgtctccaccatggcctgggctctgctatccctcaccctcctcactcagggcacagggtcctgggcccagtctgccctgactcagcctgcctccgtgactgggtctcctggacagtcgatcaccgtctcctgctctggctccagtagtgacgtcggtgcttatattttcgtcgcctggtaaccaacaacaccccggcgaacgccccaagacctcaattaatttatgatgtcactgactccggccctgtagggtttacaatcgtcttctctcggctccaagtccggctacgacggtcctcctgacctacgtcctcccggcctacccgaggccggaacgggtacggtagggttgtaagttttacgtttcgtacggtactaacgtccttacgtaactttaacccaaaccgacgtaccctaaccgtaaccctttcgtaccgttaccgtttacgggaaaccgttcgggaacccgtacgggttacctacgttaccggtaccgttaacggtccgtaaccggaacccgtaaaccggacccctaaaccccccgaacttccggtaacctaaccgttcccttacccgttaccccctaccccgttccctcgttaaaccg

SEQ ID NO: 55063 - DNA, 858 bp, Homo sapiens
  misc_feature: GYAE6OF01CX239.41.19.B08.1.454.CMB.1.raw
  modified_base (312)..(312): a, c, t, g, unknown or other
  misc_feature (312)..(312): n is a, c, g, or t
  modified_base (771)..(771): a, c, t, g, unknown or other
  misc_feature (771)..(771): n is a, c, g, or t
  modified_base (785)..(785): a, c, t, g, unknown or other
  misc_feature (785)..(785): n is a, c, g, or t
tcagtctatactatcacgaccggtgctcgatttagtgagtcagtaaggggtggggtctcaggaggcagcgctctcgggacgtctccaccatggcctgggctctgctatccctcaccctcctcactcgagggcacgagggtccgtcgggcccagtctcgccctgactcagcctgcctccgtgacgtgggtctccgtggacagtcgatccaccgtctctcgctcgtcggcctaccgaagtaggtgtacggtcggtgtacttattaacgttttgccgtcgtacggtaacccaaacgaaccgacccggacgaaccnccccgaagtacctactaactttaaacgtttagtacgtactacgtccaacgtcgaacgttcccggaccgtttacgggttaagggttttacctaacgtttccgttaccgtttaccgttcgttacggtacccttaaccggtaaccgggttacccgggaccgtaacccgtaccccggtacccccgttacccgttaaccggaccccgttaacgttcccccggtaccccgggtaccccgttaccgggaaccggggggaaccgggtaacgggggtaacgggttacggggtacgtttaaacgttttctttcggtacggtaaccgtcgttaaccgttactaaaccgtttaaccaacccggtaacgttaccctaaccttaccgtttacggtccgtttaaccggtaaccgggtaaccgtccgggaacccgtacggttacctacggttccgttaccggacgtccggaaccncccgggtaaaaccnccccgtaaaccctaccggccgttaaccacgttaccccgttccggttacccccactttcccgtagttaaaccgg

SEQ ID NO: 55064 - DNA, 748 bp, Homo sapiens
  misc_feature: GYAE6OF01BJQC1.41.19.B08.1.454.CMB.1.raw
tcagtctatactatcacgaccggtgctcgatttagtgagtcagtaaggggtggggtctcaggaggcagcgctctcgggacgtctccaccatggcctgggctctgctatccctcaccctcctcactcagggcacagggtcctgggcccagtctgccctgactcagcctgcctccgtgactgggtctcctggacagtcgatcaccgtctcctgctctggctccagtagtgaccgtcggtgtctttattaattttgcgcctggtaccaacaaccaccccggcgaacgcccccagacctcattaatttatgatgtcactgactccggcctcgtagggtttctaatcgtcttctcgtcgctccaacggtccggcgacgaccggtccctcccgtgaccctacttccgtcccggtccctacccggacgggaccgggaacgggaccgggtagggggttagttaacgttttacgttttcgtacggtaccgtacggttccttacgttaaaccgttttaacccaaacccgtaaccgacccctaaccctaccctttcggtccctttaccggtttaccgggaacccgttccgggggaacccttacccggttaccgtaccgttacccggttcccttaacgggttacccaaccggtaccccccgaaacggggtaccccccaaacccccgtccgttacgttaccccgtaccgtttacccgtttccccggttaccccccgttccccttcccgttccgtaaaccgg

SEQ ID NO: 55065 - DNA, 593 bp, Homo sapiens
  misc_feature: GYAE6OF01AVIKI.41.19.B08.1.454.CMB.1.raw
  modified_base (238)..(238): a, c, t, g, unknown or other
  misc_feature (238)..(238): n is a, c, g, or t
  modified_base (414)..(414): a, c, t, g, unknown or other
  misc_feature (414)..(414): n is a, c, g, or t
  modified_base (424)..(424): a, c, t, g, unknown or other
  misc_feature (424)..(424): n is a, c, g, or t
tcagtctatactatcacgaccggtgctcgatttagtgagtcagtaaggggtggggtctcaggaggcagcgctctcgggacgtctccaccatggcctgggctctgctatccctcaccctcctcactcagggcacagggtcctgggcccagtctgccctgactcagcctgcctccgtgactgggtctcctggacagtcgatcaccgtctcctgctctggcctccagtagtgacgtcggtncttataatttgcgctgtaccaacaacacccggcgaacgccccagactcaataatttatgtatgtcactgatcggccctgtagggtttctaatcgcttctctggcctaccgaacgtccggcgacaccggtcctcccgtgacccatccgtccggcctcgaggcggaggacgtagggtntattattcgngcacgctacgtacttacaaccgtagcccactaccttcgaccttacgttacggaacgtcggaccctacggtactacgtccgtacctaggtaccaccgacccgaaccggaccccaaaccccgtctaccgtaccaccgtccgttacccgttcccccgcccttcctactaacg

SEQ ID NO: 55066 - DNA, 677 bp, Homo sapiens
  misc_feature: GYAE6OF01BX7OC.41.19.B08.1.454.CMB.1.raw
  modified_base (237)..(237): a, c, t, g, unknown or other
  misc_feature (237)..(237): n is a, c, g, or t
tcagtctatactatcacgaccggtgctcgatttagtgagtcagtaaggggtggggtctcaggaggcagcgctctcgggacgtctccaccatggcctgggctctgctatccctcaccctcctcactcagggcacagggtcctgggcccagtctgccctgactcagcctgcctccgtgactgggtctcctggacagtcgatcaccgtctcctgctctggctccagtagtgacgtcggtntctttataattttgcgtcctaggtaccaacaaccgaccccggacgaacgccccagactctaataatttatgatgtcactgactccggtccctcgtaggggtttactaagttcgtcttctcgtcggtctaccgtaaggtcccggacgaccgaccggtcccttaccctacgacctacgttccgtccccggtccctccgacgggcgggaacggtacgggtagggtagtaagtttactttcgtgtactacgtctacgttactttaaaccaacccgtacgaccctaacctaccgttcgtccttaccggttacggaaccgttacgggaacccgtacggtcctacttccgttacccgtagtacccgaaccgcccgaaaccggacccctaaacccgtcgtccgttacaccgttcccttcccgttacccccgtcccttccctcgtaacg

SEQ ID NO: 55067 - DNA, 761 bp, Homo sapiens
  misc_feature: GYAE6OF01BLJX3.41.19.B08.1.454.CMB.1.raw
tcagtctatactatcacgaccggtgctcgatttagtgagtcagtaaggggtggggtctcaggaggcagcgctctcgggacgtctccaccatggcctgggctctgctatccctcaccctcctcactcagggcacgagggtcctgggcccagtctgccctgactcagcctgcctccgtgacgtgggtcctccgtggacagtcgactcaccgtctcctgcctctcggctaccgagtagtcgacggtcggtgtactttaattagttttcgccgtcgttacggtaacccaaaccgaacccgaccccggaccgaaccgccccaagtacctactaattaaatttagtagacttgtacctacgtagtaccgtccgtaccgtacggtacgggtttactaacgtcgtacctttcgtccgtcggtacctaccgtaacggtcccggacgtaccgtaccccggtaccccttcccgtaccgaccctacgtcccgtccccggtaccgtacccggacggggtaccgggaacgggtaaccgggtaagggttacgttaacgttttacgttcgacggtccgtacgtacctttaacgttaaaccgttaacccgaaccgtacctaaccctaccgtaccgttcgtccttaccggtaccggtaacggtaccggaccgtacgtacgtacgttcccgtacgtacggtaccaaccggacccgaacgacccctacccgtacgtccgtacctaccgttccgtaccccttacccgccctacgtctaacgg

SEQ ID NO: 55068 - DNA, 1040 bp, Homo sapiens
  misc_feature: GYAE6OF01ETK2Y.41.19.B08.1.454.CMB.1.raw
tcagtctatactatcacgaccggtgctcgatttagtgagtcagtaaggggtggggtctcaggaggcagcgctctcgggacgtctccaccatggcctgggctctgctatccctcaccctcctcactcagggcacgagggtcctgggcccagtctgccctgactcagcctgcctcgtgacgtgggtctccgtggacagtcgatcgaccgtctcctgctcgtggctccgagtagtcgacggttcggtgtactttaatttaacgttttcggtaccgtccgttacggtaaacccaaaccgaaacccgaacccccgggacgaaacccgcccccgtaaggtaaccttacctaaacttttaaactttttaacgtcggtaacgtttacggttaacctaaccgttaggtaacccggttcccgggttaccccgtttacgggttaacgggggtttttacctaaaccggtttccggttccttttccgttccgtacggggtacccttaacccgggtaaacgggtccccgggacggtaaccccggtacccggttccccgttaccccgtacgtaaccccgttaccgtttccccggttccccgggtacccgttaacccgggaacgggggtacccgggggtaaaccggggtaaccgggggttaagggggtttacgttttaaaccgtttttacggtttttacccgtacgggtaaccgttaaccgggttcccgtttaaacccgtttaaaccgtttttaaaacccccgggaaacccctacccggtaaccccgtaaaccctttacccgttttcggtaacccgttttaacccggttaacccggggtaaccggtttaccccggggaaacccggttaaccgggttaccctaaccgggtttccccgggtttaacccggtaacgggtttaccccggaaacccgtaaacccccgggtaaacccgaccccccgttaaaccccgttacggttacccgtaccccttacccgtttaccccgttaccccggtttaacccccccacccgtttacccgtaccggtttaaaaccgg

SEQ ID NO: 55069 - DNA, 911 bp, Homo sapiens
  misc_feature: GYAE6OF01CJODP.41.19.B08.1.454.CMB.1.raw
tcagtctatactatcacgaccggtgctcgatttagtgagtcagtaagggatggggtctcaggaggcagcgctctcgggacgtctccaccatggcctgggctctgctatccctcaccctcctcactcagggcacagggtcctgggcccagtctgccctgactcagtcctgcctccgtgacgtcgggtctccgtggacagtcgactcaccgtctcgtcgctcgtcggcctaccgtaggtacggtcggtacggtcgggtatactttagttaacgtttttcggaccgtccgtacggtaaccaaaccgaaccgtaccccggacgtaaccgcccccgtaagtaccgttacgtaaattaacgtttacgtacgtaacttacgtacctacgttagacccgttcggtaccccgttaggttaacgggttttacctaacgttcggttccttccggttccgtacgtcccgtaacgtacggttcccggaacgtaccgtacccgggtccctacccgtacgtacccgttcgttcccgtacccggacctaccgggtaaccgggtacgggtaacgggacgggttaacggggtatttaaccggttttacgttaccggtaacggtccgtaacgttaccgttaacgttaaaccttaacccgggtaacctacccgggttaacccttaaccccgttacggttttccggtaccccgtttacggggttaacccgggtaacccgtttaccggggacccttaaccggggttacctaaccgtttccccgggtaccgttaaaccgggtacccgtaaacccggtaaccccggtaacccggtaaacccccgtaaccccgttcggttaacccggttaccccgtaacccggttttacccttaccccgggtttccccccggtaccctttaaccggttaaacccgg

SEQ ID NO: 55070 - DNA, 691 bp, Homo sapiens
  misc_feature: GYAE6OF01ELKRG.41.19.B08.1.454.CMB.1.raw
  modified_base (227)..(227): a, c, t, g, unknown or other
  misc_feature (227)..(227): n is a, c, g, or t
  modified_base (296)..(296): a, c, t, g, unknown or other
  misc_feature (296)..(296): n is a, c, g, or t
  modified_base (374)..(374): a, c, t, g, unknown or other
  misc_feature (374)..(374): n is a, c, g, or t
tcagtctatactatcacgaccggtgctcgatttagtgagtcagtaaggggtgggtctcaggaggcagcgctctcgggacgtctccaccatggcctgggctctgctatccctcaccctcctcactcaggcacagggtcctgggcccagtctgccctgactcagcctgcctccgtgactgggtctccgtggacagtcgatcaccgtctcctgctctggcctccgagtancgtacgtcgtgctttataatttgcgctcggtaccaacaccacccggcgacgcccagactcataatttangtatgtacatgacgtccggcctcgtagggtttactaacgtcgtcttctcgtcgtcctaccgaacggtcccgacgaccnccggtccctcctcgaaccctacgttcccgtcccggtccctaccggagggacgggacggtacggtaggtacgttatttagttcgcgacgacgtctaccgttaacttaccaaccgacgaccctaacctaccgtcgtccgtttaccgttaaccgggaaccgtaccgggtaaccctacggtacctacgttacccggttaccgtacggttccaaacccggtaccccgaaaccggtacccccgtaaaacccctcgttaccggtacccttaacccgttccccgtttacccgttaacccccctaccccttaaccgttacgtaacg

SEQ ID NO: 55071 - DNA, 617 bp, Homo sapiens
  misc_feature: GYAE6OF01AGQV2.41.19.B08.1.454.CMB.1.raw
  modified_base (228)..(228): a, c, t, g, unknown or other
  misc_feature (228)..(228): n is a, c, g, or t
  modified_base (445)..(445): a, c, t, g, unknown or other
  misc_feature (445)..(445): n is a, c, g, or t
  modified_base (480)..(480): a, c, t, g, unknown or other
  misc_feature (480)..(480): n is a, c, g, or t
tcagtctatactatcacgaccggtgctcgatttagtgagtcagtaaggggtggggtctcaggaggcagcgctctcgggacgtctccaccatggcctgggctctgctatccctcaccctcctcactcagggcacagggtcctgggcccagtctgccctgactcagcctgcctccgtgactgggtctcctggacaggtcgatcaccgtctcctgctctggctccagtagngacgtcggtgctttatattttgcgcctggtaccaacaaccgaccccggcgaaccgccccagactcaattaatttatgatcgtcactgactccggccctcgtaggggtttctaacgtcgtctttctcgtcggcctaccgaacgtcccggaccgacgtaccggccctcccgtacgaccctactccgtcccgccctccgacgggcggaggcggtagggtntagttactttcgagctagctactactttacaaccncgacctactaccttcgcttcgttacggaaccgtcggacctacggtctacgtccgttaccgaggtccaccgacccgaccgaccccaacccgtctaccgtcctaccttacccgtcccttccccgcccttcctacttacg

SEQ ID NO: 55072 - DNA, 594 bp, Homo sapiens
  misc_feature: GYAE6OF01BNYJP.41.19.B08.1.454.CMB.1.raw
  modified_base (237)..(237): a, c, t, g, unknown or other
  misc_feature (237)..(237): n is a, c, g, or t
  modified_base (251)..(251): a, c, t, g, unknown or other
  misc_feature (251)..(251): n is a, c, g, or t
  modified_base (581)..(581): a, c, t, g, unknown or other
  misc_feature (581)..(581): n is a, c, g, or t
tcagtctatactatcacgaccggtgctcgatttagtgagtcagtaaggggtggggtctcaggaggcagcgctctcgggacgtctccaccatggcctgggctctgctatccctcaccctcctcactcagggcacagggtcctgggcccagtctgccctgactcagcctgcctccgtgactgggtctcctggacagtcgatcaccgtctcctgctctggctccagtagtgacgtcggtncttataattttgcncctggtaccaacaaccaccccggcgaacgccccagactcataatttatgatgtcactgatcggccctcgtaggggtttctaacgtcgtcttctctggtcctccgaacggtcccggacgacgaccggccctcccgtcgaccactcgtcccggcctccgacgggcggacgggacggagggtgtattactttctgcagtcctacgtactttaccaaccacgacccactaccttgccttcgttacggaaccgtcgggaccctacggtactacgtcgtccgtacggtccaccgacccgaacggcccaaccctctcgtcacttcctccgtaccccnccctcctctaacg

SEQ ID NO: 55073 - DNA, 712 bp, Homo sapiens
  misc_feature: GYAE6OF01BS62A.41.19.B08.1.454.CMB.1.raw
tcagtctatactatcacgaccggtgctcgatttagtgagtcagtaaggggtggggtctcaggaggcagcgctctcgggacgtctccaccatggcctgggctctgctatccctcaccctcctcactcagggcacagggtcctgggcccagtctgccctgactcagcctgcctccgtgactgggtctcctggacagtcgatcaccgtctcctgctctggctccagtagtgacgtcggtgcttataatttgcgcctgtaccaacaacacccggcgaacgcccagactcatattatgatgtcactgactccggcctcgtaggggtttactaacgtcgtctttctctcggtcctccgtaacggtcccgggaccgtaccaccgggcccttcccgtcgaccctactccgtccccggccctccggacggggccgggaacgggaaccgggtacggggtagtaagttttacgtttcgtcggtctacggtcgttaccttaactttaaccgaaccacgtaccctaccttaacccgtttcgcctttaccgttaccggggaaccgtacggggtaaccctaccgggttacctaacgttccggttccgtaacggttccgaaccggtaccccgaaaccggtaaccccctaaacccccgtacgttaccgtacccctaaccgtttcccgttacccggttaacccccctaccccttcccgtcccttaaaccg

SEQ ID NO: 55074 - DNA, 759 bp, Homo sapiens
  misc_feature: GYAE6OF01DEPR4.41.19.B08.1.454.CMB.1.raw
tcagtctatactatcacgaccggtgctcgatttagtgagtcagtaaggggtggggtctcaggaggcagcgctctcgggacgtctccaccatggcctgggctctgctatccctcaccctcctcactcagggcacagggtcctgggcccagtctgccctgactcagcctgcctccgtgactgggtctcctggacagtcgatcaccgtctcctgctcgtggcctccagtagtcgacgtcggtgtactttattatttttcgcgtcctggtaaccaacaaccgaccccggacgaaccgccccagactcaattaatttatgatcgtcatcgactccggcctcggttacgggtttactatcgtcttctcgtcgctaccgaagtcccggacgaccacggccctccgtcgaccgtactccgtaccgtcccgtaccggagggtaccggggaaggggtacccggtaggggttacgttaacgttttacgttttcgtacggacttacggtaccctttaccgttaaacttttaaccccgaaaccctaaccgtaccccgtaacccgttacccgttttcgacccgtttacccggtttaacccgggtaacggttaccggggaaccccgtaccggtttccgaaccgttttcccggtacccggttaacggtaccgtaacccgaccccggtaaaccggacccccctaaacccctaccgttacccgtaccctacccgtttcccgttacccgtttaccccccaccccttcctaccgtaacg

SEQ ID NO: 55075 - DNA, 763 bp, Homo sapiens
  misc_feature: GYAE6OF01CR63L.41.19.B08.1.454.CMB.1.raw
tcagtctatactatcacgaccggtgctcgatttagtgagtcagtaaggggtggggtctcaggaggcagcgctctcgggacgtctccaccatggcctgggctctgctatccctcaccctcctcactcagggcacagggtcctgggcccagtctgccctgactcagcctgcctcgtgacgtgggtctccgtggacagtcgactcaccgtctctgctcgtggctccgtagtgtcgacggttcggtgtactttaagttaagttttcggccgtccgttacggtaaaccctaaaccgaacccgaacccccgggacgaaacccgacccccgaacggtaccttactaacttaaacttttaagtacggtaacttcgttaccaacgttcgtacgtacccggttacccgttacggtttaacgggttttacctaacgttccggttaccgttccttacgtcggtacccgtaccgtaaccgggtacccggaccgtaaccgacccggtcccctaccgtaccggaacctaccgttcccgtacccggtccctaccgggacggggaccggaacggggacggtagggttacgtaagttttacgttcgtacgctaacgtcgttactaacttacccgaacctacgaccctaccgtaccgttacgtaccgttacgtacggtaccgtacggtaccgacgttacgacgttcgtacgttcgacgacgacccgaccgacccacctactcgtacctacgttccctacccgtaccctccctcgtagtaacg

SEQ ID NO: 55076 - DNA, 669 bp, Homo sapiens
  misc_feature: GYAE6OF01EN6PC.41.19.B08.1.454.CMB.1.raw
  modified_base (235)..(235): a, c, t, g, unknown or other
  misc_feature (235)..(235): n is a, c, g, or t
  modified_base (297)..(297): a, c, t, g, unknown or other
  misc_feature (297)..(297): n is a, c, g, or t
tcagtctatactatcacgaccggtgctcgatttagtgagtcagtaaggggtggggtctcaggaggcagcgctctcgggacgtctccaccatggcctgggctctgctatccctcaccctcctcactcaggcacagggtcctgggcccagtctgccctgactcagcctgcctccgtgactgggtctcctggacagtcgatcaccgtctcctgctctggctcagtagtgacgtcggtnctttataattttgcgcctggtaaccaacaaccacccggcgaacgccccagactcataatttntgatgtcactgactcgcctgtacgggtttctaagtcgtcttctctggctccgaagtccggcgacacggcctcctgacccatcctccggcctaccgacgggtccgggaggaccggtaggggttacgtattttacgtttcctgtcacgttctaccgtaattttaacccaaaccctacgtacctaaccgtacctttacgcctttaccgttacgggtaacgttccggggaaccgtaaccggttcgaacgtttccggtacccgttaaggtccgaacggtacccccggtaacggtacccccaaacccccgtcgttaccgtctaaccccgtttccgttacccggttacccccctaccccgttcccttacccgtaaacgg

SEQ ID NO: 55077 - DNA, 664 bp, Homo sapiens
  misc_feature: GYAE6OF01AS4ES.41.19.B08.1.454.CMB.1.raw
  modified_base (235)..(235): a, c, t, g, unknown or other
  misc_feature (235)..(235): n is a, c, g, or t
  modified_base (270)..(270): a, c, t, g, unknown or other
  misc_feature (270)..(270): n is a, c, g, or t
tcagtctatactatcacgaccggtgctcgatttagtgagtcagtaaggggtggggtctcaggaggcagcgctctcgggacgtctccaccatggcctgggctctgctatccctcaccctcctcactcagggcacagggtcctgggcccagtctgccctgactcagcctgcctccgtgactgggtctcctggacagtcgatcaccgtctcctgctctggctcagtgtgacgtcggtncttatattttgcgctggtaccaacaaccgcccggnacgcccagactcataattatgatgtcactgactccggcctggtacgggtttctaagtcgtcttctcgtcggcctaccgaacgtcccggacgaccgaccggtccctcccgtacgacctacgtcccgtacccgcccgttaccgacgggaccgggaggtaaccgggtaggggttacgtacgttttactttcgtcgaccgtaacggtcttaccttacgtttaaaccaacccgacgtaccctactacccgtttgccttacgttaccggaacgttccgggacctacggtcctacgttccgtacgtacggtccaaccggacccgtaaccgggacccctaacccgtcgttacgtccctaaccgttccgttccctacccccgtacccttcccgtgtaaaccgg

SEQ ID NO: 55078 - DNA, 643 bp, Homo sapiens
  misc_feature: GYAE6OF01EVAWN.41.19.B08.1.454.CMB.1.raw
  modified_base (313)..(313): a, c, t, g, unknown or other
  misc_feature (313)..(313): n is a, c, g, or t
  modified_base (463)..(463): a, c, t, g, unknown or other
  misc_feature (463)..(463): n is a, c, g, or t
tcagtctatactatcacgaccggtgctcgatttagtgagtcagtaaggggtggggtctcaggaggcagcgctctcgggacgtctccaccatggcctgggctctgctatccctcaccctcctcactcagggcacagggtcctgggcccagtctgccctgactcagcctgcctccgtgactgggtctcctggacagtcgatccaccgtctcctgctctggctccagtagtgacgtcggtgctttattaattttgtccgtcctaggtaaccaaaccaaccgaccccggcgaacgccccagacctcaattaatttangatgtcactgactccggccctgtacgggtttctaagtcgtcttctcgtggtcctccgaagtcccggcgaccgaccggtccctcccgtagaccctactccgtcccggccgtccgagggccggaagggacggagggttatattttctttcgngcacgtccttactaactttaaccaaccgacgaccccaactacccttgtacccgttaccgttaccggaaccgtcgggaaccctacggtactacgttccgtaccgttacggtccacgaccccgaacggaccccaaccctctacgtccaccgttccttcccgttcccctcccttcctctaacg

SEQ ID NO: 55079 - DNA, 812 bp, Homo sapiens
  misc_feature: GYAE6OF01CT77Y.41.19.B08.1.454.CMB.1.raw
  modified_base (792)..(792): a, c, t, g, unknown or other
  misc_feature (792)..(792): n is a, c, g, or t
tcagtctatactatcacgaccggtgctcgatttagtgagtcagtaaggggtggggtctcaggaggcagcgctctcgggacgtctccaccatggcctgggctctgctatccctcaccctcctcactcgagggcacgagggtcctgggcccagtctcgccctgactcagcctgcctcgtgacgtgggtcctccgtggactagtcgatccaccgtctcctgctcgtgacctccgtagtacggtcgacggtcggtactatttaagtttacgttttcggccgtaccgttacggtaaacccaaaccgaaccgacccccgggacgaacccgaccccgagtaaccttactaattaagtttacgtacggtacttcgtaccacgttacgtaaccgttcccggtccgttacggtttaacgggtttaccttaacgtccggtcctttcgtcgttcggtacctacccgtaacggtccggacgtaaccgcccgtcccttccgactacctcgttcccgtccgtaccgccggacgggacgggaacggtacgggtagggttacttaacgttttacgtgtacggacacggttccttaacgttaaaccttaacccgaacccgtacggtaccctaaacccgtttaccggtttctacccgtttaacgggttaacccgggtaacgtccccgggtaaccgttaccggtaacctacggttccgtaacccggttacggaccccgttacggaaaccccgtaaaccggtaacccccaccttccgttacgtacccttctacccccggtttcgttacccccncccgtaacttcttaaacggg

SEQ ID NO: 55080 - DNA, 788 bp, Homo sapiens
  misc_feature: GYAE6OF01BC6XK.41.19.B08.1.454.CMB.1.raw
  modified_base (316)..(316): a, c, t, g, unknown or other
  misc_feature (316)..(316): n is a, c, g, or t
tcagtctatactatcacgaccggtgctcgatttagtgagtcagtaaggggtggggtctcaggaggcagcgctctcgggacgtctccaccatggcctgggctctgctatccctcaccctcctcactcaggcacagggtcctgggcccagtctgccctgactcagcctgtctccgtgactgggtctcctggacagtcgatcaccgtctcctgctcgtggcctccagtagtcgacgtcggtgtacttattaattttcgacgtctaggtaccaactaaccgaccccggacgaacgccccaagacctactattaactttanagtattcgtacactgactccggtccctcgttagggtttactaagttccggtcctttacgtcgtcggtacctaccgtaaacggtcccggaccgaaccgtaccggtcccttacccgtacgtacccgtacgttcccgtacccggtaccctaccggacgggaccgggtaacgggtacgggtaggggttacgttactttacgtttccgtcggaccgtacgtcccttaacgttaactttaaaccgaacccgtaacgtaccctaacctacctttcggtaccctttaccggttaacccggtaaacggttccgggtaacccgtacgggttaccctaccgttacccgggttaacccgttacgggttaaaccccgaaaccccggtaacggtacccccctaaaccccgtacgttacccggtaccctaccgttccccgttacccgttacccccgtacccctttccttaaccgtacgttaaaccgg

SEQ ID NO: 55081 - DNA, 762 bp, Homo sapiens
  misc_feature: GYAE6OF01D4IG2.41.19.B08.1.454.CMB.1.raw
  modified_base (240)..(240): a, c, t, g, unknown or other
  misc_feature (240)..(240): n is a, c, g, or t
  modified_base (751)..(751): a, c, t, g, unknown or other
  misc_feature (751)..(751): n is a, c, g, or t
tcagtctatactatcacgaccggtgctcgatttagtgagtcagtaaggggtggggtctcaggaggcagcgctctcgggacgtctccaccatggcctgggctctgctatccctcaccctcctcactcagggcacagggtcctgggcccagtctgccctgactcagcctgcctccgtgactgggtcctcctggacagtcgatcaccgtctcctgctcgtcggctccagtagtgacgtcggtntcttattatttcgcgcctaggtaccaaacaaccgaccccggacgaacgccccagacctacctattaaactttatagattcgtctacgtagacgtccggtcctcgtagggttttctaaagttccgtctttctacgtcggtccgtaccaacggtcccggaccgaccgacccggtccctccccgtacggaccctaacgttcccgttccccggcccgttacccgaacgggggtaccgggtaacgggaaaccgggtaacgggggttgttaaacgttttagttttccgacggtaccgaaccggttccttaacgttaaacttttaacccgaaacccgaacgtacccaaccttacccgttcgtcctttacccggttacggtaaccgtacggggtaacccgtaccggtactacgttcccgttccggttaacggtcccgaaccgtaccccgaaacggacccccaaaccccgtacgttccgtacctacccgttccttacccgttaccccctccccgttaccnccgttaaacgg

SEQ ID NO: 55082 - DNA, 727 bp, Homo sapiens
  misc_feature: GYAE6OF01CRLXH.41.19.B08.1.454.CMB.1.raw
  modified_base (249)..(249): a, c, t, g, unknown or other
  misc_feature (249)..(249): n is a, c, g, or t
tcagtctatactatcacgaccggtgctcgatttagtgagtcagtaagggggtggggtctcaggaggcagcgctctcgggacgtctccaccatggcctgggctctgctatccctcaccctcctcactcagggcacagggtcctgggcccagtctgccctgactcagcctgcctccgtgacgtgggtcctccgtggacagtcgatccgaccgtcctcctgctcgtggcctccgagtagtcgacggtcggtntactttaattattttcgcgccttacggtaaccaaaccaaccgaccccggacgaaccggccccagaacctcattaacttatgattcgtcacgtgatccggcctcggtacgggtttactaatcgtctttctcgtcggcctccgtaacggtccggaccgaccgtacccggtccctacccgtacgaccctactccccgtcccggtccctaccggacggggaccgggtacgggaaccggtaggggttacgttatttacttttcggcgacgtacgtaccttacgttaacgtttaacccaacccgacgtaaccctacccgttaaccgtttcggtacccttacggttaacccgggtaccgttacggggacccgtaacggtctacggttcccggttaccgtacggtcccacggaccccgtaaaccgcccctaaacccgtcgttccgtacccaccttccgttcccgtccccctccctccgtctaaacg

SEQ ID NO: 55083 - DNA, 673 bp, Homo sapiens
  misc_feature: GYAE6OF01A7P2R.41.19.B08.1.454.CMB.1.raw
  modified_base (430)..(430): a, c, t, g, unknown or other
  misc_feature (430)..(430): n is a, c, g, or t
tcagtctatactatcacgaccggtgctcgatttagtgagtcagtaaggggtgggggtctcaggaggcagcgctctcgggacgtctccaccatggcctgggctctgctatccctcaccctcctcactcagggcacagggtcctgggcccagtctgccctgactcagcctgcctccgtgactgggtctcctggacagtcgatcaccgtctcctgctctggctccagtagtgacgtcggtgtacttattattttgcgcctaggtaccaacaacaccccggcgaacgccccagactcataaatttatgatgtcactagactcggccctgtacgggtttataactcggctttctctggtcctacctaacgtccggcgtacaccggtccctcccgtcgacccgatccgtcccggcctccgacgggcggaggacggngggtcgtatttacgtttcgtcgacgtacgtcctacgtaactttaaccaacctacggaccctaacctacccgtttcgcctttaccggttaccggaaccgtcgggtacccgtaacggtctacgttcccggttaccgtagggtacccaaccggtaccccgtaaaccgggccccctaaaccccgtaccgttacggtaccctacctcccgttacccggttacccccctcccttccccgtcgttaaacg

SEQ ID NO: 55084 - DNA, 772 bp, Homo sapiens
  misc_feature: GYAE6OF01CUKI6.41.19.B08.1.454.CMB.1.raw
  modified_base (211)..(211): a, c, t, g, unknown or other
  misc_feature (211)..(211): n is a, c, g, or t
  modified_base (325)..(325): a, c, t, g, unknown or other
  misc_feature (325)..(325): n is a, c, g, or t
  modified_base (333)..(333): a, c, t, g, unknown or other
  misc_feature (333)..(333): n is a, c, g, or t
  modified_base (341)..(341): a, c, t, g, unknown or other
  misc_feature (341)..(341): n is a, c, g, or t
tcagtctatactatcacgaccggtgctcgatttagtgagtcagtaaggggtggggtctcaggaggcagcgctcgtcgggacgtctccaccatggcctgggctctgctactccctcaccctcctcactcgagggcacagggtcctcgggcccagtctcgcctgactcacgcctgcctcgtgacgtgggtcctccgtggacaggtccgactcnccgtctcctgcctcgtcggcctacctaggtcgtacggacggtcgtcgtactttaattattttcggcgtccgtaggtaacccaacgaccgacccggacgaaccgcccagacctanattaattngatcgtancgtgacgtccgtctaggtaggtttacaatcgtacttctgttcggcttaccgaaggtcccgacgacccacggcccttccgtacgtaccctacgtccggttaccccgccgtaacgacggggacggggaacggtacggtagggttacttaagtttacgtttcgagacggtataccgtaacgtttaaccgtaaaccaccggtaacctaccccgtaaagtttcccgttacggtaccccggtttcttaaacccggggaacggtacccggggaaccggtttacgtaccgttacggttaccccgggtttaacgtaaccgggtacccctaaaccccgggtaacccgaaacccggtaccccctaaacccgttaccgccggttaaccccttacgtccccggtttaaccccgtcccccggaccctttaacgtcccgtaaaagg

SEQ ID NO: 55085 - DNA, 861 bp, Homo sapiens
  misc_feature: GYAE6OF01CZ32S.41.19.B08.1.454.CMB.1.raw
  modified_base (156)..(156): a, c, t, g, unknown or other
  misc_feature (156)..(156): n is a, c, g, or t
  modified_base (224)..(224): a, c, t, g, unknown or other
  misc_feature (224)..(224): n is a, c, g, or t
  modified_base (832)..(832): a, c, t, g, unknown or other
  misc_feature (832)..(832): n is a, c, g, or t
  modified_base (844)..(844): a, c, t, g, unknown or other
  misc_feature (844)..(844): n is a, c, g, or t
tcagtctatactatcacgaccggtgctcgatttagtgagtcagtaaggggtggggtctcaggaggcagcgctctcgggacgtctccaccatggcctgggctctgctactccctccaccctcctcactcgacgggcacgtggggtccgtcgggcccngtcgtcgccctagactcgacgcctcgcctacgtgacgtcgggtcctcgtaggacgtacgtcgactccnccgttcctccgtgtcctcgtcggtacctcgtaggtacggtacggtccggttcggttacgttagttttagttaagtttttccggaccggttcccggttaacggtaaaacccccaaaccggaaacccccgtaaccccggggaaccggtaaccccgtacccaagtaacccttactaaatttaaaactttttcgaggtcttacggtaacctcggtacgtaccggtaccggttccgttaacgggttacgggtttaacttacggtccttcgtttccgcgtcggtacccgttacgacccgggttaccggccgtaacccggtctcccttacgacctacggtcctccccggtacggcccgtcgggacggggacggggtacggtacgggttagggtaacttacgttcccggtttcgacggtccgttaaacgtcgttaaacctttaaacgaaaccctacccgtaccgtactttaacccgggttaccgttactccccggtttaacggtaacccgggtaaccggtaccggacgtttacggtacctacgtaccccgttacggaccgtaccgaccgaaaccccgacgtaaccccgtacctacgaccgttcctaaccgttcccncccgttaacccncctacggtaacttacgg

SEQ ID NO: 55086 - DNA, 714 bp, Homo sapiens
  misc_feature: GYAE6OF01ADGSX.41.19.B08.1.454.CMB.1.raw
  modified_base (177)..(177): a, c, t, g, unknown or other
  misc_feature (177)..(177): n is a, c, g, or t
  modified_base (249)..(249): a, c, t, g, unknown or other
  misc_feature (249)..(249): n is a, c, g, or t
  modified_base (406)..(406): a, c, t, g, unknown or other
  misc_feature (406)..(406): n is a, c, g, or t
  modified_base (436)..(436): a, c, t, g, unknown or other
  misc_feature (436)..(436): n is a, c, g, or t
  modified_base (522)..(522): a, c, t, g, unknown or other
  misc_feature (522)..(522): n is a, c, g, or t
  modified_base (653)..(653): a, c, t, g, unknown or other
  misc_feature (653)..(653): n is a, c, g, or t
tcagtctatactatcacgaccggtgctcgatttagtgagtcagtaaggggtggggtctcaggaggcagcgctctcgggacgtctccaccatggcctgggctctgctatccctcaccctcctcactcagggcacagggtcctgggcccagtctcgccctgactcacgcctgacctcgngactgggtctcctaggacagtcgactcgaccgtctcctgcctcgtggcctccgagtagcgaccggttcggtntactttaagtttacgttttcgccggtccgttaacggaaccctaaaccaaccccggaccccggacaacccggaccccaagtacctactaatttattaagtggtattacgtactacgtggaccgtccggtcctaggtacggtttacacttcgtcttacncgtcggaccttaccgacggtccgaccgacnccggtccctacgcgacctacgtccgtcccgccgtccggaaggtccgggagtacgggtacgtacgttagtttaccttggactacgtnttacccgtacttaaccgttacaaccctacggtacctaccgttaccgttccgtactttaccggaccgtaaccggtacggccgtcgtacgtcctcggtacgtcgtaaccgaccggacccaacccgtaaccccncgttaccgtccccgttctaacccgttcccgttacccgacccctacccttgtaacgttaccg

SEQ ID NO: 55087 - DNA, 794 bp, Homo sapiens
  misc_feature: GYAE6OF01EOBUL.41.19.B08.1.454.CMB.1.raw
  modified_base (208)..(208): a, c, t, g, unknown or other
  misc_feature (208)..(208): n is a, c, g, or t
tcagtctatactatcacgaccggtgctcgatttagtgagtcagtaaggggtgggtctcaggaggcagcgctctcgggacgtctccaccatggcctgggctctgctactccctccacccctcctcactcgagggcacgtacgggtccgtcgggcccagtctcgccctgactcacgcctcgcctccgtagcgttcggtcctccgtggacngtccgactccgaccgttcctccgtgtccgtcgtacggtcctacgtagtaggtcgtaccggttcgtacgttactttagtttagtttcgccgtacgtacggtaaccaaccgaacccgacccggaccgtaacccgcccaagtactacgtatttaagtttacgtgtactcgtaccgtacgtacgtaccgtcccggttaccgtaggtttacggttacttacgtccgttccttcgtccggtacgccttaccggaaccggtcccggtaacctacccggtcccgtcccgtaccgtcgtaaccctcccgttccccgtaccggtcccgtacgggtaccgggaacgggtaccggtaacgggttacgttacgtttactttcgtaccggactaccgttacccgtaactttcgtaaacccttaccccgaaccgtacctccctaaccgttccgttaccgttaccgtaccggttaaccggaccgtacccggtaccgcgttaccgtccgttaccgtagaccgtaccaaccgtacccgaacccgttcccgaaccttcgtaccgtcctacccgtttcgtacccctcccgttcctagtacgttacg

SEQ ID NO: 55088 - DNA, 746 bp, Homo sapiens
  misc_feature: GYAE6OF01CN9QX.41.19.B08.1.454.CMB.1.raw
  modified_base (311)..(311): a, c, t, g, unknown or other
  misc_feature (311)..(311): n is a, c, g, or t
tcagtctatactatcacgaccggtgctcgatttagtgagtcagtaaggggtggggtctcaggaggcagcgctctcgggacgtctccaccatggcctgggctctgctatccctcaccctcctcactcagggcacagggtcctgggcccagtctgccctgactcagcctgcctccgtgactgggtctcctggacagtcgatcaccgtctcctgctctggtcctcgagtgtgacggtcggtgtcttattattttgcgtcctcggtaaccaacaaccgacccggacgaaccgcccagactactaattaactttangtattgtctacgtgaccgtccggtacccgtacggttacgggtttacctaagtccgtaccgtttcgtcgtcgtaccgtaccgtaacggtcccggacgtaacccggtacccggtccctacccgtaccgacccgtacctcccggtccccggtcccgtaccgggacggggccgggtaacggggtacgggtaggggttacgttacgtttacgtttcgacggtactacgtccttactaaccgtttaacccgaaccgtaccaccctaccgtccttcgtaccgtttccgtacggtaaccgtccgggtaaccgttacggttacctacgttccgttaccggtacgccgtaaccgacccgtaaaccggccccctaaacccgtccgttaccgtcccttaccgttccccgttacccgttaccccccacccgtttccgtacgttaaacg

SEQ ID NO: 55089 - DNA, 747 bp, Homo sapiens
  misc_feature: GYAE6OF01EU5AJ.41.19.B08.1.454.CMB.1.raw
  modified_base (314)..(314): a, c, t, g, unknown or other
  misc_feature (314)..(314): n is a, c, g, or t
tcagtctatactatcacgaccggtgctcgatttagtgagtcagtaaggggtggggtctcaggaggcagcgctctcgggacgtctccaccatggcctgggctctgctatccctcaccctcctcactcaggcacagggtcctgggcccagtctgccctgactcagcctgcctccgtgactgggtctccgtggacagtcgactcaccgtctacctgctctcggtcctcgagtagtcgacgtcggtgtacttattagtttgtccgcgtacgtaaccaacaccgaccccggacgaaccgcccagactactaattaattnatcgtcgactgtgcgtccgtcctaggttacggttactacgtctcttctcgtcgtcctaccgaacggtccggacgaccgaccgtcccctcgtacgtacctacgttcccgccggtacccgtacgacggggtacggacggtaacgggttggttaacgttacgttttcgttaccgtcgcgttaaccgtacctaacgttaactacccgaacctacccgacgttaacccctaccggttaccgtccgtttaccgggttaaccggtaccggggtaaccggtaccgtaccggttacttaaccggtcccggttaccgtacggtaacccgaacccggacccgtaaaccccggaccccctaaacccgtcggtttacccctaaccggttccccgtaccccgtttaccccggtacccccctttccctacccgttaaacgttaaccgg

SEQ ID NO: 55090 - DNA, 971 bp, Homo sapiens
  misc_feature: GYAE6OF01DSHYY.41.19.B08.1.454.CMB.1.raw
  modified_base (196)..(196): a, c, t, g, unknown or other
  misc_feature (196)..(196): n is a, c, g, or t
  modified_base (214)..(214): a, c, t, g, unknown or other
  misc_feature (214)..(214): n is a, c, g, or t
tcagtctatactatcacgaccggtgctcgatttagtgagtcagtaaggggtggggtctcaggaggcagcgctctcgggacgtctccaccatggcctgggctctgctatccctcaccctcctcactcgagggcacgagggtcctgggcccagtctgccctgactcagcctgcctcgtgacgtgggtctccgtggacngtcgatcgaccgtctccngtctcgtcggcctccgtagtgtgtacggttcggtagtactttaattagtttttcgccgtaccgtacggtaacccaaaccgtaacccgaccccggacgaaaccggccccaagacctactaatttaacgtttagtcgtacttacgtccgtacgtacgaaccgttcccggccctttacggtacggggttttactaaacgttccggttcctttccgttcggtcgtacccgttaaccgtaaccgggtaccccgggtacccggaaccgtaccccggggtccccttcccgtaacccggtaacccgttacccgtccccgggttaccccggttaccccggttaacccgggtaacggggggtaacccgggaaacgggggtaacccggggttaaggggttacccgttttaaaggttttaagttttcccggtagggttacccgtaaccggtttaccttaacccttttaaacggtttaaaccccgtaaacccggaaccggttaaccccctaaccgttacccggttttaccggaccccgttttaccgggttaaacccgggtaacccgggttttaccggggaaaccccgttacccggggtttaaacttcccgttaacccggggtttccccgtaaacgggttacccgacccgggtaaccccccgtaaacgggtaaccccccccgaaacccgttaccgtaccggttaccccttaaccggtttccccttaacccggttccccccctaaacccctttccgtaaccgttaaaccggg

SEQ ID NO: 55091 - DNA, 712 bp, Homo sapiens
  misc_feature: GYAE6OF01BMSRA.41.19.B08.1.454.CMB.1.raw
  modified_base (253)..(253): a, c, t, g, unknown or other
  misc_feature (253)..(253): n is a, c, g, or t
  modified_base (332)..(332): a, c, t, g, unknown or other
  misc_feature (332)..(332): n is a, c, g, or t
  modified_base (643)..(643): a, c, t, g, unknown or other
  misc_feature (643)..(643): n is a, c, g, or t
tcagtctatactatcacgaccggtgctcgatttagtgagtcagtaagggggtggggtctcaggaggcagcgctctcgggacgtctccaccatggcctgggctctgctatccctcaccctcctcactcagggcacgagggtcctgggcccagtctgccctgactcagcctgcctccggtgacgttgggtcctccgtaggacagtcgatcctaccgtctcctgctctcggcctaccgagtagtcgacggtcggtntactttattatttcgtcgtcctacgtaaccaacaaccgaccccggacgtaaccgccccagtacctactaattaaatttntagtattcgcctaacgtcgacgtccgtcccgtaggttacggtttactaacgtccgtactttcgtcgtcgtcctaccgtacggtcccggaccgaccgtcccgtacccgtcccgtaacgtacctccgtccccgtcccggtccgtaccgggacggggtacgggaacgggtacgggtaagggttacttacgtttcgttccgtaggacctacggtccttaactaaccgttaacaaccgtacctaccgtacctccgttcgtaccgtaccggttacgggaccggtaccggtacgtcgtaccgtcgttcgtaacccggnacccggacacccggaaccgacccctacgatcccgtactccctcgtcccgtcccctcctactcgtaaacg

SEQ ID NO: 55092 - DNA, 791 bp, Homo sapiens
  misc_feature: GYAE6OF01A8HM2.41.19.B08.1.454.CMB.1.raw
tcagtctatactatcacgaccggtgctcgatttagtgagtcagtaaggggtggggtctcaggaggcagcgctctcgggacgtctccaccatggcctgggctctgctatccctcaccctcctcactcagggcacagggtcctgggcccagtctgccctgactcagcctgcctccgtgactgggtctcctggacagtcgatcaccgtctcctgctcgtggcctcgagtagtgtacgtccggtgtctttaattaacgttttgccgtctacggtaaccaacaacccgaccccggacgaaccgccccagacctactaataatttatagactgtctacgtgacgtccggcccttcggtacgggtttacttaacgttcgtcctttccgtccgtcgaccgtaccgtaacggttccccggaccgaccgtacccgggccctcccgtacggaccctcgttccccgtacccggtaccctaccggacggggccgggaacgggtccggtaagggttctagtttactttcgtgaccgtactctacgttaactttaccgaacccacgtacccaccgttaacccttgtaccccgttacgggtttaccgggaacccgggttacgggaaccccggtaccgttaaccgttaccccgggttacccggttaccgggtaccggttaccccggaaccgtaaacccccgggaacccggtaacccccctaacccccgtagtttaccccgtaccctttaccccgggtttacctcccccgttaacccccttaccccgttccccgtaaccgttaaaaccg

SEQ ID NO: 55093 - DNA, 652 bp, Homo sapiens
  misc_feature: GYAE6OF01ACCFS.41.19.B08.1.454.CMB.1.raw
  modified_base (236)..(236): a, c, t, g, unknown or other
  misc_feature (236)..(236): n is a, c, g, or t
  modified_base (454)..(454): a, c, t, g, unknown or other
  misc_feature (454)..(454): n is a, c, g, or t
tcagtctatactatcacgaccggtgctcgatttagtgagtcagtaaggggtggggtctcaggaggcagcgctctcgggacgtctccaccatggcctgggctctgctatccctcaccctcctcactcagggcacagggtcctgggcccagtctgccctgactcagcctgcctcgtgactgggtctcctggacagtcgatcaccgtctcctgctctggctccagtagtgacgtcggtncttatattttgcgcctggtaccaacaccaccccggcgaacgccccagactcataattatgatgtcactgactcggccctcgtagggtttcctaagtcgtcttctcgtcggctccgaaggtcccggacgaccgaccggtccctccgtacgaccctagttccgtcccggccctccggacgggccggaacggaccggagggttacgtactttacgtttcgngtccgagtctactaactttaccgaacctacgcccaaccgtcccttagcctttaccgttacgggaaccgttcgggaaccctcggttaccctacgttaccgttcctacgggtccaaccgaccccgaacggtacccccaaacccggtctaccgtcctaccttcccgttacccggttcccccgaccccttcctacgttaacg

SEQ ID NO: 55094 - DNA, 932 bp, Homo sapiens
  misc_feature: GYAE6OF01BV8N9.41.19.B08.1.454.CMB.1.raw
tcagtctatactatcacgaccggtgctcgatttagtgagtcagtaaggggtggggtctcaggaggcagcgctcgtcgggacgtctccaccatggcctgggctctgctactccctcaccctcctcactcgagggcaacgagggtccgtcgggccctaggtctcgccctgactcgacgcctcgcctcgtgacgtcgggtcctccgtggactcgtacgtactccgtaccgtcctccgtcgtcgttcgtcggcctaccgtaggttacggtacggtccggttacgggtagttaaccttttaagtttacggtttttccggccggttaccggttaacggtaaaccctaaaaccgaaaccccggaaccccgggtaaccgaaaccccggtaccccgtaaacggtaaccttaaccgttaaacttttaaagtttacgtaaggtacttcgtaccgtacgtacgtaccgtcccggtccgttacgggtttacgggtttacctaacgttccgtcgtttccgtcgtccgtaccgtaccgtaccggtccggaccgacccgtccggtcccctccgtactccgtacgtcccgtacccgtccgtacgggacgggacgggtacggtacgggtagggttacttacgtttacgtcgtacgaccgtacgtacttaaccgttaacgttaacctaaccgcccgtaaccctaccgttacccggtacgttcccgtttaaccgggtaacccggtaaccgggtaccgggttaacccgtaccgggtttacccttaacggttacccggtttaaccgtaccgggtaaaccccgtaaccccggtaaccccggtaacccgaaacccccgttaccccgttaaccggttacccgttaacccgttaccccgtttacccccttaccccggttaccccccttacccgttacccgttaagtttaaaacccggg

SEQ ID NO: 55095 - DNA, 894 bp, Homo sapiens
  misc_feature: GYAE6OF01CBC1E.41.19.B08.1.454.CMB.1.raw
tcagtctatactatcacgaccggtgctcgatttagtgagtcagtaagggggtgggggtctcaggaggcagcgctctcgggacgtctccaccatggcctgggcctctgctactccctccaccctcctcactcgagggcacgtagggtccgtcgggcccagtctcgccctagacctcgcgtcctcgtcccgtccggtggtaccgttcgggtcctccggtacggacgtacggtaccgtaactcccgtacccggttccttcccgttcgtccttcgtcggtccttaccgtaggtaacggtcggtaccggttcgggttacttacgttttaaacgtttacgttttcgggtccttaccggttaaccggtaaaccccaaacccgtaaaccccggaaccccgggaccggtaaaccccgtacccgtaacggtaaccttacgttaaaagtttaaacgtttagttacgtacggttacgtaccgtaacgttcggtaccggttccccgggtaccgttacggggttttacgggttaccttacgttccgttaccgttccgttccggtaccggtacctaaccgggacggtccccggaaccggtacccgtacccggttcccctaccggtaacctaacccgtcccggttccccgggttcccggtacccggtaccgggggaacggggtacgggtaacggggtacggtcggtttacgttactttacgtcgacgtcgtacctcgtaactacctaacaccgacctactacgtcctacgtccgttacgacgtaccgtacggtaccgtacgtcgtaccgtccggtacgtcctaccggaccgtacccgaccgtaccccacggttacctcggtaccctttacccgtcccgttcccgtacccccgtcttaaccggtataaccg

SEQ ID NO: 55096 - DNA, 528 bp, Homo sapiens
  misc_feature: GYAE6OF02GHTM2.41.19.B08.1.454.CMB.1.raw
  modified_base (523)..(523): a, c, t, g, unknown or other
  misc_feature (523)..(523): n is a, c, g, or t
tcagtctatactatcacgaccggtgctcgatttagtgagtcagtaaggggtggggtctcaggaggcagcgctctcgggacgtctccaccatggcctgggctctgctatccctcaccctcctcactcagggcacagggtcctgggcccagtctgccctgactcagcctgcctccgtgactgggtctcctggacagtcgatcaccgtctcctgctctggctccagtagtgacgtcggtgcttataattttgtcgcctggtaccaacaacaccccggcgaagcccccagactcataatttatgatgtcactgatcggcctcagggtttctaatcgcttctctggctccaagtccggcgacacggcctccctgaccatctccggcctccaggcggaggacgagggtgattatttctgcagctcatttacaaccagccacaccttgcctcttcggactgggaccacggtcatcgtctaggtcagcccaaggccaaccccactcgtcactctcgttccccacccttccnctaac

SEQ ID NO: 55097 - DNA, 526 bp, Homo sapiens
  misc_feature: GYAE6OF02GPOXF.41.19.B08.1.454.CMB.1.raw
tcagtctatactatcacgaccggtgctcgatttagtgagtcagtaaggggtggggtctcaggaggcagcgctctcgggacgtctccaccatggcctgggctctgctatccctcaccctcctcactcagggcacagggtcctgggcccagtctgccctgactcagcctgcctccgtgactgggtctcctggacagtcgatcaccgtctcctgctctggctccagtagtgacgtcggtgcttataattttgtcgcctggtaccaacaacaccccggcgaagcccccagactcataatttatgatgtcactgatcggcctcaggggtttctaatcgcttctctggctccaagtccggcgacacggcctccctgaccatctccggcctccaggcggaggacgagggtgattatttctgcagctcatttacaacagccacaccttgctcttcggaactgggaccacggtcatcgtcctaggtcagcccaaggccaaccccatcgtcactctcgttcccgccctcctctacg

SEQ ID NO: 55098 - DNA, 572 bp, Homo sapiens
  misc_feature: GYAE6OF02GPZHP.41.19.B08.1.454.CMB.1.raw
tcagtctatactatcacgaccggtgctcgatttagtgagtcagtaaggggtggggtctcaggaggcagcgctctcgggacgtctccaccatggcctgggctctgctatccctcaccctcctcactcagggcacagggtcctgggcccagtctgccctgactcagcctgcctccgtgactgtgtctcctggacagtcgatcaccgtctcctgctctggctccagtagtgacgtcggtgcttataattttgtcgcctggtaccaacaacaccccggcgaacgcccccagactcataattatgatgtcactgatcggccctcgtagggtttctaatcgcttctctggctccaagtccggcgacacggcctccctgaccatcctcccggcctccgacggcggacggacggagggtgtattatttctgcagctcatttacaaccagccactaccttgaccttcgttacggaacgtcgggacctacggtctacgtccgtacctacggtccacggacccaacggccccaaacccctacgttccgtacctaccttccgtttccgtcccctccctcctacc

SEQ ID NO: 55099 - DNA, 534 bp, Homo sapiens
  misc_feature: GYAE6OF02ITPPZ.41.19.B08.1.454.CMB.1.raw
  modified_base (320)..(320): a, c, t, g, unknown or other
  misc_feature (320)..(320): n is a, c, g, or t
  modified_base (501)..(501): a, c, t, g, unknown or other
  misc_feature (501)..(501): n is a, c, g, or t
tcagtctatactatcacgaccggtgctcgatttagtgagtcagtaaggggtggggtctcaggaggcagcgctctcgggacgtctccaccatggcctgggctctgctatccctcaccctcctcactcagggcacagggtcctgggcccagtctgccctgactcagcctgcctccgtgactgggtctcctggacagtcgatcaccgtctcctgctctggctccagtagtgacgtcggtgcttataattttgtcgcctggtaccaacaacaccccggcgaagccccccagactcataatttatgatgtcactgatcggccctnaggggtttctaatcgcttctctggctccaagtccggcgacacggcctccctgaccatctccggcctccgaggcggaggacggagggtgattattctgcagctcatttacaaccagccacaccttgctcttcggaactgggaccacggtcatcgtcctaggtcagcccaacggcccaacccnctcgtcacctctcgttcccgccctcctctaacg

SEQ ID NO: 55100 - DNA, 786 bp, Homo sapiens
  misc_feature: GYAE6OF02G25DE.41.19.B08.1.454.CMB.1.raw
  modified_base (243)..(243): a, c, t, g, unknown or other
  misc_feature (243)..(243): n is a, c, g, or t
tcagtctatactatcacgaccggtgctcgatttagtgagtcagtaagggtaagggggttgggtccgtagggaggcagaactctagggtgttcgtcaccagtggcctggactcccctcgtacttcctccccctccgtcaacgtcctcttcgacacaggtctctggaggccggcctagtgaaggtcgacacagccacacgtcggtgtcagtcgtccccaggacagacggccaggatcacctgctntggagatgaattcgccaaggctaaattttgtttaattcggtaccagcagaagccagcccaggcccctgtgttggtgatgtaataaagacagtagagacgccctgagggactcccgtagacgacgtacttctcgtacggccgacccgtagcctacgaacgggaacctaggtaacgtccgtaacggtttcgaaacccgtattaccgaggttaggaacggtcccgaagggaccaaggaaacggaaccggaacggtcgtaacggtaaccttaagtttaacgtttacgttacgtaaccggacgtaaggttaacggacgaaccgggataacgggtttccgggtttaaccgttttaaaccgggtttcgggggtttaacggggttttcccggggaaccggggggtaaacccgtaagggtcccggttaacgggtaccccgggtttcggtaaccggttcccggaaacggtacccccggtaagggtaccccggttacccggtcccccccggtttacggggtaaccccttcccggttacccgtttaccccccggg

SEQ ID NO: 55101 - DNA, 570 bp, Homo sapiens
  misc_feature: GYAE6OF02JFZQP.41.19.B08.1.454.CMB.1.raw
  modified_base (414)..(414): a, c, t, g, unknown or other
  misc_feature (414)..(414): n is a, c, g, or t
tcagtctatactatcacgaccggtgctcgatttagtgagtcagtaaggggtggggtctcaggaggcagcgctctcgggacgtctccaccatggcctgggctctgctatccctcaccctcctcactcagggcacagggtcctgggcccagtctgccctgactcagcctgcctccgtgactgggtctcctggacagtcgatcaccgtctcctgctctggctccagtagtgacgtcggtgcttataattttgtcgcctggtaccaacaacaccccggcgaagccccccagactcataatttatgatgtcactgatcggccctcaggggtttctaatcgcttctctggctcagtccgcgacacggcctcctgaccatctccggcctccaggcggagacggagggtgtattactttcgngcagctctatttaaccaaccgtacgaccactaccgttgaccttccgttacggaacgtcgggacctacggtcactccgtccgtaggtccacgacccgtaacggacccaaccctccgtacgtacctacctcttcgttcctcccgtacccttcccgtac

SEQ ID NO: 55102 - DNA, 536 bp, Homo sapiens
  misc_feature: GYAE6OF02H6IZI.41.19.B08.1.454.CMB.1.raw
  modified_base (299)..(299): a, c, t, g, unknown or other
  misc_feature (299)..(299): n is a, c, g, or t
  modified_base (434)..(434): a, c, t, g, unknown or other
  misc_feature (434)..(434): n is a, c, g, or t
tcagtctatactatcacgaccggtgctcgatttagtgagtcagtaaggggtggggtctcaggaggcagcgctctcgggacgtctccaccatggcctgggctctgctatccctcaccctcctcactcagggcacagggtcctgggcccagtctgccctgactcagcctgcctccgtgactgggtctcctggacagtcgatcaccgtctcctgctctggctccagtagtgacgtcggtgcttataattttgtcgcctggtaccaacaacaccccggcgaagcccccagactcataatttangatgtcactgatcgccctcaggggtttctaatcgcttctctggctccaagtccggcgacacggcctccctgaccatcctccggcctccgaggcggaggacgagggtgattatttctgcagctcactttacaccanccacacctgctctcgactggaccacgtcatcgtctagtccacgcccgaacggcccaaccccactcgtcctactcctccgttccccacccttccctactaacg

SEQ ID NO: 55103 - DNA, 529 bp, Homo sapiens
  misc_feature: GYAE6OF02GSBPY.41.19.B08.1.454.CMB.1.raw
tcagtctatactatcacgaccggtgctcgatttagtgagtcagtaaggggtggggtctcaggaggcagcgctctcgggacgtctccaccatggcctgggctctgctatccctcaccctcctcactcagggcacagggtcctgggcccagtctgccctgactcagcctgcctccgtgactgggtctcctggacagtcgatcaccgtctcctgctctggctccagtagtgacgtcggtgcttataattttgtcgcctggtaccaacaacaccccggcgaagccccccagactcataatttatgatgtcactgatcggccctcagggtttctaatcgcttctctggctccaagtccggcgacacggcctcctgaccatctccggcctccaggcggagcgagggtgattatttctgcagctctatttaccaaccagccacaccttgcctcttcggaactgggaccacggtcatcgtcctaggtcagcccaaggcccaacccactcgtcactctcgttccccaccctcctctac

SEQ ID NO: 55104 - DNA, 594 bp, Homo sapiens
  misc_feature: GYAE6OF02I05OD.41.19.B08.1.454.CMB.1.raw
  modified_base (555)..(555): a, c, t, g, unknown or other
  misc_feature (555)..(555): n is a, c, g, or t
tcagtctatactatcacgaccggtgctcgatttagtgagtcagtaaggggtggggtctcaggaggcagcgctctcgggacgtctccaccatggcctgggctctgctatccctcaccctcctcactcagggcacagggtcctgggcccagtctgccctgactcagcctgcctccgtgactgggtctcctggacagtcgatcaccgtctcctgctctggctccagtagtgacgtcggtgcttataattttgtcgcctggtaccaacaacaccccggcgaagcccccagactcataatttatgatgtcactgatcggccctcagggtttctaatcgcttctctcggtctccgaagtcccgggcgaccacggcccttccctcgacccactccgtacccggcccttccgacgggccgggaagggacggaggggttgatttagtttcgtgcacgcttctaatttaccaaccacgacccaactaccttgccttacttacggaacctgggaacctacggttacacgttccgtccgttaggtcacgcccgaacggcccaacccnctacgtaccacttcgtccgttcccgcccttcctactacg

SEQ ID NO: 55105 - DNA, 570 bp, Homo sapiens
  misc_feature: GYAE6OF02H64YY.41.19.B08.1.454.CMB.1.raw
  modified_base (413)..(413): a, c, t, g, unknown or other
  misc_feature (413)..(413): n is a, c, g, or t
  modified_base (423)..(423): a, c, t, g, unknown or other
  misc_feature (423)..(423): n is a, c, g, or t
tcagtctatactatcacgaccggtgctcgatttagtgagtcagtaaggggtggggtctcaggaggcagcgctctcgggacgtctccaccatggcctgggctctgctatccctcaccctcctcactcagggcacagggtcctgggcccagtctgccctgactcagcctgcctccgtgactgggtctcctggacagtcgatcaccgtctcctgctctggctccagtagtgacgtcggtgcttataattttgtcgcctggtaccaacaacaccccggcgaacgcccccagactcataatttatgatgtcactgactcgccctcgtaggggtttcaatcgcttctctggcctccaagtccggcgacacggcctccctgaccatcctcccggcctccgaggcgggaggacggagggtntattatttcngcagctctaatttaaccaaccacgccactaccttgccttcgttacggaacgtcgggaccacggtcacttccgtcctaggtcacgcccgaacggccccaacccgactacgtcctacctccgttccgttccccgcccttcctactaacg

SEQ ID NO: 55106 - DNA, 570 bp, Homo sapiens
  misc_feature: GYAE6OF02ILI34.41.19.B08.1.454.CMB.1.raw
  modified_base (449)..(449): a, c, t, g, unknown or other
  misc_feature (449)..(449): n is a, c, g, or t
tcagtctatactatcacgaccggtgctcgatttagtgagtcagtaagggggggagaggagccccagccttgggattcccaggtgttttcattcagtgatcaggactgaacacagaggactcaccatggagtttgggctgagctggatttttccttgctgctattttaaaaggtgtccagtgtgaggtgcagttggtggagtctgggggaggtttggtaaagccgtggggagtcccttagactctcctgtgcagcctctggattcactttcagtaacgcctggatgacctggtccgcaggctccgagggaagggctggagtgggttggccgtagtagaaccaaagctaggacggtggacagcagactacgctgccaccgtgaaagcagatcacatctcaagagatagaattacaaaaagtataacggtcgtacttctgacagatagaacngcctagaacgaccgaggacacagtccgtactaattacgtgtacgtagggtacttggtttcgagttccgggaccgtacgggacccgttggtcctaccggttcctcccgtcaccgcctacccg

SEQ ID NO: 55107 - DNA, 634 bp, Homo sapiens
  misc_feature: GYAE6OF02GQWIL.41.19.B08.1.454.CMB.1.raw
tcagtctatactatcacgaccggtgctcgatttagtgagtcagtaagggtgggggtctcgaggagggcagcgcctctcgggacgtctaccaccgatggtcctgggctctgctatccctcaccctacctcactcagggcaccagggtcctgggtcccagtctggccctggtacctcagcctgtacctccgtgactgggtctcctgggacagtcgatcaccgtctccgtgctcgtggctccaggtagtcgacgtcggtgcttataattttgcgcctggtaccaacaacaccccggtcaacgtcccccagctcattaattatgatcgtcactgactcggccctcggtagggtttctaagtcggtcttctcttggtctctaagtccggcgacgacggtcctcctgacctatccgtccggcctccgagggcggacggacgtacgggtctacgtttacttcagcacgtcctacgtactttaaccaaccgacgtacccacctaccgttgccttacgttaccggaacgtcgggacctacgggtctacgttccgtacgtacggtccacggcccgtaagggtacccctaaccctacgttccgtaccgaccttacttccgtttacccccaccttccgtactaacg

SEQ ID NO: 55108 - DNA, 747 bp, Homo sapiens
  misc_feature: GYAE6OF02GPGC7.41.19.B08.1.454.CMB.1.raw
tcagtctatactatcacgaccggtgctcgatttagtgagtcagtaaggggtggggtctcaggaggcagcgctctcgggacgtctccaccatggcctgggctctgctatccctcaccctcctcactcagggcacagggtcctgggcccagtctgccctgactcagcctgcctccgtgactgggtctcctggacagtcgatcaccgtctcctgctctggctccagtagtgacgtcggtgcttattaattttgcgtcctggtaaccaacaaccgaccccggacgaaccgcccccagacctacaattaattatgatcgtacactgactccggcctcgtagggtttactaatccgtcttctcgtcggctaccgaacggtcccggacgaccgaccggtcccttacccgtacgaccctacgttcccgtcccggtccctaccggacggggaccgggaacgggacgggtaaggggttacgtacgttttacgtttccgtacggtacctacggtccttacgttaaaccgttttaaacccgaaaccgtaaccggtaccctaaccttacccgtttgtacccgtttaccggttaccggaaccgttaccggggaacccgtacgggttacctacggttacccggttaccgttacgggtaccaacccggaccccgaaaccgggtacccccaaaccccgtaccgttaccgtaccctaaccgttcccgttacccgttacccccgacccctttaccctacgtaaccg

SEQ ID NO: 55109 - DNA, 676 bp, Homo sapiens
  misc_feature: GYAE6OF02H39W6.41.19.B08.1.454.CMB.1.raw
  modified_base (396)..(396): a, c, t, g, unknown or other
  misc_feature (396)..(396): n is a, c, g, or t
tcagtctatactatcacgaccggtgctcgatttagtgagtcagtaaggggtggggtctcaggaggcagcgctctcgggacgtctccaccatggcctgggctctgctatccctcaccctcctcactcaggcacagggtcctgggcccagtctgccctgactcagcctgcctccgtgactgggtctcctggacagtcgatcaccgtctcctgctctggcctccagtagtgacgtcggtgcttatattttgcgcctggtaccaacaacacccggcgaacgccccagactcataactttatgatgtcactgatccggcctcgtagggtttctaatcgtctttctcgtggcctacctaaggtcccggacgtaccaccggtcctccctgaaccctattcccncccgggtcccttccgacgggcgggaacgggaacggacgggggttataacgtttagtttcgtacggaccgtacggtcttaccgttaaactttaccaaaccgtaccgccctaacacccgttgaccctttacgttcccggaaacgttccgggaacccgtaacgtccgtacgtccgttaccgtacggttaccacggaccccctaaaagggccccctaaacccccgattacccggtactaccgttcccgtttccgttaccccccggtcccctttccacttaaccg

SEQ ID NO: 55110 - DNA, 816 bp, Homo sapiens
  misc_feature: GYAE6OF02F1U7R.41.19.B08.1.454.CMB.1.raw
  modified_base (233)..(233): a, c, t, g, unknown or other
  misc_feature (233)..(233): n is a, c, g, or t
tcagtctatactatcacgaccggtgctcgatttagtgagtcagtaaggggtggggtctcaggaggcagcgctctcgggacgtctccaccatggcctgggctctgctatccctcaccctcctcactcagggcacagggtcctgggcccagtctgccctgactcagcctgcctccgtgactgggtcctcgtgacacgtcgactccaccgtctcctgctcgtcgcctcctagtagngtacggtcggtgtacttaattagttttcgtccgtccgtacggtaaccaaacaacccgtaccccggacgaacccgcccccaagacctacaatttaaactttagtagtattcgtacctacgtgtacgtcccggtcccttacggttacggggttttaccttaacgtccgttctttcgtcgtcggtcctaaccgtaacggtccggacgaccgaccggtccctcccgtagaccctacttcccgtcccggtccctaccgggacggggacgggtaaacgggtaaccggggtaggggttacgttaaacttttacgtttccgtacggaccgtacgtccttaactttaacctttaaaccgaaacccgtacgtaacccctaccgttaacccgtttgttacccgttaccggttaacccggtaaaccggttccgggaaacccgttaccggttacctaaacggtttcccgtaccggttacggtaccaacccggtaaccccgaaaccggtacccccctaaaccccgtacgtttaccgtacccttaaccgttccgtttaccccggttacccccctaccccttacccgtacttaaaccgg

SEQ ID NO: 55111 - DNA, 551 bp, Homo sapiens
  misc_feature: GYAE6OF02GXUQK.41.19.B08.1.454.CMB.1.raw
  modified_base (321)..(321): a, c, t, g, unknown or other
  misc_feature (321)..(321): n is a, c, g, or t
  modified_base (356)..(356): a, c, t, g, unknown or other
  misc_feature (356)..(356): n is a, c, g, or t
  modified_base (359)..(359): a, c, t, g, unknown or other
  misc_feature (359)..(359): n is a, c, g, or t
tcagtctatactatcacgaccggtgctcgatttagtgagtcagtaaggggtggggtctcaggaggcagcgctctcgggacgtctccaccatggcctgggctctgctatccctcaccctcctcactcagggcacagggtcctgggcccagtctgccctgactcagcctgcctccgtgactgggtctcctggacagtcgatcaccgtctcctgctctggctccagtagtgacgtcggtgcttataattttgtcgcctggtaccaacaacaccccggcgaacgccccccagactcataatttatgatgtcactgatcggccctnagggtttctaatcgcttctctggctcaagtccggnacncgcctcctgaccatctccgcctccacggcgaggacgagggtgattattctgcagtctcatttacacacgccacaccttgcctcgttcgaacgtggacccaggtcacgttcgtccgtaggtcacggacccgaacggaccccaaccccacgttcgtcctacctccgtttcctccccggtcccttcctactaacg

SEQ ID NO: 55112 - DNA, 558 bp, Homo sapiens
  misc_feature: GYAE6OF02HZ9RN.41.19.B08.1.454.CMB.1.raw
  modified_base (301)..(301): a, c, t, g, unknown or other
  misc_feature (301)..(301): n is a, c, g, or t
  modified_base (454)..(454): a, c, t, g, unknown or other
  misc_feature (454)..(454): n is a, c, g, or t
  modified_base (544)..(544): a, c, t, g, unknown or other
  misc_feature (544)..(544): n is a, c, g, or t
tcagtctatactatcacgaccggtgctcgatttagtgagtcagtaaggggtgggggtctcaggaggcagcgctctcgggacgtctccaccatggcctgggctctgctatccctcaccctcctcactcagggcacagggtcctgggcccagtctgccctgactcagcctgcctccgtgactgggtctcctggacagtcgatcaccgtctcctgctctggctccagtagtgacgtcggtgcttataattttgtcgcctggtaccaacaacaccccggcgaacgcccccagactcataatttangatgtcactgatcggccctcgaggggtttctaatcgcttctctggctccaagtccggcgacacggcctccctcgaccctactttcccggcctccgacgggcgggacggacggagggtgattactttctgcagctctatttacaccacgccacncctgctcttacggacgtcgggaccacggtcatcgtccgtagtccacgacccaacggcccaaccccactcgtaccactcttccgttccccnccctcctccatacg

SEQ ID NO: 55113 - DNA, 768 bp, Homo sapiens
  misc_feature: GYAE6OF02IM1T9.41.19.B08.1.454.CMB.1.raw
tcagtctatactatcacgaccggtgctcgatttagtgagtcagtaaggggtggggtctcaggaggcagcgctctcgggacgtctccaccatggcctgggctctgctatccctcaccctcctcactcaggcacagggtcctgggcccagtctgccctgactcagcctgcctccgtgactgggtctcctggacagtcgatcaccgtctcctgctctggctccagtagtgacgtcggtgcttataatttgcgcctggtaaccaacaaccaccccggcgaacgcccccagactacataatttatgatgtcactgactccggccctgtagggtttctaatcgtcttctctcggtctaccgaacggttcccggaccgacgacccgggcccttcccgtacgaacccacttccgtaccccggtccctacccgacggggccgggaacgggaaccgggtaaggggttacgtaacgtttacgttttaccgacggtacctacggtccttacgttaaacttttaaacccaaacccgtaaccgtaacccctaacccgtaacccgtttcgtaccctttacccggtttaccgggtaaaccgttccgggggaaacccgttaaccggggttacctaaccggtttaccgttacccggttaacggtaccgtaacccgggtaaccccgaaaccggggtaacccccccaaaccccgttacgttaccggttaaccctacccgtttcccgttaccccgtttacccccctacccccttaccctaccttaaccg

SEQ ID NO: 55114 - DNA, 848 bp, Homo sapiens
  misc_feature: GYAE6OF02HT869.41.19.B08.1.454.CMB.1.raw
  modified_base (214)..(214): a, c, t, g, unknown or other
  misc_feature (214)..(214): n is a, c, g, or t
tcagtctatactatcacgaccggtgctcgatttagtgagtcagtaaggggtgggggtacgtcaggaggcagcgctcctcgggacgtctccaccgatcggcctgggctctgctatccctcaccctcctcactcaggcacaggtcctgggcccagtctgccctgactcagcctgccctccgtgactgggtctccgtggacagtcgactcaccgtcncctgctctggcctccagttagtgacgttcggtgctttaagtaattttgcgcctggtaccaacaaccaccccggcgaacgccccccagacctcattaacttatgatgtcactgactcggccctcgacggggtttctaagtccgtctttctcgtggtcctccgaaggtcccggtcgtaccgaacccgggcccttacccgtcgaccctaacttccgtaccccggtccttcccgacggggtccgggaacgggacccggtaagggggttcgaacgttttaacgttttccgtacggtcctagtaccgttacgttaaacttttttaacccgaaaccccgttacggacccctaaacccgtaccccgtttaacgttaccccgtttaccgtttaacccggggtaaaccgtttaaccgggggacccccgttaaaccggggtttacccgttaaaccggttacccgggtttaaccccggttaacggggttacccgtaaccggggtaaccccccggtaaaaccggggtaacccccctaaaaccccccgtaacccgtttaccgggttaccccgtaacccgtttccgtttaccccgggtttaaccccccccctaacccccgttttaccccggttaccctttaaacccggg

SEQ ID NO: 55115 - DNA, 822 bp, Homo sapiens
  misc_feature: GYAE6OF02JJ4LI.41.19.B08.1.454.CMB.1.raw
tcagtctatactatcacgaccggtgctcgatttagtgagtcagtaaggggtgggggtctcaggaggcagcgctctcgggacgtctccaccatggcctgggctctgctatccctcaccctcctcactcagggcacagggtcctgggcccagtctgccctgactcagcctgcctccgtgactgggtctcctggcagtcgatcaccgtctcctgctctggctccagtagtgacgtcggtgcttataattttgtcgcctggtaccaacaacaccccggacgaacgcccccagactcataatttatgatgtcactgactccggccctcgtacggggtttctaatcgtccttctctcggcctccgaacggtccggcgaaccgaccggccctacccgtcgaacccacttccgtacccggcccttacccgacggggtaccgggaacgggaacgggtacggggttacgtaacgttttacgttttaccgtcgaccgtacgtaccgttactaacgttttaacccaaacccgtacggtacccaacccgttaacccgtttcgtcccgtttaccgtttaccggggtaaaacccggttaccgggggtaaaccccgtaaccggggtttacccgtaaaccgttttacccgggttaccccgtttaaacggggttacccctaacccgggtaaccccccgtaaaaacccgggggtaccccctaaaaaccccccccgtaacgtttacccggtttaacccctaacccggttttaccccgtttaaccccgttttacccccccgttaaacccccccgttttacccccttacccgtttaaaacccgg

SEQ ID NO: 55116 - DNA, 748 bp, Homo sapiens
  misc_feature: GYAE6OF02FGAB1.41.19.B08.1.454.CMB.1.raw
  modified_base (226)..(226): a, c, t, g, unknown or other
  misc_feature (226)..(226): n is a, c, g, or t
  modified_base (234)..(234): a, c, t, g, unknown or other
  misc_feature (234)..(234): n is a, c, g, or t
tcagtctatactatcacgaccggtgctcgatttagtgagtcagtaaggggtggggtctcaggaggcagcgctctcgggacgtctccaccatggcctgggctctgctatccctcaccctcctcactcagggcacagggtcctgggcccagtctgccctgactcagcctgcctcgtgactgggtctcctggacagtcgatcaccgtctcctgctctggctccagtagngacgtgtncttatatttgcgcctgtaccaacaccacccggcaacgccccagactcattattatgatgcactgacgtccggtcctacgtagggtttactaacgtcgtctttctcgtacgctacccgaacggtcccggaccgaccgccggtccccttccgacgaccctacgtcccgtacccggccctaccggaggggaccggtaagggtaccggaggggttacgtaagttttaccgttcgtacgtacccgacggtaccctttaaccgttaactttaaaccccaaacccgtaacccgtaccctaaccccgttacccgtttcggtaccccgtttacggtttaacccgggtaaaccgttacccggggaacccgttaaccgggtcctaaacggtttccccgtaaccgtaccgggttcccaacccggaccccgaaaaccggtccccccaaacccccgtagttacccgtaacctacccgttaccgtttcccccgttaccccccgtccccgttaccctacgttaaacccgg

SEQ ID NO: 55117 - DNA, 550 bp, Homo sapiens
  misc_feature: GYAE6OF02GFE2C.41.19.B08.1.454.CMB.1.raw
  modified_base (451)..(451): a, c, t, g, unknown or other
  misc_feature (451)..(451): n is a, c, g, or t
tcagtctatactatcacgaccggtgctcgatttagtgagtcagtaaggggtggggtctcaggaggcagcgctctcgggacgtctccaccatggcctgggctctgctatccctcaccctcctcactcagggcacagggtcctgggcccagtctgccctgactcagcctgcctccgtgactgggtctcctggacagtcgatcaccgtctcctgctctggctccagtagtgacgtcggtgcttataattttgcgcctggtaccaacaaccaccccggcgaacgcccccagactcataatttatgatgtcactgatcggcctgagggtttctaatcgcttctctcggctccaagtcccggcgacgaccggcctcccgtgacccatcctcccggccctccgacgggcgagggacgagggtgatttattctgcagctcatttacacagccactcttnctcttcgactgggaccacgtcactcgtactaggtcacgcccgaacggcccaaaccccgtctcgtactacctccttccgttccccgcccttcctctaacg

SEQ ID NO: 55118 - DNA, 682 bp, Homo sapiens
  misc_feature: GYAE6OF02HR519.41.19.B08.1.454.CMB.1.raw
  modified_base (207)..(207): a, c, t, g, unknown or other
  misc_feature (207)..(207): n is a, c, g, or t
  modified_base (300)..(300): a, c, t, g, unknown or other
  misc_feature (300)..(300): n is a, c, g, or t
tcagtctatactatcacgaccggtgctcgatttagtgagtcagtaaggggtggggtctcaggaggcagcgctctcgggacgtctccaccatggcctgggctctgctatccctcaccctcctcactcagggcacagggtcctgggcccagtctgccctgactcagcctgcctccgtgactgggtctcctggacagtcgatcaccgtcncctgctgtggctccagtagtggacgtcggtgcttattaattttgcgccttggtaccaacaacacccggcgaacgccccagactcataatttangtatgtcatgagtccggcctacgtagggtttctaagtccgtcttctctcggctaccgaacgtccggcaccgaccggtccctcccgtacgaccacttccgtcccggccgtcgaccgggcggacgggaccggtagggttcgtaatttacgtttcgtcgctacggtcttacttaactttaaccaaccgtacgccctaacctaccgttgccttacgttaccggtaacgtccggtaacccgtaccggtcctacgtcccgttacgtaaccggtccaaccggtacccccgaaaccgggccccctaaaacccccgtacgttccgtacccgtaacctttccccggttcccgtttccccccggtaccccctttaccccgtacttaaacccgg

SEQ ID NO: 55119 - DNA, 634 bp, Homo sapiens
  misc_feature: GYAE6OF02I9JFU.41.19.B08.1.454.CMB.1.raw
  modified_base (456)..(456): a, c, t, g, unknown or other
  misc_feature (456)..(456): n is a, c, g, or t
tcagtctatactatcacgaccggtgctcgatttagtgagtcagtaaggggtggggtctcaggaggcagcgctctcgggacgtctccaccatggcctgggctctgctatccctcaccctcctcactcagggcacagggtcctgggcccagtctgccctgactcagcctgcctccgtgactgggtctcctggacagtccgatcaccgtctcctgctctggctccagtgtgacgtcggtgcttataattttgcgcctggtaccaacacaccccggcgaacgccccagactcataactttaatgatcgtcactgactcggcccttacgtaggggtttactaatccgtctttcgtctcggtctaccgaacgtcgcgaacgccggccttccctagacctactccgcccggcctccgaacggccgggaagggacggtacggggtcgtaatttacgttctcganacgtctactaacgtttaacaacccgagtacccaccgtaaccgttcgcctttacgttaccggtaacgttcgggaacccacgggttctacgtcccgtaccgtaggttccaccgacccgaacggtaccccaacccacgtcgtccaacttccgtaccgttccctaccccttacacccgttaa

SEQ ID NO: 55120 - DNA, 620 bp, Homo sapiens
  misc_feature: GYAE6OF02F2P54.41.19.B08.1.454.CMB.1.raw
tcagtctatactatcacgaccggtgctcgatttagtgagtcagtaaggggtggggtctcaggaggcagcgctctcgggacgtctccaccatggcctgggctctgctatccctcaccctcctcactcagggcacagggtcctgggcccagtctgccctgactcagcctgcctccgtgactgggtctcctggacagtcgatcaccgtctcctgctctggctccagtagtgacgtcggtgcttataattttgcgcctggtaccaacaacaccccggcgaacgcccccagactcattaattatgatgtcactgactcggccctcgtaggggtttctaagtcgtctttctcgtcggcctccgaacgtccggacgaccaccggccctcccgtagacctactccgtcccggccctccgacgggccggaagggacggtaggggtatagtttactttcgtgcagcctactaactttaaccaaccacgacccaactaccgttgaccttaccgttccggtaacgtccgggaacctacggtaccacgttccgtaccgttacggtcaacgcccgaacggacccaacccgtcgtacgtacctacttccgtccgttacccacccttccactaacg

SEQ ID NO: 55121 - DNA, 658 bp, Homo sapiens
  misc_feature: GYAE6OF02IRXQO.41.19.B08.1.454.CMB.1.raw
  modified_base (238)..(238): a, c, t, g, unknown or other
  misc_feature (238)..(238): n is a, c, g, or t
tcagtctatactatcacgaccggtgctcgatttagtgagtcagtaaggggtggggtctcaggaggcagcgctctcgggacgtctccaccatggcctgggctctgctatccctcaccctcctcactcagggcacagggtcctgggcccagtctgccctgactcagcctgcctccgtgactgggtctcctggacagtcgatcaccgtctcctgctctggctccagtagtgaccgtcggtncttataattttgcgcctggtaccaacaacaccccggcgaacgcccccagactcataatttatgatgtcactgatccggccctcgtacgggtttctaatcgtcttctctggctaccagtcccggcgaccgacggccttcccagtacccagtcctaccggtccctcccgagggaccggaggaccggagggtcgtagtttatttctggcacgtcgtctaacgtttaaccaaccacgtacccactaccgtttcgccgtttacccgttacgggtaaccgttccggggaaccgtaccgggttaccgacgttcccgggtacccttacgggtacccgacggtaccccctaaagggaacccccctaacccctaccgttccggttaaccacccgtttccttcccgttcccccaccccgttccctacgtac

SEQ ID NO: 55122 - DNA, 552 bp, Homo sapiens
  misc_feature: GYAE6OF02F4GPZ.41.19.B08.1.454.CMB.1.raw
  modified_base (358)..(358): a, c, t, g, unknown or other
  misc_feature (358)..(358): n is a, c, g, or t
  modified_base (371)..(371): a, c, t, g, unknown or other
  misc_feature (371)..(371): n is a, c, g, or t
  modified_base (389)..(389): a, c, t, g, unknown or other
  misc_feature (389)..(389): n is a, c, g, or t
  modified_base (414)..(414): a, c, t, g, unknown or other
  misc_feature (414)..(414): n is a, c, g, or t
  modified_base (433)..(433): a, c, t, g, unknown or other
  misc_feature (433)..(433): n is a, c, g, or t
tcagtctatactatcacgaccggtgctcgatttagtgagtcagtaaggggtggggtctcaggaggcagcgctctcgggacgtctccaccatggcctgggctctgctatccctcaccctcctcactcagggcacagggtcctgggcccagtctgccctgactcagcctgcctccgtgactgggtctcctggacagtcgatcaccgtctcctgctctggctccagtagtgacgtcggtgcttataattttgtcgcctggtaccaacaaccaccccggcgaacgcccccagactcattaattatgatgtcactgatccggcctcgtagggtttctaatcgtcttctctgctccaagtccgngacacggcctccngaccatctccggcctcgnggcggaggacggaggtgattattcngcagctactattaccaacncgaccactaccttgctcgttcggaactcgggaccacggtcagtccgtacgtagtcacgacccaacggaccctaacccctatcgttcaccttcctccgttaccccacccttccactaacg

SEQ ID NO: 55123 - DNA, 731 bp, Homo sapiens
  misc_feature: GYAE6OF02GBBL1.41.19.B08.1.454.CMB.1.raw
tcagtctatactatcacgaccggtgctcgatttagtgagtcagtaaggggtggggtctcaggaggcagcgctctcgggacgtctccaccatggcctgggctctgctatccctcaccctcctcactcagggcacagggtcctgggcccagtctgccctgactcagcctgcctccgtgactgggtctccgtggacagtcgatcaccgtctcctgctctggctccagtagtgacgtcggtgcttattaattttgcgtccttggtaccaacaaccgaccccggacgaaccgccccccagacctcaattaatttatgatgtcactgacgtccggcccttgtacggggtttactaacgtccgtcttctcgtgtcctaccgaacggtccggacacgacccgtccctcccgtacgaccctactcccgtcccggccctaccggacggggtccgggaacgggtaccgggtagggttacgttacttttagttcgtcgacgtacgtccttaacttaactttaacccaaaccgtacgtacccctaaccttaccgttcgtacccgtttaccgttaccgggtaaaccgttccgggtaacccgtacgggttacctacgtttccgtacccgtacggttcccgtaccgaccccggaaaccggtaccccctaaaccccgtacgttaccgtacccgttaaccgttcccgtttaccccggttaccccctcccccttacctaccgttaaaccg

SEQ ID NO: 55124 - DNA, 536 bp, Homo sapiens
  misc_feature: GYAE6OF02GABHK.41.19.B08.1.454.CMB.1.raw
  modified_base (318)..(318): a, c, t, g, unknown or other
  misc_feature (318)..(318): n is a, c, g, or t
  modified_base (430)..(431): a, c, t, g, unknown or other
  misc_feature (430)..(431): n is a, c, g, or t
tcagtctatactatcacgaccggtgctcgatttagtgagtcagtaaggggtggggtctcaggaggcagcgctctcgggacgtctccaccatggcctgggctctgctatccctcaccctcctcactcagggcacagggtcctgggcccagtctgccctgactcagcctgcctccgtgactgggtctcctggacagtcgatcaccgtctcctgctctggctccagtagtgacgtcggtgcttataattttgcgcctggtaccaacaacaccccggcgaagcccccagactcataatttatgatgtcactgatcggccctnagggtttctaatcgcttctctggctcaagtccgcgacacggcctccctgacccatcctccggcctccgaggcggaggacgagggtgatttattctgcagctcatttacaccnnccactaccttgctcgtcggaactgggaccacggtcatcgtcctaggtcagcccaacggacccaaccccatcgtcacttcctaccgttccccgccctcctctaacg

SEQ ID NO: 55125 - DNA, 700 bp, Homo sapiens
  misc_feature: GYAE6OF02GWPR3.41.19.B08.1.454.CMB.1.raw
tcagtctatactatcacgaccggtgctcgatttagtgagtcagtaaggggtggggtctcaggaggcagcgctctcgggacgtctccaccatggcctgggctctgctatccctcaccctcctcactcagggcacagggtcctgggcccagtctgccctgactcagcctgcctccgtgactgggtctcctggacagtcgatcaccgtctcctgctctggctccagtagtgacgtcggtgcttataattttgcgcctggtaccaacaacaccccggcgaacgcccccagactcataattatgatgtcactgatccggcctgacgggtttctaagtcgtcttctctggctccgaacgtccggcgaccgacggcctcccgtcgacctactccgtcccggcctaccgacggcgggaaggacggtagggtacgtagtttactttcgtcgtcgacgtcctacttaacttttaaccaaaccctacggaccctaccgtaaccctttcgacccttaccgttaccgggtaaaccgttcggggaaccctaccgggtttaccacgttacccggttacccgtacgggttacccgaaccggtaacccccgaaacgggtaaccccctaacccccgtaacgtttacccgttacccgtaaccgtttacccggttcccggttacccccccgtacccccgtttccccgttaccttaaaccg

SEQ ID NO: 55126 - DNA, 680 bp, Homo sapiens
  misc_feature: GYAE6OF02GD2TG.41.19.B08.1.454.CMB.1.raw
tcagtctatactatcacgaccggtgctcgatttagtgagtcagtaaggggtggggtctcaggaggcagcgctctcgggacgtctccaccatggcctgggctctgctatccctcaccctcctcactcagggcacagggtcctgggcccagtctgccctgactcagcctgcctccgtgactgggtctcctggacagtcgatcaccgtctcctgctctggctccagtagtgacgtcggtgcttataattttgcgcctggtaccaacaacaccccggcgaacgcccccagactcataatttatgatgtcactgacgtccggcctcgagggtttctaagtcgtcttctctggtcctacgtaacgtccggcgaaccgtacggccctccgtcgaccacttccgtcccggccctccgacggccgggaacggaccgggtagggtcgtaatttacgtttctcgacctaggtaccctcgttaacttttaacccgaacctacggacccctaacctacccgtttcgtacccgttaccgttaccgggtaaccgttacggggaacccttacgggtcctaacgttccgtacccgttagggtacccgacgaccccgtaacggaccccctaaaccctcgttaccggtacctacccgttcgttcccgttacccccgcccctttaccgtaccttaaccgg

SEQ ID NO: 55127 - DNA, 624 bp, Homo sapiens
  misc_feature: GYAE6OF02JFCUM.41.19.B08.1.454.CMB.1.raw
  modified_base (440)..(440): a, c, t, g, unknown or other
  misc_feature (440)..(440): n is a, c, g, or t
tcagtctatactatcacgaccggtgctcgatttagtgagtcagtaaggggtggggtctcaggaggcagcgctctcgggacgtctccaccatggcctgggctctgctatccctcaccctcctcactcagggcacagggtcctgggcccagtctgccctgactcagcctgcctccgtgactgggtctcctggacagtcgatcaccgtctcctgctctgctccagtgtgacgtcggtgcttatattttgcgcctgtaccaacaacacccggcaacgcccccagactcataatttatgatgtcactgatccggcctcgtacgggtttctaactcgtcttctcgtcggtcctccgaaggtccggacgaccgaccggccctcccgtacgacctactccgtcccggcctccgacgggcgggaggacggtagggtagtacttattcgngtcagccttctaactttaccaaccgaccgacctacctaccgttccgtcttaccgttacggaacgttccgggaccgttaccgtcaaccgttccggtaccttacggtccgagaccccgaaccggaccccaaccctactcgttaccgaccgttccgttcccgttccccgtcccttccctacctaacg

SEQ ID NO: 55128 - DNA, 577 bp, Homo sapiens
  misc_feature: GYAE6OF02FY8DE.41.19.B08.1.454.CMB.1.raw
  modified_base (262)..(262): a, c, t, g, unknown or other
  misc_feature (262)..(262): n is a, c, g, or t
  modified_base (447)..(447): a, c, t, g, unknown or other
  misc_feature (447)..(447): n is a, c, g, or t
tcagtctatactatcacgaccggtgctcgatttagtgagtcagtaagggggggagaggagccccagccttgggattcccaggtgttttcattcagtgatcaggactgaacacagaggactcaccatggagtttgggctgagctggattttccttgctgctattttaaaaggtgtccagtgtgaggtgcaggtgatggaatttgggggacgcctagttcggccggggggcccctaagactctcctgtctcgtctctgaacccncctttagcagctactggatgcactgggtccgccaagctccgaggaaagggcctgatgtgggtctcacgtattaacaccgatcgggactatcacttggttactcgagacgccgtagaacgggccgtagttcatcatctccagacgaacaatgtaacgaaacgacggtagttaatttaacaaagtanaacagtactaagagtacgaggacgacggctgtctattacttgtgtgatactatgtattctagttgggagtttagtcggtttggccctacgacggtcgggcgtacgggtacctttcgggtccgtcgttccc

SEQ ID NO: 55129 - DNA, 552 bp, Homo sapiens
  misc_feature: GYAE6OF02FPQE8.41.19.B08.1.454.CMB.1.raw
  modified_base (407)..(407): a, c, t, g, unknown or other
  misc_feature (407)..(407): n is a, c, g, or t
  modified_base (446)..(446): a, c, t, g, unknown or other
  misc_feature (446)..(446): n is a, c, g, or t
tcagtctatactatcacgaccggtgctcgatttagtgagtcagtaaggggtggggtctcaggaggcagcgctctcgggacgtctccaccatggcctgggctctgctatccctcaccctcctcactcagggcacagggtcctgggcccagtctgccctgactcagcctgcctccgtgactgggtctcctggacagtcgatcaccgtctcctgctctggctccagtagtgacgtcggtgcttataattttgcgcctggtaccaacaacaccccggcgaagcccccagactcataatttatgatgtcactgatcggccctcgaggggtttctaatcgcttctctggctccaagtccggcgaccacggcctccctgacccatcctccggcctccaggcgaggacgagggtnagttattcgtgcagctcatttacactagccactaccttnctcttcgactggacctacggtcacgtcgttcctaggtccacggtacccgaaggcccaaacccccactaccgtcaccttcgtcgttcccccgcccttccctctaacg

SEQ ID NO: 55130 - DNA, 776 bp, Homo sapiens
  misc_feature: GYAE6OF02FOSHZ.41.19.B08.1.454.CMB.1.raw
tcagtctatactatcacgaccggtgctcgatttagtgagtcagtaaggggtggggtctcaggaggcagcgctctcgggacgtctccaccatggcctgggctctgctatccctcaccctcctcactcagggcacagggtcctgggcccagtctgccctgactcagcctgcctccgtgactgggtctcctggacagtcgatcaccgtctcctgctctggctccagtagtgacgtcggtgcttataattttgcgcctggtaccaacaaccaccccggcgaacgcccccagacctcattaatttatgtatgtcactgactccggccctcgtaggggtttactaagtcgtcttctcgtcggccttaccgaacgtccggacgaccgaccggtccctacccgtcgaaccctacttcccgtcccggtccctaccggacgggaccgggaacgggaccggtaggggttgtaacgttttaacgtttccgtacggtaccgtacggtccttacgtaaacgttttaacccgaaacccgtaccggtacccctaaccgttacctttacggtcccgtttaccggttacccgggtaaaccggttccggggtaaccccgttaaccgggttacctaacggttttacccggttacccgttaaccgggttccgaaccggaacccccggtaaaccggggaacccccctaaacccccgtaacgttacccgtttacccgtacccgtttcccgttacccggtttacccccccgtacccctttaccccgtacgttaaacccgg

SEQ ID NO: 55131 - DNA, 771 bp, Homo sapiens
  misc_feature: GYAE6OF02HJR1R.41.19.B08.1.454.CMB.1.raw
  modified_base (292)..(292): a, c, t, g, unknown or other
  misc_feature (292)..(292): n is a, c, g, or t
tcagtctatactatcacgaccggtgctcgatttagtgagtcagtaagggtggggtctcaggaggcagcgctctcgggacgtctccaccatggcctgggctctgctatccctcaccctcctcactcaggcacagggtcctgggcccagtctgccctgactcagcctgcctccgtgactgggtctcctggacagtcgatcaccgtctcctgctctggctccagtagtgacgtcggtgcttatattttgcgctggtaccaacaacacccggcaacgcccccagctcattaattangatgtctactgactccggcctcgacgggttttctaagtccgtccttcttctcggtcctaccgaacgtccgggaccgactaccggtcctaccctacggaccctacgtcccgtccccgggacccttacccggacggggtaccggggacgggaacccgggtaagggggttacgtaagttttaacgtttccgtacggtccgaaccggttccttaaccgtttaactttaaacccgaaacccgtacggtacccctaaccgtaccccgtttggacccctttaccgtttaccgggtaaacccttccgggggaaacccgttacccgggttaccgtaaccggttcccggttacccgttaacgggtacccgtaacccggtacccccggaaacccggtcccccgtaaaccccgtaccgttacccgtacccgtaccctttaccggttacccgttacccccccggtacccctttacccgttacccgtaaccgg

SEQ ID NO: 55132 - DNA, 780 bp, Homo sapiens
  misc_feature: GYAE6OF02IP6E4.41.19.B08.1.454.CMB.1.raw
tcagtctatactatcacgaccggtgctcgatttagtgagtcagtaagggtggggtctcaggaggcagcgctctcgggacgtctccaccatggcctgggctctgctatccctcaccctcctcactcagggcacagggtcctgggcccagtctgccctgactcagcctgcctccgtgactgggtctctggacagtcgatcaccgtctcctgctctggctccaggtagtgacgtcggtgcttataattttcgcgcctggtaccaacgaaccacccccggcgaacgaccccccaggactacgattaacgtttatcgtatgtccgtacgtcgtacgttaccggcccttacgtagggttttcctaacgtcgtcgttctcgtcggccttccgaaacgttccggacgtaccacgggtaccctcccggtacgaaccctacgtacccgttcccggtacccgttcccaacggggtacccgggtaacgggtaaccggtacggggttacggtaacgttttaaccggtttccggtacggtaccgtaacggttacccgttaccgtttaacgttttaaacccgaaacccgttacggtaacccctaacgtaacccgtttaggaccctttaacgtttaccggaaaccgttacgggtacccgtaaccgggttactacgttacccggtaccgttacggtccgtaacgaccccggtaaagggtaccccctaaacccgtacgtaccgttaccgttaccgttccggtttaccgttacccccacccgttaccgtaccttaacgg

SEQ ID NO: 55133 - DNA, 630 bp, Homo sapiens
  misc_feature: GYAE6OF02I6OAC.41.19.B08.1.454.CMB.1.raw
  modified_base (503)..(503): a, c, t, g, unknown or other
  misc_feature (503)..(503): n is a, c, g, or t
tcagtctatactatcacgaccggtgctcgatttagtgagtcagtaagggttggggtctcaggaggcagcgctctcgggacgtctccaccatggcctgggctctgctatccctcaccctcctcactcagggcacagggtcctgggcccagtctgccctgactcagcctgcctccgtgactgggtctcctggacagtcgatcaccgtctcctgctctggctccgagtagtgacgtcggtgcttataattttgcgtcctggtaccaacaaccaccccggcgaagcccccagacctcattaatttatgatgtacactgacgtcggaccctcgtaggggtttactaattccgtctttccgtctcggcctaccgtaacggtcccggacgtaccgaccggtccctacccgtcgtaacctactccgtcccggcccttccggaacgggccgggacggacggtacgggtagtatttacgtttcgtcgctacgtcttaccttattaaccaaccncgacccactaccttgtccttacgtacggactcgggacctacgtcacgttcgtactacgtccacgccgaacggacccaaccctacgtcgcctacgtcccgttccttaccccgacccttactctaaccg

SEQ ID NO: 55134 - DNA, 693 bp, Homo sapiens
  misc_feature: GYAE6OF02IREXP.41.19.B08.1.454.CMB.1.raw
  modified_base (298)..(298): a, c, t, g, unknown or other
  misc_feature (298)..(298): n is a, c, g, or t
tcagtctatactatcacgaccggtgctcgatttagtgagtcagtaaggggtggggtctcaggaggcagcgctctcgggacgtctccaccatggcctgggctctgctatccctcaccctcctcactcagggcacagggtcctgggcccagtctgccctgactcagcctgcctccgtgactgggtctcctggacagtcgatcaccgtctcctgctctggctccagtagtgacgtcggtgcttataatttgcgctgtaccaacaaccaccccggcaacgcccccagactcaataactttangtatgtcacgtgacgtccgccctggtacgggtttcctaatccgtctttctcgtcgtctaccgaacgtccggccgaccgtaccggtccctcccgtacgtaccctacttcccgtccccggcccttaccggacgggccggacgggaacggtaaggggtctaagtttctttcgaggtcagtccttacttaactttaaaccaccgtacgtaccctacctacccgttagtcccgttaccgttaccgggtaaccgttaccgggaacctaccggttaaccgtacgttacccgttacgtaacggtaccgaacggtaacccccgaacggtacccccaaaccccgttacgtacccgttacctaaccttcccgttaccgttaccccctaccccttactccgtaaacg

SEQ ID NO: 55135 - DNA, 734 bp, Homo sapiens
  misc_feature: GYAE6OF02ITHKC.41.19.B08.1.454.CMB.1.raw
tcagtctatactatcacgaccggtgctcgatttagtgagtcagtaaggggtggggtctcaggaggcagcgctctcgggacgtctccaccatggcctgggctctgctatccctcaccctcctcactcagggcacagggtcctgggcccagtctgccctgactcagcctgcctccgtgactgggtctcctggacagtcgatcaccgtctcctgctctggctccagtagtgacgtcggtgtcttataattttcgcgcctggtaccaacaaccaccccggcgaacgcccccagactcaattaatttatgattgtcactgtactccggcccttcgtaggggtttactaacgttcgtcttctcgtggcctaccgaacgtccggacgacgacccggtcctcccgtacgtaacccacttcccgtcccggtaccctccggacggggaccgggtaacgggaacgggtacggggttacgtaacttttacggttttctcggtacctacggtaccttacgtaaacttttaacccgaaacccgtacggacccctaaccgtacccgttcgtcctttaccggttaccggtaaaccgtccggggaaccctaccgggttctacgttccgtaccgttacggtaccgaacgtaccccgaaacggtacccccaaacccctaacgttaccgtaccttaacccgtttcccgttacccggtttccccccgtaccccgtttaccctaccgttaaaccgg

SEQ ID NO: 55136 - DNA, 778 bp, Homo sapiens
  misc_feature: GYAE6OF02HCO1H.41.19.B08.1.454.CMB.1.raw
tcagtctatactatcacgaccggtgctcgatttagtgagtcagtaaggggtggggtctcaggaggcagcgctctcgggacgtctccaccatggcctgggctctgctatccctcaccctcctcactcagggcacagggtcctgggcccagtctgccctgactcagcctgcctccgtgacgtgggtctcctggacagtcgatcaccgtctcctgctctggctccagtagtgacgtcggtgtctttaattaattttgtccgccgttaggtaacccaaacaaccgtacccccgggacgaaccgccccccgagaccttacaactttaaatttactgtaattcgtacctaactggaacgttcccgggtccccttcggttacggggttttactaacgttccgtctttcctccggtcggaccccgtaaaggtccccgggtacgaaccgtaccggtcccctcccgtacgaccctacgtcccgtcccggccctccggagggtaccgggagggacggtaggggtcgtaacgttttacgtttccgtggaccgtacgtcctacgttaacgtttaaacccaacccgtaccggtccctaacccgtttacccgttcgtacccgtttccggttaaccgggtaaccggtaccgggtaacccgtacccggttactacgttacccggtaccggttacgtaccgaccgacccgtaaaccggcccctaaccccgtacgtccgttacctaccgtccgtttacccgtcccccgttacccgttccccttacgtacgttaaccg

SEQ ID NO: 55137 - DNA, 821 bp, Homo sapiens
  misc_feature: GYAE6OF02GYIJ9.41.19.B08.1.454.CMB.1.raw
tcagtctatactatcacgaccggtgctcgatttagtgagtcagtaaggggtggggtctcaggaggcagcgctctcgggacgtctccaccatggcctgggctctgctatccctcaccctcctcactcagggcacagggtcctgggcccagtctgccctgacctcagcctgcctccgtgactgggtctcctggacagtcgatccaccgtctcctgctctcgctccagtagtgacgtcggtcgtcttaattatttgcgtccgtgtaccaacaaccaccccggacgaaccgcccccagactctattaattatagtatcgttacactgtaacgtcccggtcccgtagttacggggttttactaacgttccgtacctttcctcgttcggtacctacccgtaacggtccgggtacccgtaaccgtacccggtcccgttcccgtacgtaacccctaccttcccggtacccccggtcccttacccggacggggtaccgggaacgggtaaccgggtaggggttacgttaacgttttacgtttacgtcgtacccgtacgttccgttaaccgttaaacgtttaacccgaaaacccgttccggaccctaacccgtttacccgtttccgttaccgttacccgttaacccgggaaccgtttacccggggaacccttaccgggtttaccgaaccgtttacccggtacgttaaccgggtaccgtaacccgaccccgggtaaaccggtaacccccctaaacccggtcctttaaccggtaccctaaccgttcccggtttacccctcccccgggtttaacccttcccgttaccttaaacgg

SEQ ID NO: 55138 - DNA, 717 bp, Homo sapiens
  misc_feature: GYAE6OF02G5WEQ.41.19.B08.1.454.CMB.1.raw
tcagtctatactatcacgaccggtgctcgatttagtgagtcagtaaggggtgggggtctcaggaggcagcgctctcgggacgtctccaccatggcctgggctctgctatccctcaccctcctcactcagggcacagggtcctgggcccagtctgccctgactcagcctgcctccgtgactgggtctccgtggacagtcgatccaccgtctcctgctctcggctccgagtagtgacgtcggtgcttatattttgcgctgtaccaacaaccaccccgcgaacgcccccagactcataatttatagatgtccatgacgtccgccctcgtacgggtttctaatcgtcttctcgtcgtactccgaacgtccggacgaccgaccgccctccctacgtacccacttcccgcccgtcccgtccggacgggtacggacgggtacggtagggtgttaactttacgttcgtacgacgtacgtccttacgttaactttaacccaacccgtaccgaccctacccgtaccgttacgtccgtttaaccgttccgggtaaccgttaccgggtacccgttaaccggttacgtaccgtttacccggtaccgttaacggtccgaacccggtaccccgtaacccgggtaaccccctaaaccccgtacggttaacccgttaccttaccccttcggtttaccccgttccccccgtacccttacccggttactaacccgg

SEQ ID NO: 55139 - DNA, 610 bp, Homo sapiens
  misc_feature: GYAE6OF02IQZ1S.41.19.B08.1.454.CMB.1.raw
tcagtctatactatcacgaccggtgctcgatttagtgagtcagtaaggggtggggtctcaggaggcagcgctctcgggacgtctccaccatggcctgggctctgctatccctcaccctcctcactcagggcacagggtcctgggcccagtctgccctgactcagcctgcctccgtgactgggtctcctggacagtcgatcaccgtctcctgctctggctccagtagtgacgtggtgcttataatttcgcgtcctggtaccaacaaccacccggcgaagcccccagactcataatttatgatcgtcactgactcggccctcgtaggggtttctaatcgtcttctcgtggctcacgtccgcgacacggcctcctcgaccatccgtcccgtcctccgacgggcggtaggaccggtagggtcgtatttacgtttcgtacgctacgcgttactaactttaacaaccctacgccctaaccgtacctttcgaccttcgttacggaacgtcgggacctacggtactacgtccgttactacggttcgacgtaacccgaacgtaccccaaacccgtctcgtactaccgttctccgttaccccacccgttccctactaacg

SEQ ID NO: 55140 - DNA, 652 bp, Homo sapiens
  misc_feature: GYAE6OF02HTC23.41.19.B08.1.454.CMB.1.raw
tcagtctatactatcacgaccggtgctcgatttagtgagtcagtaagggggtggggtctcaggaggcagcgctctcgggacgtctccaccatggcctgggctctgctatccctcaccctcctcactcagggcacagggtcctgggcccagtctgccctgactcagcctgcctccgtgactgggtctcctggacagtcgatccaccgtctcctgctctggctccagtagtgacgtcggtgtcttatattttgcgcctgtaccaacaaccaccccggcaacgcccccagactcattaatttatgatgtcactgactccggccctcgtagggtttctaatcgtcttctcgtggtcctccgtaacgtcccggcgaccgaccggtccctcccgtcgaccctactccgtcccggccctccgacgggcggacggacggtagggtcgtatttactttcgtcgcgacgtccttactaactttaccaaccacgcccacctccttcgtccttaccgttaccggaaccgtcgggaaccctacggttctacgtccgtaccctaggtacccaccggtaccccgaaccggacccccaaccccgtaccttccgttacctacccgtttcccgttacccgttcccccgtaccccttacccgttactaacg

SEQ ID NO: 55141 - DNA, 813 bp, Homo sapiens
  misc_feature: GYAE6OF02H7HID.41.19.B08.1.454.CMB.1.raw
tcagtctatactatcacgaccggtgctcgatttagtgagtcagtaagggggggggtctcaggaggcagcgctctcgggacgtctccaccatggcctgggctctgctattcctcaccctcctcactcagggcacagggtcctgggcccagtctgccctgactcagcctgcctcgtgtcgtgggtcacctggacaggtcggtcaccatctcctgacacgtgggacgccaaggtacggttaaattactttcttaagttacttttaaacttttgtaccttccttggtacttacaactactactacttaccgaacggtaaaacctaccccctaaaactctaactactaacttacttaagtaggtaacggtaccttaagtaaacggaccggtccccgttaggttaacggggttttacaacgttccgtacttacacttaccgacctaacccgtaaccggtaccggaaccaaacccggtacccggtcccttacccgtacgtaacctaaacttccgtaccggtcgggtaccttccgggaggtcgtagggacggaacggtacgggtcttagttactttaagttttacgttcgttacgtacctacgtaacggttagtttccggttccgtacgtaccttaacgttaccgttaacgtttacttcggtttaaccggttaacgggtacggtaacggaaccgttaacgggtcctacccggttacccggtaggtccgaaaccggacccgtaaacccgaacccccgtaacccgtacggtaccgtttaaccctacccggttttacccgttaccccgttacccccgtaacccc

SEQ ID NO: 55142 - DNA, 635 bp, Homo sapiens
  misc_feature: GYAE6OF02HGFS8.41.19.B08.1.454.CMB.1.raw
  modified_base (239)..(239): a, c, t, g, unknown or other
  misc_feature (239)..(239): n is a, c, g, or t
  modified_base (295)..(295): a, c, t, g, unknown or other
  misc_feature (295)..(295): n is a, c, g, or t
tcagtctatactatcacgaccggtgctcgatttagtgagtcagtaaggggtggggtctcaggaggcagcgctctcgggacgtctccaccatggcctgggctctgctatccctcaccctcctcactcagggcacagggtcctgggcccagtctgccctgactcagcctgcctccgtgactgggtctcctggacagtcgatcaccgtctcctgcctctggcctccagtagtgacgtcggtncttatatttgcgctgtaccaacaccacccggcacgcccccagactcaattaattangtatgtcacgtgacgtccggcctgtacgggtttactaagtcgtcttctcgtgacctaccgacggtccggacgtaccgaccggtcccttacccgtcgaaccctacgttccgtacccggtccctaccgacggggaccgggacgggaaccggtaggggttacgtatttactttcgtgacgacgtctacttaacttaccaacccgtacgaccctactccgttgtccgttacgttaccgtacgtcggaccgtacgtctacgtcgtaccgtaggccaccgacccgaacgaccccacctcgtaccgtcctaccgtccgttacccgtccccgtaccttcctacctacg

SEQ ID NO: 55143 - DNA, 789 bp, Homo sapiens
  misc_feature: GYAE6OF02IKCGM.41.19.B08.1.454.CMB.1.raw
  modified_base (341)..(341): a, c, t, g, unknown or other
  misc_feature (341)..(341): n is a, c, g, or t
  modified_base (499)..(499): a, c, t, g, unknown or other
  misc_feature (499)..(499): n is a, c, g, or t
tcagtctatactatcacgaccggtgctcgatttagtgagtcagtaagggtggggtctcaggaggcagcgctctcgggacgtctccaccatggcctgggctctgctactcctcacctcctcactcagggcacagggtcctgggccagtctcgcctgactcacgcctcgcctccgtcgacgttcgggtcctccgtcggacagtcgacttcgaccgtctccgtgctcgtggccttccagtagtcggacgtcggtgtactttattaagttttcgcgtccgtacggtaaccaaacaaccgacccggacgaaaccgacccccaagacctacaacttaaacgtttacngtattcgtacacgtcgtacgtccggaccttacggtacgggttttactaacgttcgtctttctacgtcggaccttaccgtaacggtccggacgaccgtaccggtcctccgtacgacctactccgtcccggctccgacggacggacggaacggtagggtntaacgtttacgtttcgacgtctaaggtccttacgttaacgtttaaccaaccgtaacgtacccgtaactacccgtttcgtaccctttaccggttaccggtaaacgttaccggggtaacccgttaccgggttaccttaaacggttcccggtttaaccgttaccgggtaccgtaaccggtaacccggtaaaccgggaaccccctaaaccccggttaaccgttacggtaaccccttaccggtttacccgttcccgggtttaccccctaccccgtttacccttaccgttaaaccg

SEQ ID NO: 55144 - DNA, 718 bp, Homo sapiens
  misc_feature: GYAE6OF02HFMQZ.41.19.B08.1.454.CMB.1.raw
  modified_base (236)..(236): a, c, t, g, unknown or other
  misc_feature (236)..(236): n is a, c, g, or t
  modified_base (296)..(296): a, c, t, g, unknown or other
  misc_feature (296)..(296): n is a, c, g, or t
tcagtctatactatcacgaccggtgctcgatttagtgagtcagtaaggggtggggtctcaggaggcagcgctctcgggacgtctccaccatggcctgggctctgctatccctcaccctcctcactcagggcacagggtcctgggcccagtctgccctgactcagcctgcctccgtgactgggtctcctggacagtcgatcaccgtctcctgctctggctccagtagtgacgtcgtncttataatttgcgctggtaccaacaacacccgagaacgcccccaagactcaattaattangtatgtacactgacgtccggccctacgtagggtttactaagtcgtacttctcgtgcctacgaacgtccggacgaccgtaccggcccttccgtactaacccgtacttcccgtacccggtcccttaccgaggggtaccgggaacgggacggtaaggggtacgttaacgtttaacgttttcgtacgactacgtcttacttaactttaaacccgaaacctacggacccaacctaccgttacgtaccgttcgttaaccgggtaacgtacgggaacctacgggttaccgtaacttaccggtaccgttacggttaccgaaccggtaccccggtaaacggaccccctaaaccccgtacgtaccggttaccctaaccggttacccttacccggttaacccccccgtaccccttacgtaaaccgttaacggg

SEQ ID NO: 55145 - DNA, 637 bp, Homo sapiens
  misc_feature: GYAE6OF02F7N72.41.19.B08.1.454.CMB.1.raw
  modified_base (625)..(625): a, c, t, g, unknown or other
  misc_feature (625)..(625): n is a, c, g, or t
  modified_base (633)..(633): a, c, t, g, unknown or other
  misc_feature (633)..(633): n is a, c, g, or t
tcagtctatactatcacgaccggtgctcgatttagtgagtcagtaaggggtggggtctcaggaggcagcgctctcgggacgtctccaccatggcctgggctctgctatccctcaccctcctcactcagggcacagggtcctgggcccagtctgccctgactcagcctgcctccgtgacgtgggtctcctggacagtcgatcaccgtctctgctctggctcagtagtgacgtggtgtcttattaattttcgtcgtcctggtaaccaaaccaaccgaccccggaccgaacgcccccagactactaattaatttatgatcgtacactgtactccggtccctcggtacgggtttactaagtcgtcttctcgtcggcctaccgtagtcccggacgacccgaccggtccctccctacgaccctactccgtcccggtccctccggacggggtccgggaacggacggtagggttagtatttactttcgtcgtcacgtctacttaactttaacaaccacgccaacctccgttcgtcttaccgttacggaacgtcgggaccctacggtctacgtcgttaccgagtcaccgtacccgaacggacccaacccgactcgtacctcctcttcctacccnccctcctntaac

SEQ ID NO: 55146 - DNA, 833 bp, Homo sapiens
  misc_feature: GYAE6OF02FV1XM.41.19.B08.1.454.CMB.1.raw
  modified_base (369)..(369): a, c, t, g, unknown or other
  misc_feature (369)..(369): n is a, c, g, or t
tcagtctatactatcacgaccggtgctcgatttagtgagtcagtaagggggtgggggtctcaggaggcagcgctctcgggacgtctccaccatggcctgggctctgctatccctcaccctcctcactcagggcacgagggtcctgggcccagtctgccctgactcagcctgcctccgtgacgtgggtctccgtggacagtcgatcaccgtctcctgctctggctccgagtagtgacgtcggtgtacttaattaattttgcgtcctggtaaccaacaaccgacccggacgaaccgcccccagactacattaattatagatgtacactgacgtccggtccttaggtacgggtttactagtcgtccgtttcncgtcgtcctaccgtaacggtccggtaccgaaccgtaccggtccctacccgtacgtaaccacgttacccccgtcccggtaccccttacccgggaacggggtcccggggaaacggtaccggggtaaacgggttacgggttaatttttaacgtttccggtacggtacccgtaggttcccttaaccgtttaaacctttaaacccggaaaccttaaccgacccctaaaccgttacccggtttcttaccggttacccggtttaacccgggtaaccggtttaaccggggaacccttaaccggggttcctaaccggtttacccgtacccggttaagggttaaccccgaacccggtaaaccccggaaacccggttaacccccgtaaacccccggtatttaacccgggtaaccttacccggtttacccgtttcccccggttacccccgtcccctttaccccggtaattaaccgg

SEQ ID NO: 55147 - DNA, 715 bp, Homo sapiens
  misc_feature: GYAE6OF02ISXXM.41.19.B08.1.454.CMB.1.raw
  modified_base (216)..(216): a, c, t, g, unknown or other
  misc_feature (216)..(216): n is a, c, g, or t
  modified_base (221)..(221): a, c, t, g, unknown or other
  misc_feature (221)..(221): n is a, c, g, or t
  modified_base (245)..(245): a, c, t, g, unknown or other
  misc_feature (245)..(245): n is a, c, g, or t
  modified_base (569)..(569): a, c, t, g, unknown or other
  misc_feature (569)..(569): n is a, c, g, or t
tcagtctatactatcacgaccggtgctcgatttagtgagtcagtaaggggtggggtctcaggaggcagcgctctcgggacgtctccaccatggcctgggctctgctactccctcaccctcctcactcagggcacgagggtcctgggcccagtctcgccctgacctcagcctcggcctccgtgacgtgggtctccgtggacagtcgatccgacgtcnctgcncgtgctacgagttagcgcgtggtntacttaattattttcgcgtcttacggaaccaaaccgaaccgacccggacgaaccgccccgagtacctacaattaaactttagtgtaatctctaacgtgacgtccgtccgtacggttacgggtttactaagttccgtcttcgttcgtcggacctaccgtaacggtcccggagtaaccgccgggtaccctcccgtacgacctacgtccggtcccggtacctacccggagggacgggaggaaccgggagggttaaacttacgttactttagcgtacgtcgtaccttaacttaacgttaaacaacccgtacaaccctactaccgttancccgtttacgttaacccgggacggtaccgggtaccgtaaccgtccgtacggtccgttacgtaccgttacgacccgaaccgacccggaaccctaacccgtaacgttccgtaactccgtcttccgttccccgcttacccgtataacgg

SEQ ID NO: 55148 - DNA, 763 bp, Homo sapiens
  misc_feature: GYAE6OF02JI1RM.41.19.B08.1.454.CMB.1.raw
  modified_base (401)..(401): a, c, t, g, unknown or other
  misc_feature (401)..(401): n is a, c, g, or t
tcagtctatactatcacgaccggtgctcgatttagtgagtcagtaagggtgggggtcgtcaggaggcagcgctctcgggacggtctccaccatggcctgggctctgctatccctcaccctcctcactcaggcaccaggtcctgggcccagtctgccctgtacctcagcctgtcctccgtcgactgggtctcctggacagtcgatcaccgtctcctgctctcggcgtccagtagtgacgtcggtgcttatagtttgtcgctgtaccaacaactacccggcgaaccgccccagactacaataattacgtgactgtcacgtgacgtccggtccgtacgtacgggtttctaacgtcgtcttcgtcgtacgctacgaacggttccgacgaccgaccggtcctcccncgacctacgtccctcccgtacccgtcgacgggtaccgggaacggtaacgggtacgggtagtaagttttaactttcggtacgtaccgaaacgggttcccttaacgttaaaaccgttttaacccgaaaacccggtccgttaaaccccgaacctttaacccggtttgtaccccgtttacccgtttaacggggtaaacccgttaccgggggtaacccctacggggttacctaaccgtttacccgttacccggttaccgggtacctaacccgggtacccgaaaacccggtccccaaaaccccgttcgtacgtaccccgttaacgtttccttaccccgttccccggtcccctaccgttaccgtaaccg

SEQ ID NO: 55149 - DNA, 681 bp, Homo sapiens
  misc_feature: GYAE6OF02H1438.41.19.B08.1.454.CMB.1.raw
  modified_base (441)..(441): a, c, t, g, unknown or other
  misc_feature (441)..(441): n is a, c, g, or t
tcagtctatactatcacgaccggtgctcgatttagtgagtcagtaagggggtggggtctcaggaggcagcgctctcgggacgtctccaccatggcctgggctctgctatccctcaccctcctcactcagggcacagggtcctgggcccagtctgccctgactcagcctgcctccgtgactgggtctcctggacagtcgatcaccgtctcctgctctggctccagtagtgacgtcggtgtcttattaattttgtcgccttggtaccaaacaaccaccccggacgaacgcccccagacctcattaaatttatgtatgtcactgactcggccctgtacgggtttactaagtcgtcttcgtcgtcggtctccgaaggtccggcgacaccggcctccctgaccactccgtcccgcctccgacgggcggacggacggtacggggttntaactttactttcgtcgcgtacgtcttacttaactttaccaaacccgacgtacccaacctaccctttcggccctttaccgttaccgggtaaccgtcggggaacccgtaccgggttactacgttcccgttaccgttacggtaccctaacggtaccccgaaacggtacccccaaaccccgtcgttaccggtaccctaccgttccgttccccgttcccccgtccccctttctacccgttaacg

SEQ ID NO: 55150 - DNA, 860 bp, Homo sapiens
  misc_feature: GYAE6OF02G1X8P.41.19.B08.1.454.CMB.1.raw
tcagtctatactatcacgaccggtgctcgatttagtgagtcagtaaggggtggggtctcaggaggcagcgctctcgggacgtctccaccatggcctgggctctgctatccctcaccctcctcactcgagggcacagggtcctgggcccagtctcgcctgactcagcctgcctccgtgacgtgggtctccgtggactagtcgactcaccgtctcctgctcgtcggctccgagttacgtcggtacgtcggtacgtactttattaacgttttcggccgtccgttacggtaacccaaacgtaacccgaccccggtacgaaccccgccccctaagaccttacgtaaactttaagttttacgtacggtacgttacggtaccgtaaccgtcggtaaccggtcccggttacccgtttacggggttaacggggttttacccttaacgttccggttacctttaccgttccggtaccggtacccgttaaccggtaacccgggttcccggaaccgtacccggaccccggttaccccgtacccgtacgtaccctaccgtcccggtacccggtccgtaccgggacggggtacgggaacgggtacggtacgggttattacgttttacgtcgtacgtacgtcgtaccgtaaccttaacgttaacccgaacccgtccgaacccttaaccgtccgtttaccggtccgtttaccggtaacgggtaccggttaaccgggtacccgtacgttacgttaaccgttccgttaacccggtagaccgaacccggtaccgtaaccggtaacccttacgtaccccggactttcccggacctttccggttaccccgtcccgtttacccccgttacccgtacgttaacg

SEQ ID NO: 55151 - DNA, 748 bp, Homo sapiens
  misc_feature: GYAE6OF02IVPWI.41.19.B08.1.454.CMB.1.raw
  modified_base (151)..(152): a, c, t, g, unknown or other
  misc_feature (151)..(152): n is a, c, g, or t
  modified_base (210)..(210): a, c, t, g, unknown or other
  misc_feature (210)..(210): n is a, c, g, or t
  modified_base (239)..(239): a, c, t, g, unknown or other
  misc_feature (239)..(239): n is a, c, g, or t
  modified_base (291)..(291): a, c, t, g, unknown or other
  misc_feature (291)..(291): n is a, c, g, or t
tcagtctatactatcacgaccggtgctcgatttagtgagtcagtaaggggtggggtctcaggaggcagcgctctcgggacgtctccaccatggcctgggctctgctatccctcaccctcctcactcagggcacagggtcctggcccagtcnnccctgactcagcctgcctcgtgactgggtctcctggacagtcgatccaccgtctcctncctctgctccagtagtgaccggttcggtntcttatatttcgccgcttggaaccaacaaccgtcccggacgaacgcccccanacctcacgttaatttatagtatgtacagtcgacgtccggtcctcgttagggtttactagttccgtactttctacgtcgttaccctacgtacggtccggtaccgaccgtccggtacctccgttcgacctacttccgacccggtcctacgacggggtcggacggacggtacggtacgttactttagtttcctagtaccgtacgtaccgttaacgttaacgtttaacccacggtaacgtaccctaaccgtaccgttacgtaccggtttacggttacccggaaaccggttaccgggtaaccttaccgggttacgttacggttacccggtaccggtttaaccggttccgaaccgtttaaaccccggcccgggtaaaccccctaacccggtaccttaccggttaccctacccgttcccggtttacccgttacccccggtacccttaccgttaacccgttaacg

SEQ ID NO: 55152 - DNA, 736 bp, Homo sapiens
  misc_feature: GYAE6OF02GPDQ8.41.19.B08.1.454.CMB.1.raw
  modified_base (306)..(306): a, c, t, g, unknown or other
  misc_feature (306)..(306): n is a, c, g, or t
tcagtctatactatcacgaccggtgctcgatttagtgagtcagtaaggggtggggtctcagggaggcagcgctctcgggacgtctccaccatggcctgggctctgctatccctcaccctcctcactcagggcacagggtcctgggcccagtctgccctgactcagcctgcctccgtgactgggtctcctggacagtcgatcaccgtctcctgctctggctccagtagtgacgtcggtgtcttataattttgtcgccttggtaccaacaaccaccccggcgaacgcccccagacctcaataatttangatgtcactgatcgccctgtagggtttctaatcgcttctcgtcggctccaacggtccggcgacaccggtccctccctggaccctactccgtcccggccctccgtacgggccgggacggaccggtaggggttgtaactttacgtttcgtgaccgtacggtccttaccttaacgttttaacccaaacccgtacgtaccctaaccgtaacccgtttcgtaccctttacccggtttaccgggtaaaccggttccggggtaaacccctaaccggggttcctaaccgtttacccgggttacccgttaaccgggttaccgaaccggttaacccccgggaaaccggtaacccccctaaaccccgtaccgttacccgtaccgtaacccgttcccgttacccggtttaccccccgacccgttttaccctacccgttaacg

SEQ ID NO: 55153 - DNA, 689 bp, Homo sapiens
  misc_feature: GYAE6OF02FSHVU.41.19.B08.1.454.CMB.1.raw
tcagtctatactatcacgaccggtgctcgatttagtgagtcagtaaggggtgggggtctcaggaggcagcgctctcgggacgtctccaccatggcctgggctctgctatccctcaccctcctcactcagggcacagggtcctgggcccagtctgccctgacctcagcctgcctccgtgacgtgggtctcctggacagtcgatcaccgtctcctcgctcgtggctaccgagtagtcgacgttcggtgtccttaattaacgttttcggccgtccgtacgtaacccaaccgtaacccgtaccccggaccgtaacccgacccccgaagtacctactaacttaacgttacgtacgtacgttcgtactaacgttacgtaccgtccggtaccgtacggtacggtttactacgttcgtcttcctcgtcggtacctaccgtacggtccgaccgtacgaccgtccctccgtacgacctcgtccgtaccgtccgtacgcggaccggacggtacggtagggtctacgtttacgttcgtacgtctacgtcttactaactaccacgtaccgtacctactctcgtcctacgtacgacgtaccggacgtacgtctacgttcgtacgtacgaccgacgtaccgaaccgacccgtacccgtgtacctactaccgttccgttcccgtcccctacccgtcgtacgtacg

SEQ ID NO: 55154 - DNA, 1010 bp, Homo sapiens
  misc_feature: GYAE6OF02JC5JD.41.19.B08.1.454.CMB.1.raw
tcagtctatactatcacgaccggtgctcgatttagtgagtcagtaaggggtggggtctcaggaggcagcgctctcgggacgtctccaccatggcctgggctctgctatccctcaccctcctcactcaggcacagggtcctgggcccagtctgccctgactcagcctgccctccgtgaccgtgggtcctcctggactagtcgatccgacccgttctccgtagccttcgtcggtcctacccgtaagttacggtcggtaaccggttccgggttgtacgttttaatttaaacgtttttcggtaccgtaccgttacgggtaaaccccaaaccgtaaacccggaaccccccgggacgtaaacccgaccccccccgtaagacccttaccgaaatttaacgttttaacgtagtaaccgttcggtaccaccgttacgtacgttccccgggtcccgtttaccggttaaacggggtttttaacctaacggttcccggttcctttccgttccgggttaaccgttcccgtacccggtaaacccggttcccgggaccccgtaaacccggtcccggtaccccttacccggtaccgtaaccccgtacgtttccccggtccccggtacccctaccgggaacggggtaccggggtaaaccgggtaaccggggtacggggtttaccgtaaacgttttcgtttaacccgtcggtaccgttacccggacttaaccgttaacttttaaacccgaacccgtaacccgtacccggtaaccctttaccgttaccgtaccccgttttaaccgggtaccgggttaaaccgttccccggggtaacccgttaaccgttaccggttaacccggttaccggttaccgggttaaccgggttacccgaccccgggtaaaccccggtaacccgggaaccccccgttaacctaccccggttaccggttaccctacccccgtttcccgggtttaacccccgtttccccccgggtaacccccttttcccgttaaccgttaacccggg

SEQ ID NO: 55155 - DNA, 792 bp, Homo sapiens
  misc_feature: GYAE6OF02JU149.41.19.B08.1.454.CMB.1.raw
  modified_base (114)..(114): a, c, t, g, unknown or other
  misc_feature (114)..(114): n is a, c, g, or t
  modified_base (141)..(141): a, c, t, g, unknown or other
  misc_feature (141)..(141): n is a, c, g, or t
  modified_base (267)..(267): a, c, t, g, unknown or other
  misc_feature (267)..(267): n is a, c, g, or t
  modified_base (722)..(722): a, c, t, g, unknown or other
  misc_feature (722)..(722): n is a, c, g, or t
tcagtctatactatcacgaccggtgctcgatttagtgagtcagtaaggggtgggggtctcaggaggcagcgctcgtcgggacgtctccaccatggcctggctctgctatcctcnccctcctcactcagggcacagggtccngggcccaggtctcgccctagactcacgtcctcgtccctccgtgaccgttgggtcctccgtaggactagtcgtactccgaccgtctcctgccttacgcggtctccgagttacgtcgacggttcggtnttactttagttaacgttttcgtccgtaccgtacggttaaaccaaaccgaccccgtacccgggaccgaacccgccccccgtaagtacccgttactaaactttaaaacgtttgtagtaacgttaccgttcgtaaccgttccgggtaacgttccccggtaccccgtttaacggttacggggtttaaccttaaccggttccgttaccgtttaccgtcggttccggacctttaccgggtaaaccggtcccggtacgacccggttaaccgtccccgttaccgtacgtacctaccgtccgttaccccggacccgtaaccggtcggggacccgtaacgggtaaccgggtggttacgttacgttactcgtacgcttacgcttacgtaactacaccacgttaccacgttaccttgtcccgttacgtaccgtagtacccgtactacgtcctagtccgtacgttacncgtacctaccggcctaccgaccgtactaccgttcgtaccttcgtacccgtcccctaacgttccgaatccg

SEQ ID NO: 55156 - DNA, 795 bp, Homo sapiens
  misc_feature: GYAE6OF02FJYVG.41.19.B08.1.454.CMB.1.raw
  modified_base (258)..(258): a, c, t, g, unknown or other
  misc_feature (258)..(258): n is a, c, g, or t
  modified_base (339)..(339): a, c, t, g, unknown or other
  misc_feature (339)..(339): n is a, c, g, or t
tcagtctatactatcacgaccggtgctcgatttagtgagtcagtaagggggtggggtctcaggaggcagcgctctcgggacgtctccaccatggcctgggctctgctatccctcaccctcctcactcagggcacgagggtccgtgggcccagtctcgcccctgacctcagcctgccctccgtagacgtcgggtctccgtcggacaggtcgactccaccgtctcctgctcgtcggcctccgagtacgtcgacggtggtntctttagttatttcggccgtacctacgtaacccaacgtacccgacccggcgaaccgccccagtactaccgtaatttacttncgtataccgtactagtctacggtccgtacccgtcggtcgggttttactaactccgtccgtcgtacttcgaccttaccggaacggttccccggacgacccgtaccggtaccctccggtacctacgtacccgttccccgaccgttaccccgcgggtaacgggccggtaacgggtacggtaaggggttgtttaactttaccggtttcgacggtacacggttaccctaacctttaaacccgtaaccctaaacccgacctacccctaaaccgttcccggtttacgtcccgtttccgggttaaccgtaacccgggttccgggaacccgttacccggttaccttacccggtttaccgtaccgttaccgtaccgaacccgtaccggaaaccccgtaccccgtaacccgtcgaccctacgttccctacccggttcccgtaccccttcgtaccctacgttaaccgg

SEQ ID NO: 55157 - DNA, 884 bp, Homo sapiens
  misc_feature: GYAE6OF02H19H0.41.19.B08.1.454.CMB.1.raw
  modified_base (290)..(290): a, c, t, g, unknown or other
  misc_feature (290)..(290): n is a, c, g, or t
tcagtctatactatcacgaccggtgctcgatttagtgagtcagtaaggggtggggtctcaggaggcagcgctctcgggacgtctccaccatggcctgggctctgctactccctcaccctcctcactcgacgggcacgtacgggtcctcgggcccagttccgtcgcccgttagacctcgacgcctcgtccgtccggtagtacgttcgggtcctacccgtgggaactcggtcgacttccgtaccgtccttcctgtcctcgtggaccttccgaagttcgtacgtcggtcggtnttacctttaatacgttttcgccgttacgacggttaaccaacaacccggtacccggacgaaccgtcccccaagaccttctaattaacgtttagtacgtcgttacgtaccgtacgtacgtaccgtccggaccgtttcgggtacgggtttacacgttcggtaccttcgtcgtacgtacgtcccgtaacgtccggagttacccgcccgtaccttccggactaccgtacgtcccgtccggtacctacgggacgggtaccggacgggttacggtacggttcgtacgtttacggttcgtacgtacgtacggttccttaagttcccgtaaaaccgtaccgtaacccgtcctaaccttaaccggttccggttaccgtttaaccgggttacccgggtaaccgggttccgggtaaacccgtaccgtttacccttaacggttcccgggtttaaacccgtttaacgggtacccggttacccgggttaaccccggaaaccccggtaccccggttaaaccccgaaccggtttaccgtttacccggttacccggttttcccggttacccctttaccccgtttacccgttaccccggttatttaaccccgg

SEQ ID NO: 55158 - DNA, 862 bp, Homo sapiens
  misc_feature: GYAE6OF02HTVAM.41.19.B08.1.454.CMB.1.raw
tcagtctatactatcacgaccggtgctcgatttagtgagtcagtaaggggtggggtctcaggaggcagcgctctcgggacgtctccaccatggcctgggctctgctatccctcaccctcctcactcagggcacgagggtcctgggcccagtctcgccctgacctcacgcctcgcccttccgtgacgtcgggtcctcctggacagtcgactccaccgtctcctgtctcgtcggccttaccgagttacgtcggtacggtcggtagttacttttaagtttacgttttcggccgtaccgttaacggaaaccaaaccgaacccggaccccggaacgaacccgcccccgtaagacttactaaatttaacgttagtagtaactcgttactacgttgtaccgtcccggtaccttagggtttacgggttactaagtccgttacctttcgtacgtcgtacccgtaccggtaaccggtacccggaccgtaacccgtacccgtacccgttaacccggtaccgaacccgttacttcccccggttacccgggaaccccgttaccggggaacgggggtaacccggggtaaccggggaaacggggttaagggtacttttaacgttttaccgttcgttaccggacgttaccgttaccttaaacgttaaccgtttaaacccaaccgtaccgaacccttacgtccgttaccgtaccgtttaccggtaaccggaaaccggtaccggaaccgttacgttaacgtaccgttaccgttaacgtaccgggtactaacccggaacccgtaaccgaccccaaaccgttccgttaaccgtaccgtaccgttccgttacccggttaccccgtaccttacctacgtaacgg

SEQ ID NO: 55159 - DNA, 430 bp, Homo sapiens
  misc_feature: GYAE6OF01CVKPJ.44.79.H02.1.454.CMB.1.raw
  modified_base (424)..(430): a, c, t, g, unknown or other
  misc_feature (424)..(430): n is a, c, g, or t
tcagacagtatatacacgaccggtgctcgatttagtgtcacacgaagggaaagggctggagtgggtggccaacgtgaggcaagatggagttagtaaatactatgcggacagtttgaagggccgattcaccatctccagagacaacgccaagaactctctgtatctgcaaatgaccagcctgagagtcgaggacacggctgtgtattactgtgcgaccatatcagcgcctggagtccgttctgagtacttccaagattggggccagggcaccctggtcaccgtcgcctcagcctccaccaagggcccatcggtcttcccctggcgccctgctccaggagcacctccgagagcacagcggccctgggctgcctggtcaaggactacttcctcgatcgcgtctgagcgggctggcaaggcgcatagnnnnnnn

SEQ ID NO: 55160 - DNA, 214 bp, Homo sapiens
  misc_feature: GYAE6OF01BB3BC.44.79.H02.1.454.CMB.1.raw
  modified_base (212)..(214): a, c, t, g, unknown or other
  misc_feature (212)..(214): n is a, c, g, or t
tcagacagtatatacacgaccggtgctcgatttagtgtcacacgaagggaaagggaaccctggtcaccgtctcctcagcctccaccaagggcccatcggtcttcccctggcgccctgctccaggagcacctccgagagcacagcggccctgggctgcctggtcaaggactacttcctatatactgtctgagcgggctggcaaggcgcatagnnn

SEQ ID NO: 55161 - DNA, 431 bp, Homo sapiens
  misc_feature: GYAE6OF01A24XK.44.79.H02.1.454.CMB.1.raw
  modified_base (423)..(431): a, c, t, g, unknown or other
  misc_feature (423)..(431): n is a, c, g, or t
tcagacagtatatacacgaccggtgctcgatttagtgtcacacgaagggaaagggctggagtgggtggccaacgtgaggcaagatggagttagtaaatactatgcggacagtttgaagggccgattcaccatctccagagacaacgccaagaactctctgtatctgcaaatgaccagcctgagagtcgaggacacggctgtgtattactgtgcgaccatatcagcgcctggagtccgttctgagtacttccaagattggggccagggcaccctggtcaccgtcgcctcagcctccaccaagggcccatcggtcttccccctggcgccctgctccaggagcacctccgagagcacagcggccctggctgcctggtcaaggctacttcctatatactgtctgagcgggctggcaaggcgcatagnnnnnnnnn

SEQ ID NO: 55162 - DNA, 151 bp, Homo sapiens
  misc_feature: GYAE6OF01BEUOC.44.79.H02.1.454.CMB.1.raw
  modified_base (151)..(151): a, c, t, g, unknown or other
  misc_feature (151)..(151): n is a, c, g, or t
tcagacagtatatacacgaccggtgctcgatttagtgtcacacgaagggaaggacacgacttgagattaagcgaactgtggctgcaccatctgtcttcatcttcccgccatctgatatatactgtctgagcgggctggcaaggcgcatagn

SEQ ID NO: 55163 - DNA, 214 bp, Homo sapiens; identical to SEQ ID NO: 55160
  misc_feature: GYAE6OF01CW06P.44.79.H02.1.454.CMB.1.raw
  modified_base (212)..(214): a, c, t, g, unknown or other
  misc_feature (212)..(214): n is a, c, g, or t

SEQ ID NO: 55164 - DNA, 432 bp, Homo sapiens
  misc_feature: GYAE6OF01DDEMS.44.79.H02.1.454.CMB.1.raw
  modified_base (338)..(338): a, c, t, g, unknown or other
  misc_feature (338)..(338): n is a, c, g, or t
  modified_base (426)..(432): a, c, t, g, unknown or other
  misc_feature (426)..(432): n is a, c, g, or t
tcagacagtatatacacgaccggtgctcgatttagtgtcacacgaagggaaagggctggagtgggtggccaacgtgaggcaagatggagttagtaaatactatgcggacagtttgaagggccgattcaccatctccagagacaacgccaagaactctctgtatctgcaaatgaccagcctgagagtcgaggacacggctgtgtattactgtgcgaccatatcagcgcctggagtccgttctgagtacttccaagattggggccagggcaccctggtcaccgtcgcctcagcctccaccaagggcccatcggtcttccccctggcgccctgctccaggngcacctccgagagcacagcggccctgggctgcctggtcaagggactacttcctatatactgtctgagcgggctggcaaggcgcatagnnnnnnn

SEQ ID NO: 55165 - DNA, 217 bp, Homo sapiens
  misc_feature: GYAE6OF01C4PCE.44.79.H02.1.454.CMB.1.raw
  modified_base (212)..(217): a, c, t, g, unknown or other
  misc_feature (212)..(217): n is a, c, g, or t
tcagacagtatatacacgaccggtgctcgatttagtgtcacacgaagggaaagggaaccctggtcaccgtctcctcagcctccaccaagggcccatcggtcttcccctggcgccctgctccaggagcacctccgagagcacagcggccctgggctgcctggtcaaggactacttcctatatactgtctgagcgggctggcaaggcgcatagnnnnnn

SEQ ID NO: 55166 - DNA, 435 bp, Homo sapiens
  misc_feature: GYAE6OF01A0LFW.44.79.H02.1.454.CMB.1.raw
  modified_base (428)..(435): a, c, t, g, unknown or other
  misc_feature (428)..(435): n is a, c, g, or t
tcagacagtatatacacgaccggtgctcgatttagtgtcacacgaagggaaaggggctggagtgggtggccaacgtgaggcaagatggagttagtaaatactatgcggacagtttgaagggccgattcaccatctccagagacaacgccaagaactctctgtatctgcaaatgaccagcctgagagtcgaggacacggctgtgtattactgtgcgaccatatcagcgcctggagtcctttctgagtacttccaagattggggccagggcaccctggtcaccgtcgcctcagcctccaccaagggcccatcggtcttcccctggccgccctgctccaggacgcacctctgggggcacacgcggccctgggctgcctggtcaaggactacttccacgtctactgctgagcgggctggcaaggcgcatagnnnnnnnn

SEQ ID NO: 55167 - DNA, 426 bp, Homo sapiens
  misc_feature: GYAE6OF01EOX9R.44.79.H02.1.454.CMB.1.raw
  modified_base (422)..(426): a, c, t, g, unknown or other
  misc_feature (422)..(426): n is a, c, g, or t
tcagacagtatatacacgaccggtgctcgatttagtgtcacacgaagggaaagggctggagtgggtggccaacgtgaggcaagatggagttagtaaatactatgcggacagtttgaagggccgattcaccatctccagagacaacgccaagaactctctgtatctgcaaatgaccagcctgagagtcgaggacacggctgtgtattactgtgcgaccatatcagcgcctggagtccgttctgagtacttccaagattggggccagggcaccctggtcaccgtcgcctcagcctccaccaagggcccatcggtcttcccctggcgccctgctccaggacgcacctccgagagcacagcgccctggctgcctggtcaaggctacttcctatatactgtctgagcgggctggcaaggcgcatagnnnnn

SEQ ID NO: 55168 - DNA, 573 bp, Homo sapiens
  misc_feature: GYAE6OF01BBBTY.44.79.H02.1.454.CMB.1.raw
  modified_base (514)..(514): a, c, t, g, unknown or other
  misc_feature (514)..(514): n is a, c, g, or t
  modified_base (517)..(517): a, c, t, g, unknown or other
  misc_feature (517)..(517): n is a, c, g, or t
  modified_base (523)..(524): a, c, t, g, unknown or other
  misc_feature (523)..(524): n is a, c, g, or t
  modified_base (532)..(532): a, c, t, g, unknown or other
  misc_feature (532)..(532): n is a, c, g, or t
  modified_base (534)..(534): a, c, t, g, unknown or other
  misc_feature (534)..(534): n is a, c, g, or t
  modified_base (548)..(548): a, c, t, g, unknown or other
  misc_feature (548)..(548): n is a, c, g, or t
  modified_base (550)..(550): a, c, t, g, unknown or other
  misc_feature (550)..(550): n is a, c, g, or t
  modified_base (552)..(552): a, c, t, g, unknown or other
  misc_feature (552)..(552): n is a, c, g, or t
  modified_base (555)..(556): a, c, t, g, unknown or other
  misc_feature (555)..(556): n is a, c, g, or t
  modified_base (561)..(561): a, c, t, g, unknown or other
  misc_feature (561)..(561): n is a, c, g, or t
  modified_base (567)..(568): a, c, t, g, unknown or other
  misc_feature (567)..(568): n is a, c, g, or t
  modified_base (570)..(572): a, c, t, g, unknown or other
  misc_feature (570)..(572): n is a, c, g, or t
tcagacagtatatacacgaccggtgctcgatttagtgtcacacgaagggtaaagggggtcggtggagtgggtaggccgaacgtggaggcgaagatggaagttagtaaagtactatgcggaccaggttttgaagggccgtattcacctatctccagagacaacgccaagaacctcgctgtatctgcaaactgaccaagcctgacgaggtcgaggactacggcgtggtggtagttacctgtgcgaaccatatcgacgcgcctgggaattccgttttctggagtacctttcccaaagaattagggggcctaagggcaccctggtccaccgtcgcctacaggccctccaccaacgggcccatcggtccttccccctggtccgcccgtgcttcccacgggacgccgaccctccgacgagcacaggcggcccgtggggctggcctgggtctaacgggacctacgttcctatattacgtgtactcggagccgggcgtcggcgaaagggcgtcgagtacggntancgtgcnnatatatcncncgcgcgcgacgagngngngannacgancgtcgnncnnnc

SEQ ID NO: 55169 - DNA, 427 bp, Homo sapiens
  misc_feature: GYAE6OF01BLAEV.44.79.H02.1.454.CMB.1.raw
  modified_base (421)..(427): a, c, t, g, unknown or other
  misc_feature (421)..(427): n is a, c, g, or t
tcagacagtatatacacgaccggtgctcgatttagtgtcacacgaagggaaaggggctggagtgggtggccaacgtgaggcaagatggagttagtaaatactatgcggacagtttgaagggccgattcaccatctccagagacaacgccaagaactctctgtatctgcaaatgaccagcctgagagtcgaggacacggctgtgtattactgtgcgaccatatcagcgcctggagtccgttctgagtacttccaagattggggccagggcaccctggtcaccgtcgcctcagcctccaccaagggcccatcggtcttcccctggcgccctgctccaggagcacctccgagagcacagcggccctggctgcctggtcaaggctacttcctatatactgtctgagcggctggcaggcgcatagnnnnnnn

SEQ ID NO: 55170 - DNA, 441 bp, Homo sapiens
  misc_feature: GYAE6OF01CY0EZ.44.79.H02.1.454.CMB.1.raw
  modified_base (440)..(441): a, c, t, g, unknown or other
  misc_feature (440)..(441): n is a, c, g, or t
tcagacagtatatacacgaccggtgctcgatttagtgtcacacgaagggaaagggctggagtgggtggccaacgtgaggcaagatggagttagtaaatactatgcggacagtttgaagggccgattcaccatctccagagacaacgccaagaactctctgtatctgcaaaatgaacagcctgagagccgaggacacggctgtgtattactgtgcgaggacatattgtagtactaccacctgctgggactactactacggtatggacgtctggggccaaagggaccacggtcaccgtctcctcagcctcaccaagggcccatcggtcttccccctggcaccctcctccaagagcacctctgggggcacagcggccctgggctgcctggtcaaaggactacttcctaatatactgtctgagcgggctggcaaggcgcatagnn

SEQ ID NO: 55171 - DNA, 439 bp, Homo sapiens
  misc_feature: GYAE6OF01CJHFF.44.79.H02.1.454.CMB.1.raw
  modified_base (330)..(330): a, c, t, g, unknown or other
  misc_feature (330)..(330): n is a, c, g, or t
  modified_base (428)..(428): a, c, t, g, unknown or other
  misc_feature (428)..(428): n is a, c, g, or t
  modified_base (433)..(439): a, c, t, g, unknown or other
  misc_feature (433)..(439): n is a, c, g, or t
tcagacagtatatacacgaccggtgctcgatttagtgtcacacgaagggaaaggggctggagtgggtggccaacgtgaggcaagatggagttagtaaatactatgcggacagtttgaagggccgattcaccatctccagagacaacgccaagaactctctgtatctgcaaatgaccagcctgagagtcgaggacacggctgtgtattactgtgcgaccatatcagcgcctggagtccgttctgagtacttccaagattggggccagggcaccctggtcaccgtcgcctcagcctccaccaagggcccatccggtccttccccctgggccncccctgcctccaggacgcaccgtccgagacgcacagcggccctgggctgcctggcaaggtctactcctatatactgtctgagcgggctggctaaggcncatgnnnnnnn

SEQ ID NO: 55172 - DNA, 488 bp, Homo sapiens
  misc_feature: GYAE6OF01CIPWM.44.79.H02.1.454.CMB.1.raw
  modified_base (245)..(245): a, c, t, g, unknown or other
  misc_feature (245)..(245): n is a, c, g, or t
  modified_base (351)..(351): a, c, t, g, unknown or other
  misc_feature (351)..(351): n is a, c, g, or t
  modified_base (369)..(369): a, c, t, g, unknown or other
  misc_feature (369)..(369): n is a, c, g, or t
  modified_base (467)..(467): a, c, t, g, unknown or other
  misc_feature (467)..(467): n is a, c, g, or t
  modified_base (474)..(488): a, c, t, g, unknown or other
  misc_feature (474)..(488): n is a, c, g, or t
tcagacagtatatacacgaccggtgctcgatttagtgtcacacgaagggaaaggggctggagtgggtggccaacgtgaggcaagatggagttagtaaatactatgcggacagtttgaagggccgattcaccatctccagagacaacgccaagaactctctgtatctgacaaatgaccagcctgagagtcgaggacacggctgtgtattactgtgcgaccatatcagcgcctggacgttcccgttnagacgttaccttaccaagtagtttcggggccaggggtcaacccttggtccaccgtcgccctcacgccctccaccaagggccccagtccggtccttccccgtgcccnccctcgcctccgaggacnccgaacctccgaggcgacacgacggccggcccgtgggcctcgccgtggtccaaaggccttactccacgtctacctgcgtgacgtcggctggacaggcncatagcnnnnnnnnnnnnnnn

SEQ ID NO: 55173 - DNA, 589 bp, Homo sapiens
  misc_feature: GYAE6OF01ANBZQ.44.79.H02.1.454.CMB.1.raw
  modified_base (183)..(183): a, c, t, g, unknown or other
  misc_feature (183)..(183): n is a, c, g, or t
  modified_base (216)..(216): a, c, t, g, unknown or other
  misc_feature (216)..(216): n is a, c, g, or t
  modified_base (228)..(228): a, c, t, g, unknown or other
  misc_feature (228)..(228): n is a, c, g, or t
  modified_base (531)..(531): a, c, t, g, unknown or other
  misc_feature (531)..(531): n is a, c, g, or t
  modified_base (537)..(537): a, c, t, g, unknown or other
  misc_feature (537)..(537): n is a, c, g, or t
  modified_base (539)..(539): a, c, t, g, unknown or other
  misc_feature (539)..(539): n is a, c, g, or t
  modified_base (552)..(552): a, c, t, g, unknown or other
  misc_feature (552)..(552): n is a, c, g, or t
  modified_base (556)..(556): a, c, t, g, unknown or other
  misc_feature (556)..(556): n is a, c, g, or t
  modified_base (559)..(559): a, c, t, g, unknown or other
  misc_feature (559)..(559): n is a, c, g, or t
  modified_base (562)..(562): a, c, t, g, unknown or other
  misc_feature (562)..(562): n is a, c, g, or t
  modified_base (564)..(564): a, c, t, g, unknown or other
  misc_feature (564)..(564): n is a, c, g, or t
  modified_base (568)..(568): a, c, t, g, unknown or other
  misc_feature (568)..(568): n is a, c, g, or t
  modified_base (572)..(572): a, c, t, g, unknown or other
  misc_feature (572)..(572): n is a, c, g, or t
  modified_base (574)..(574): a, c, t, g, unknown or other
  misc_feature (574)..(574): n is a, c, g, or t
  modified_base (576)..(578): a, c, t, g, unknown or other
  misc_feature (576)..(578): n is a, c, g, or t
  modified_base (581)..(582): a, c, t, g, unknown or other
  misc_feature (581)..(582): n is a, c, g, or t
  modified_base (584)..(584): a, c, t, g, unknown or other
  misc_feature (584)..(584): n is a, c, g, or t
  modified_base (586)..(586): a, c, t, g, unknown or other
  misc_feature (586)..(586): n is a, c, g, or t
tcagacagtatatacacgaccggtgctcgattttagtgtcacacgaagggaaaggggctgggagtgggtggaccaacgtgaggcaagatcggagttagtaaatacttatgcggacagtttgaagggccgattcaccatctccgagagacaacgccaagaacctctctgtatctgcaatgaccngcctgagagtcgagacacggctagtgtattacngtgccgaccatntcagccgctggagttccgttatgacttacttcaagtagttgggaccagggcacccgtggtccaccgtcgcctcacgccctaccgaccgacggccctacgtccggtcccttcccccgtggcccgcccgtcgccgtaccgacgggacgccgacccgtaccggagacgcccaacgacggtcccggcccgtcgggtcctcggacccgttcgggtaccgaaacggacccttaaccgttccaaccggttcctaacgttgacgtcgggaggtccgggtcgtacggtacgacggaccgcgagttaacgctnacggtncngcgagtcgtcganagcncgngangnacgngtgngncnnncanncncncgc

SEQ ID NO: 55174 - DNA, 495 bp, Homo sapiens
  misc_feature: GYAE6OF01B2Y4J.44.79.H02.1.454.CMB.1.raw
  modified_base (480)..(495): a, c, t, g, unknown or other
  misc_feature (480)..(495): n is a, c, g, or t
tcagacagtatatacacgaccggtgctcgatttagtgtcacacgaagggaaaggggctggagtgggtggccaacgtgaggcaagatggagttagtaaatactatgcggacagtttgaagggccgattcaccatctccagagacaacgccaagaactctctgtatctgcaaatgaccagcctgagagtcgaggacacggctgtgtattactgtgcgaccatatcagcgcctggagtccgttctgagttaccttccaagtagttggggccagggccaccctggtcaccgtcgcctcacgccctccaccgaacgggcccagtccggtccttccccccgtggccgcccctgcctccgaggacgccaccctccgaagacgacacacgccggccccgtgggccctcggcccgtgggtccaaacgggtaccttaccgttcccacgtccttactgcttggacgcgggctgggcaacgggcgcagtagnnnnnnnnnnnnnnnn

SEQ ID NO: 55175 - DNA, 438 bp, Homo sapiens
  misc_feature: GYAE6OF01BAJE8.44.79.H02.1.454.CMB.1.raw
  modified_base (241)..(241): a, c, t, g, unknown or other
  misc_feature (241)..(241): n is a, c, g, or t
  modified_base (422)..(422): a, c, t, g, unknown or other
  misc_feature (422)..(422): n is a, c, g, or t
  modified_base (428)..(438): a, c, t, g, unknown or other
  misc_feature (428)..(438): n is a, c, g, or t
tcagacagtatatacacgaccggtgctcgatttagtgtcacacgaagggaaaggggctggagtgggtggccaacgtgaggcaagatggagttagtaaatactatgcggacagtttgaagggccgattcaccatctccagagacaacgccaagaactctctgtatctgcaaatgaccagcctgagagtcgaggacacggctgtgtattactgtgcgaccatatcagcgcctggagtccgttntgagtacttccaagattggggccagggcaccctggtcaccgtcgcctcagcctccaccaagggcccatcggtcttccccctggcgcccctgctccaggagcacctccgagagcacagcggccctgggctgcctggtcaaggctacttcctatactactgtctgagcgggctggcaagggcncatagnnnnnnnnnnn

SEQ ID NO: 55176 - DNA, 506 bp, Homo sapiens
  misc_feature: GYAE6OF01AXL0X.44.79.H02.1.454.CMB.1.raw
  modified_base (443)..(443): a, c, t, g, unknown or other
  misc_feature (443)..(443): n is a, c, g, or t
  modified_base (478)..(506): a, c, t, g, unknown or other
  misc_feature (478)..(506): n is a, c, g, or t
tcagacagtatatacacgaccggtgctcgatttagtgtcacacgaagggaaaggggctggagtgggtggccaacgtgaggcaagatggagttagtaaatactatgcggacagtttgaagggccgattcaccatctccagagacaacgccaagaactctctgtatctgcaaatgaccagcctgagagtcgaggacacggctgtgtattactgtgcgaccatatcagcgcctggagtccgttctgagtacttccaagattggggccagggccacccgtggtccaccgtcgcctcacgccctccaccgacggccctatccggtccttcccccgtggccgcccctgcctccgagggacgccaccgtccgagacgcacgcgcccggcccgtggggcctcggcccgtgggtaccaacggccttaactccctaattacgttacctgttcnggacggcgggctcgggacgtaagggcgacagtagnnnnnnnnnnnnnnnnnnnnnnnnnnnnn

SEQ ID NO: 55177 - DNA, 504 bp, Homo sapiens
  misc_feature: GYAE6OF01EYG0H.44.79.H02.1.454.CMB.1.raw
  modified_base (474)..(474): a, c, t, g, unknown or other
  misc_feature (474)..(474): n is a, c, g, or t
  modified_base (478)..(504): a, c, t, g, unknown or other
  misc_feature (478)..(504): n is a, c, g, or t
tcagacagtatatacacgaccggtgctcgattttagtgtcacacgaagggaaaggggctggagtgggtggccaacgtgaggcaagatggagttagtaaatactatgcggacagtttgaagggccgattcaccatctccagagacaacgccaagaactctctgtatctgcaaatgaccagcctgagagtcgaggacacggctgtgtattactgtgcgacatatcagcgcctggatccgttctgacgtacttccaagattggggccagggcaccctggtcaccgtcgcctcacgcctccaccgaacgggcccacgtccggtcccttcccccgtcgggccgcccctcggcctacccgagggacgccgacctccgagacgcacagccggcccgtgggctcgcctggtacaacggtactacttcctaattactacctgtctagaggtccggggctggaccgaagggcgtacgacgtagnacgnnnnnnnnnnnnnnnnnnnnnnnnnnn

SEQ ID NO: 55178 - DNA, 596 bp, Homo sapiens
  misc_feature: GYAE6OF01A9UGS.44.79.H02.1.454.CMB.1.raw
  modified_base (393)..(393): a, c, t, g, unknown or other
  misc_feature (393)..(393): n is a, c, g, or t
  modified_base (567)..(571): a, c, t, g, unknown or other
  misc_feature (567)..(571): n is a, c, g, or t
  modified_base (574)..(580): a, c, t, g, unknown or other
  misc_feature (574)..(580): n is a, c, g, or t
  modified_base (582)..(596): a, c, t, g, unknown or other
  misc_feature (582)..(596): n is a, c, g, or t
tcagacagtatatacacgaccggtgctcgatttagtgtcacacgaagggaaaggggctggagtgggtggccaacgtgaggcaagatggagttagtaaatactatgcggacagtttggaagggccgattcaccatctccagagacaacgccaagaactctctgtatctgcaaatcgaccagcctgagagtcgaggacgacggtctgtgtacttacgtgtcgcgaacctatactcacggtccgccgtgggtacgttcccggtttcaggtacgttacccttaccgaaggtaacggttcggggaccgacgggccgtaccgtcggtaccgtaccgtccgccctcgcgccctacccacgtaccggcccacgtccgtccctccccgtcgcccgtccgtcnccgtaccgcggacgccctaccgaccgacgacgaccgacgtacggcccggccggtcggtccgcgtacccggttacggtacggaacgtacctttcccgtaccgtaccggttacctacgtcggtaacgtcgggaccggtcgggtcgacggacggacggtcgacgtactaggctcgannnnngcnnnnnnncnnnnnnnnnnnnnnn

SEQ ID NO: 55179 - DNA, 592 bp, Homo sapiens
  misc_feature: GYAE6OF01BWTE5.44.79.H02.1.454.CMB.1.raw
  modified_base (562)..(562): a, c, t, g, unknown or other
  misc_feature (562)..(562): n is a, c, g, or t
  modified_base (564)..(566): a, c, t, g, unknown or other
  misc_feature (564)..(566): n is a, c, g, or t
  modified_base (568)..(592): a, c, t, g, unknown or other
  misc_feature (568)..(592): n is a, c, g, or t
tcagacagtatatacacgaccggtgctcgatttagtgtcacacgaagggaaagggctggagtgggtggccaacgtgaggcaagatggagttagtaaatactatgcggacagtttgaagggccgattcaccatctccagagacaacgccaagaactctctgtatctgcaaatgaccagcctgagagtcgaggacacggctgtgtattactgtgcgaccagtactcagccgcctgggtacgttccgttctgattaccgttccaaagtagttcggggccgagggccacccgtggtccaccgtcgcctcgacgccctccgaccgaacgggccctacgtccggtcccttcccccgtcgggccgtccccgtcggccttccgaacgggtacgcccgtaacccgtccggagtaccggacaacgacggcccgggcccgttcggggctccggtccggttacggtaccgaaaggtacccgttactaccccgtagaccgttccgggcgtttaccgtacgggacgggccggggtacgtcgggaccggaaacgggtccgaactacggtagctgacncnnngnnnnnnnnnnnnnnnnnnnnnnnnn

SEQ ID NO: 55180 - DNA, 298 bp, Homo sapiens
  misc_feature: GYAE6OF01DXAM9.44.79.H02.1.454.CMB.1.raw
  modified_base (262)..(298): a, c, t, g, unknown or other
  misc_feature (262)..(298): n is a, c, g, or t
tcagacagtatatacacgaccggtgctcgatttagtgtcacacgaagggaaagggaaccctggtcaccgtctcctcagcctccaccaagggcccatccggtccttccccctggccgccctgctccaggacgctaccctccggagagccacgaggccggcccgtgggctcgcccgttgggtacaaacggtaccttacctttaccttaatacttaccgtgtccgtaggacggtcgggtcgtcggacgaacgggcgacagtaggnnnnnnnnnnnnnnnnnnnnnnnnnnnnnnnnnnnnn

SEQ ID NO: 55181 - DNA, 684 bp, Homo sapiens
  misc_feature: GYAE6OF01EMCP3.44.79.H02.1.454.CMB.1.raw
  modified_base (652)..(652): a, c, t, g, unknown or other
  misc_feature (652)..(652): n is a, c, g, or t
  modified_base (655)..(658): a, c, t, g, unknown or other
  misc_feature (655)..(658): n is a, c, g, or t
  modified_base (660)..(660): a, c, t, g, unknown or other
  misc_feature (660)..(660): n is a, c, g, or t
  modified_base (662)..(684): a, c, t, g, unknown or other
  misc_feature (662)..(684): n is a, c, g, or t
tcagacagtatatacacgaccggtgctcgatttagtgtcacacgaagggaaagggctggagtgggtggccaacgtgaggcaagatggagttagtaaatactatgcggacagtttgaagggccgattcaccatctccagagacaacgccaagaactctctgtatctgcaaatgaccagcctgagagtcgaggacacggctgtgtattactgtgcgacatatcagcgcctgggacgttccgttctggtacgttacttccgaagtagttcgggggccgtacgggcctacccgtcgggtccaacccggttccggcccttccgaccggtcccctacccgaacccgaaccggggtcccctaacgttccccggttcccctttccccccggtcgggccccgtcccccgtaccgtcccgttacccgaacgggacccgcccgaacccgttacccggaacgaccggtccgaaaccggacggtcccccgggtccccggtcggggtcccttccgggccccgtttaacggggtaccgtaaaaccggggttaccctttaaccccgttttaccctaacgtttaaccgttacgtttacggttcccttaggggaacccggtcggggtccgtacggggaccgtaaacggggccgaacctagtcgaggtcancgnnnngnannnnnnnnnnnnnnnnnnnnnnn

SEQ ID NO: 55182 - DNA, 463 bp, Homo sapiens
  misc_feature: GYAE6OF02ICX6H.44.79.H02.1.454.CMB.1.raw
  modified_base (330)..(330): a, c, t, g, unknown or other
  misc_feature (330)..(330): n is a, c, g, or t
  modified_base (334)..(334): a, c, t, g, unknown or other
  misc_feature (334)..(334): n is a, c, g, or t
  modified_base (345)..(345): a, c, t, g, unknown or other
  misc_feature (345)..(345): n is a, c, g, or t
  modified_base (367)..(367): a, c, t, g, unknown or other
  misc_feature (367)..(367): n is a, c, g, or t
  modified_base (426)..(426): a, c, t, g, unknown or other
  misc_feature (426)..(426): n is a, c, g, or t
  modified_base (434)..(463): a, c, t, g, unknown or other
  misc_feature (434)..(463): n is a, c, g, or t
tcagacagtatatacacgaccggtgctcgatttagtgtcacacgaaggggaaaggggtcgtgggagtgggtcggccaacgtgaggcaagatggagttagtaaatactagtcgcggacagtttgaacgggccgattccaccatctccagagacaaccgccaagaactctctgtatctgcaaatgacccagcctgagagtcgaggacacggctgtgtattacgtgtgcgaccatatcagcgcctggatccgttctagagttacttccaagattggggccagggcaccctggtcacgtcgcctcagcctccaccaaggccatcggtctccccnggcncctgctcagancacctcgagagcacagcggccngggctgcctggtcaaggactacttctatactactgtctgagcgggactggacaaggtcncatagcannnnnnnnnnnnnnnnnnnnnnnnnnnnnn

SEQ ID NO: 55183 - DNA, 213 bp, Homo sapiens
  misc_feature: GYAE6OF02GGE1G.44.79.H02.1.454.CMB.1.raw
  modified_base (212)..(213): a, c, t, g, unknown or other
  misc_feature (212)..(213): n is a, c, g, or t
tcagacagtatatacacgaccggtgctcgatttagtgtcacacgaagggaaagggaaccctggtcaccgtctcctcagcctccaccaagggcccatcggtcttcccctggcgccctgctccaggagcacctccgagagcacagcggccctgggctgcctggtcaaggactacttcctatatactgtctgagcgggctggcaaggcgcatagnn

SEQ ID NO: 55184 - DNA, 430 bp, Homo sapiens
  misc_feature: GYAE6OF02FUQ4W.44.79.H02.1.454.CMB.1.raw
  modified_base (425)..(430): a, c, t, g, unknown or other
  misc_feature (425)..(430): n is a, c, g, or t
tcagacagtatatacacgaccggtgctcgatttagtgtcacacgaagggaaagggctggagtgggtggccaacgtgaggcaagatggagttagtaaatactatgcggacagtttgaagggccgattcaccatctccagagacaacgccaagaactctctgtatctgcaaatgaccagcctgagagtcgaggacacggctgtgtattactgtgcgaccatatcagcgcctggagtccgttctgagtacttccaagattggggccagggcaccctggtcaccgtcgcctcagcctccaccaagggcccatcggtcttccccctggcgccctgctccaggagcacctccgagagcacagcggccctgggctgcctggtcaagggctacttcctatatactgtctgagcgggctggcaaggcgcatagnnnnnn

SEQ ID NO: 55185 - DNA, 213 bp, Homo sapiens
  misc_feature: GYAE6OF02G7268.44.79.H02.1.454.CMB.1.raw
  modified_base (212)..(213): a, c, t, g, unknown or other
  misc_feature (212)..(213): n is a, c, g, or t
tcagacagtatatacacgaccggtgctcgatttagtgtcacacgaagggaaagggaaccctggtcaccgtctcctcagcctccaccaagggcccatcggtcttcccctggcgccctgctccaggagcacctccgagagcacagcggccctgggctgcctggtcaaggactacttccacgtctactgctgagcgggctggcaaggcgcatagnn

SEQ ID NO: 55186 - DNA, 436 bp, Homo sapiens
  misc_feature: GYAE6OF02F1H6N.44.79.H02.1.454.CMB.1.raw
  modified_base (341)..(341): a, c, t, g, unknown or other
  misc_feature (341)..(341): n is a, c, g, or t
  modified_base (421)..(421): a, c, t, g, unknown or other
  misc_feature (421)..(421): n is a, c, g, or t
  modified_base (427)..(436): a, c, t, g, unknown or other
  misc_feature (427)..(436): n is a, c, g, or t
tcagacagtatatacacgaccggtgctcgatttagtgtcacacgaagggaaaggggctggagtgggtggccaacgtgaggcaagatggagttagtaaatactatgcggacagtttgaagggccgattcaccatctccagagacaacgccaagaactctctgtatctgcaaatgaccagcctgagagtcgaggacacggctgtgtattactgtgcgaccatatcagcgcctggagtccgttctgagtacttccaagattggggccagggcaccctggtcaccgtcgcctcagcctccaccaagggcccatcggtcttccccctggccgccctgctccaggancacctccgagagcacagcggccctgggctgcctggtcaacggactactccacgtctactgctgagcgggctggcaaggcncatagnnnnnnnnnn

SEQ ID NO: 55187 - DNA, 432 bp, Homo sapiens
  misc_feature: GYAE6OF02HYLH9.44.79.H02.1.454.CMB.1.raw
  modified_base (427)..(432): a, c, t, g, unknown or other
  misc_feature (427)..(432): n is a, c, g, or t
tcagacagtatatacacgaccggtgctcgatttagtgtcacacgaagggaaaggggctggagtgggtggccaacgtgaggcaagatggagttagtaaatactatgcggacagtttgaagggccgattcaccatctccagagacaacgccaagaactctctgtatctgcaaatgaccagcctgagagtcgaggacacggctgtgtattactgtgcgaccatatcagcgcctggagtccgttctgagtacttccaagattggggccagggcaccctggtcaccgtcgcctcagcctccaccaagggcccatcggtcttccccctggccgccctgctccaggagcacctccgagagcacagcggccctgggctgcctggtcaaggactacttccacgtctactgctgagcgggctggcaaggcgcatagnnnnnn

SEQ ID NO: 55188 - DNA, 403 bp, Homo sapiens
  misc_feature: GYAE6OF02GL2N4.44.79.H02.1.454.CMB.1.raw
  modified_base (400)..(403): a, c, t, g, unknown or other
  misc_feature (400)..(403): n is a, c, g, or t
tcagacagtatatacacgaccggtgctcgatttagtgtcacacgaagggaaaggggctggagtgggtggcagtcatctggtctgatggaagtaaagaatactatggaaactccgtgaagggccgattctccgtctccagagacaattccaagaacaccgtgtatctacaaatgaacaatttgagagccgaggactcggctctctattattgtacgagcccatcgttctactggggccagggagccctggtcaccgtctcctcagcctccaccaagggcccatcggtcttccccctggcgccctgctccaggagcacctccgagacgcacagcggccctgggctgcctggtcaaggctacttcctcgatcgcgtctgagcgggctgggcaaggcgcatagnnnn

SEQ ID NO: 55189 - DNA, 448 bp, Homo sapiens
  misc_feature: GYAE6OF02JHT2S.44.79.H02.1.454.CMB.1.raw
  modified_base (393)..(393): a, c, t, g, unknown or other
  misc_feature (393)..(393): n is a, c, g, or t
  modified_base (430)..(448): a, c, t, g, unknown or other
  misc_feature (430)..(448): n is a, c, g, or t
tcagacagtatatacacgaccggtgctcgatttagtgtcacacgaagggaaaggggctggagtgggtggccaacgtgaggcaagatggagttagtaaatactatgcggacagtttgaagggccgattcaccatctccagagacaacgccaagaactctctgtatctgcaaatgaccagcctgagagtcgaggacacggctgtgtattactgtgcgaccatatcagcgcctggagtccgttctgagtacttccaagattggggccagggcaccctggtcaccgtcgcctcagcctccaccagggcccatcggtcttccccctggccgccctgctccaggacgcacctccgagacgcacagcggccctgggctgcctggtcaaggctaccttccncgatcgcgtctgagcgggctggcaacggcgcagtagnnnnnnnnnnnnnnnnnnn

SEQ ID NO: 55190 - DNA, 431 bp, Homo sapiens
  misc_feature: GYAE6OF02H50BH.44.79.H02.1.454.CMB.1.raw
  modified_base (419)..(419): a, c, t, g, unknown or other
  misc_feature (419)..(419): n is a, c, g, or t
  modified_base (424)..(431): a, c, t, g, unknown or other
  misc_feature (424)..(431): n is a, c, g, or t
tcagacagtatatacacgaccggtgctcgatttagtgtcacacgaagggaaaggggctggagtgggtggccaacgtgaggcaagatggagttagtaaatactatgcggacagtttgaagggccgattcaccatctccagagacaacgccaagaactctctgtatctgcaaatgaccagcctgagagtcgaggacacggctgtgtattactgtgcgaccatatcagcgcctggagtccgttctgagtacttccaagattggggccagggcaccctggtcaccgtcgcctcagcctccaccaagggcccatcggtcttccccctggcgccctgctccaggagcacctccgagagcacagcggcctgggctgcctggtcaaggctacttcctatatactgtctgagcgggctggcaaggcgnatagnnnnnnnn
